US012644131B2

(12) United States Patent
Gradinaru et al.

(10) Patent No.: US 12,644,131 B2
(45) Date of Patent: Jun. 2, 2026

(54) VIRUS COMPOSITIONS WITH ENHANCED SPECIFICITY IN THE BRAIN

(71) Applicant: California Institute of Technology, Pasadena, CA (US)

(72) Inventors: Viviana Gradinaru, Pasadena, CA (US); Sripriya Ravindra Kumar, Chennai (IN); Benjamin Deverman, Boston, MA (US)

(73) Assignee: California Institute of Technology, Pasadena, CA (US)

( * ) Notice: Subject to any disclaimer, the term of this patent is extended or adjusted under 35 U.S.C. 154(b) by 1048 days.

(21) Appl. No.: 17/602,505

(22) PCT Filed: Apr. 10, 2020

(86) PCT No.: PCT/US2020/027708
§ 371 (c)(1),
(2) Date: Oct. 8, 2021

(87) PCT Pub. No.: WO2020/210655
PCT Pub. Date: Oct. 15, 2020

(65) Prior Publication Data
US 2022/0220502 A1 Jul. 14, 2022

Related U.S. Application Data

(60) Provisional application No. 62/832,826, filed on Apr. 11, 2019.

(51) Int. Cl.
*C12N 15/80* (2006.01)
*C07K 14/005* (2006.01)
*C12N 7/00* (2006.01)
*C12N 15/86* (2006.01)

(52) U.S. Cl.
CPC ........... *C12N 15/86* (2013.01); *C07K 14/005* (2013.01); *C12N 7/00* (2013.01); *C12N 2750/14122* (2013.01); *C12N 2750/14143* (2013.01); *C12N 2750/14151* (2013.01); *C12N 2750/14171* (2013.01)

(58) Field of Classification Search
CPC .................. C07K 14/005; C12N 15/86; C12N 2750/14122; C12N 2750/14143; C12N 2750/14151; C12N 2750/14145; A61K 48/00; A61K 31/7105; A61K 38/465; A61K 47/64; A61P 25/00
USPC ...................................................... 435/320.1
See application file for complete search history.

(56) References Cited

U.S. PATENT DOCUMENTS 6,566,118 B1 5/2003 Atkinson et al.
2015/0079038 A1 3/2015 Deverman et al.
2018/0230186 A1 8/2018 Deverman et al.

FOREIGN PATENT DOCUMENTS

JP 2019-506141 A 3/2019
JP 2019-509032 A 4/2019
WO 1998/09657 A2 3/1998
WO 2017/100671 A1 6/2017
WO 2019/046069 A1 3/2019

OTHER PUBLICATIONS

Devos et al., Proteins: Structure, Function and Genetics, 2000, vol. 41: pp. 98-107.*
Whisstock et al., Quarterly Reviews of Biophysics , 2003, vol. 36 (3): pp. 307-340.*
Witkowski et al., Biochemistry, 1999, 38:, pp. 11643-11650.*
Kisselev L., Structure, 2002, vol. 10: pp. 8-9.*
Extended European Search Report issued in European Application No. 20787580.8, Mach 10, 2023, 12 pages.
Korbelin, 2016, A brain microvasculature endothelial cell specific viral vector with the potential to treat neurovascular and neurological diseases, EMBO Molecular Medicine (Online), 8(6):609-625.
Challis, 2019, Systemic AAV vectors for widespread and targeted gene delivery in rodents, Nat Protoc 14(2):379-414.
Chan, 2017, Engineered AAV's for efficient noninvasive gene delivery to the central and peripheral nervous systems, Nat. Neurosci 20:1172-1179.
Clark, 1999, Highly purified recombinant adeno-associated virus vectors are biologically active and free of detectable helper and wild-type viruses, Hum Gene Ther., 10(6):1031-9.
De, 2006, High levels of persistent expression of alpha1-antitrypsin mediated by the nonhuman primate serotype rh. 10 adeno-associated virus despite preexisting immunity to common human adeno-associated viruses, Mol. Ther. 13(1):67-76.
Deverman, 2016, Credependent selection yields AAV variants for widespread gene transfer to the adult brain, Nat. Biotechnol. 34:204-209.
Gao, 2004, Clades of Adeno-Associated Viruses are Widely Disseminated in Human Tissues, J Virol 78:6381-6388.
International Search Report and Written Opinion issued in International Application No. PCT/US2020/27708, date of mailing: Jul. 29, 2020, 9 pages.
Mori, 2004, Two novel adeno-associated viruses from cynomolgus monkey: pseudotyping characterization of capsid protein, Virology 330(2):375-383.

(Continued)

*Primary Examiner* — Tekchand Saidha
*Assistant Examiner* — Mohammad Y Meah
(74) *Attorney, Agent, or Firm* — Brown Rudnick LLP; Adam M. Schoen

(57) ABSTRACT

Provided are compositions and kits comprising recombinant adeno-associated viruses (rAAVs) with tropisms showing increased specificity and efficiency of viral transduction in targeted cell-types, for e.g., the brain and the liver. Therapeutic and biomedical research applications of the rAAVs are also described, including without limitation methods of discovering rAAVs using a multiplexed Cre recombination-based AAV targeted evolution (M-CREATE) method, and methods of treating various diseases and conditions by rAAV-mediated transgene therapy.

12 Claims, 215 Drawing Sheets

Specification includes a Sequence Listing.

(56) References Cited

OTHER PUBLICATIONS

Schnepp, 2002, Highly purified recombinant adeno-associated virus vectors. Preparation and quantification, Methods Mol. Med., 69:427-43.

Srivastava, 1983, Nucleotide sequence and organization of the adeno-associates virus 2 genome, J Virol 45(2):555-564.

* cited by examiner

*AAV9: 60-mer*     *Trimer*     *Monomer*

*3-fold axis*     *588-589 insertion site*
*5-fold axis*     *in 3-fold axis*

R1 *pre-in vivo* selection

Relative abundance of variants

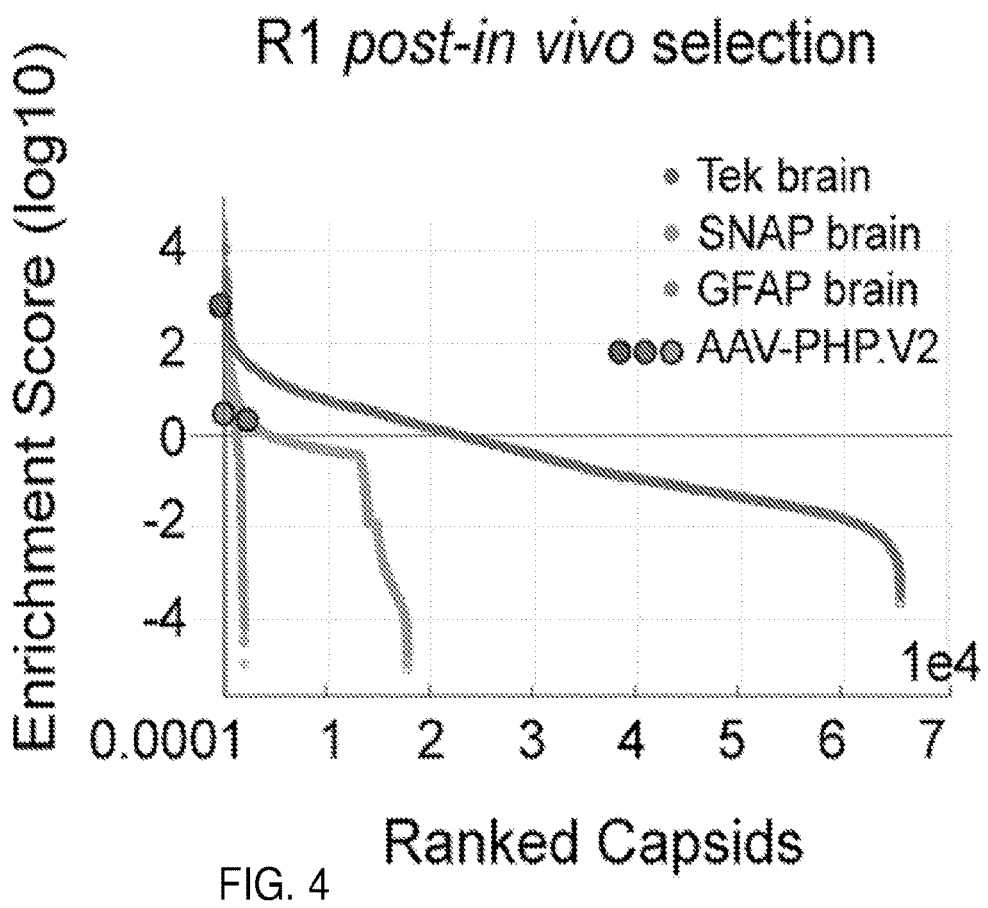
FIG. 4
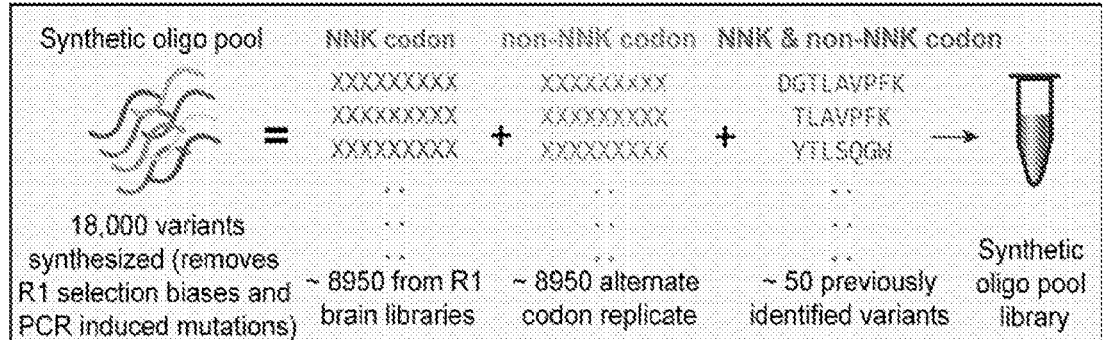
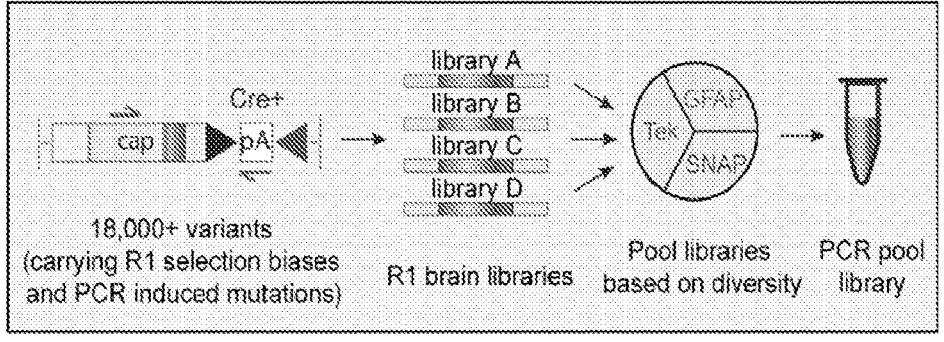
FIG. 5

Codon 1: enrichment score (log10)

```
                          588         589
                           ▼           ▼

AAV9:          AQ-------AQ
PHP.B:         AQTLAVPFKAQ
PHP.eB:        DGTLAVPFKAQ

PHP.V1:        AQTALKPFLAQ
PHP.V2:        AQTTLKPFLAQ
PHP.B4:        AQTLQIPFKAQ
PHP.B5:        AQTLQLPFKAQ
PHP.B6:        AQTLQQPFKAQ
PHP.B7:        AQSIERPFKAQ
PHP.B8:        AQTMQKPFIAQ
PHP.C1:        AQRYQGDSVAQ
```

FIG. 13

*Neurons*

*Astrocytes*

*Oligodendrocyte lineage cells*

*Vgat brain library*

*AAV-PHP.N (1x10¹¹vg/adult C57BL/6J)*

```
                        588          589
                         ▼            ▼

AAV9:    AQ-------AQ

PHP.V1:    AQTALKPFLAQ
       PHP.V2:    AQTTLKPFLAQ
        PHP.N:    AQTLAVPFSNP
       PHP.eB:    DGTLAVPFKAQ
        PHP.B:    AQTLAVPFKAQ
       PHP.B2:    AQSVSKPFLAQ
       PHP.B3:    AQFTLTTPKAQ
       PHP.B4:    AQTLQIPFKAQ
       PHP.B5:    AQTLQLPFKAQ
       PHP.B6:    AQTLQQPFKAQ
       PHP.B7:    AQSIERPFKAQ
       PHP.B8:    AQTMQKPFIAQ

PHP.C1:    AQRYQGDSVAQ
       PHP.C2:    AQWSTNAGYAQ
       PHP.C3:    AQERVGFAQAQ
```

| Enrich_ rank (within libraries) | SEQ ID NO: | Sequence (for 11 mer AA) | SEQ ID NO: | 11 mer Amino Acid | SEQ ID NO: | 7 mer Amino acid | Brain- mean- enrichme nt score (log10) | Brain- mean- standardiz ed-read count |
|---|---|---|---|---|---|---|---|---|
| SyS1 | 1074 | GCCCAAACGTTGCAGATTCCTTTAAGGCACAG | 5663 | AQTLQIPFKAQ | 10252 | TLQIPFK | 2.730563 | 26.96166 |
| TS1 | 1075 | GCCCAAACCGCCCTCAAACCCTTCCTCGCACAG | 5664 | AQTALKPFLAQ | 10253 | TALKPFL | 2.536397 | 6.252175 |
| TS2 | 1076 | GCCCAAACCACCCTCAAACCCTTCCTCGCACAG | 5665 | AQTTLKPFLAQ | 10254 | TTLKPFL | 2.513839 | 10.4831 |
| SyS2 | 1077 | GCCCAAAGCATCGAAAGACCCTTCAAAGCACAG | 5666 | AQSIERPFKAQ | 10255 | SIERPFK | 2.357132 | 30.18586 |
| GS4 | 1078 | GCCCAAACCCAAAACAGACCCTTCCTCGCACAG | 5667 | AQTQNRPFLAQ | 10256 | TQNRPFL | 2.22812 | 8.911382 |
| TS3 | 1079 | GCCCAAACCATGCAAAAACCCTTCATCGCACAG | 5668 | AQTMQKPFIAQ | 10257 | TMQKPFI | 2.165359 | 12.68417 |
| GS5 | 1080 | GCCCAAACTAGTACGCGGCCGTTTTGGCACAG | 5669 | AQTSTRPFLAQ | 10258 | TSTRPFL | 2.14357 | 7.139476 |
| SyS5 | 1081 | GCCCAAGGCACCTTCGTCCCCCACCGCACAG | 5670 | AQGTFVPPTAQ | 10259 | GTFVPPT | 2.110151 | 7.82868 |
| SyS6 | 1082 | GCCCAATGGTCGACTAATGCGGGTTATGCACAG | 5671 | AQWSTNAGYAQ | 10260 | WSTNAGY | 1.979177 | 10.16316 |
| SyS9 | 1083 | GCCCAAACCCTGAAAGACCCTTCACCGCACAG | 5672 | AQTLERPFTAQ | 10261 | TLERPFT | 1.892846 | 9.19788 |
| SP1 | 1084 | GCCCAAACTGCTGCTAAGCCGTTTCTGGCACAG | 5673 | AQTAAKPFLAQ | 10262 | TAAKPFL | 1.863541 | 0.239884 |
| GS8 | 1085 | GCCCAAATTAGGATTGGTTATTCGCAGGCACAG | 5674 | AQIRIGYSQAQ | 10263 | IRIGYSQ | 1.835644 | 2.556906 |
| SyS10 | 1086 | GCCCAAGAGAGCGTGTGGGTTTGCTCAGGCACAG | 5675 | AQERVGFAQAQ | 10264 | ERVGFAQ | 1.73803 | 5.438205 |
| SyS12 | 1087 | GCCCAAGCCGACCTCCTCAACTACAGAGCACAG | 5676 | AQADLLNYRAQ | 10265 | ADLLNYR | 1.599571 | 1.410457 |
| SyS13 | 1088 | GCCCAACTCGTCGCCGGCTTCAGCCAAGCACAG | 5677 | AQLVAGFSQAQ | 10266 | LVAGFSQ | 1.591793 | 6.106031 |
| SyP5 | 1089 | GCCCAATCGTCTCTGAAGCCTTTTCTGGCACAG | 5678 | AQSSLKPFLAQ | 10267 | SSLKPFL | 1.574365 | -0.00792 |
| TS8 | 1090 | GCCCAAACGCATTCTAGGCCGTTTATTGCACAG | 5679 | AQTHSRPFIAQ | 10268 | THSRPFI | 1.566468 | 1.399717 |
| GP3 | 1091 | GCCCAACCTTTCCTGGTTATTCTGCGGCACAG | 5680 | AQPFPGYSAAQ | 10269 | PFPGYSA | 1.555967 | 0.122481 |
| SyP6 | 1092 | GCCCAAATTATTGTTGGGTATAGTCAGGCACAG | 5681 | AQIIVGYSQAQ | 10270 | IIVGYSQ | 1.515858 | -0.03845 |
| SS12 | 1093 | GCCCAAAGGTATCAGGGTGATTCTGTTGCACAG | 5682 | AQRYQGDSVAQ | 10271 | RYQGDSV | 1.486197 | 2.200634 |
| GS13 | 1094 | GCCCAAAGGTATGCTGGGGATTCTATTGCACAG | 5683 | AQRYAGDSIAQ | 10272 | RYAGDSI | 1.456352 | 2.513518 |
| SyS15 | 1095 | GCCCAAAAGACGATTGGGGAGCATTGGGCACAG | 5684 | AQKTIGEHWAQ | 10273 | KTIGEHW | 1.44094 | 1.156576 |
| SyS16 | 1096 | GCCCAATGGATGACGCATGGTTCTGCGGGCACAG | 5685 | AQWMTHGSAAQ | 10274 | WMTHGSA | 1.432726 | 5.12209 |
| GS16 | 1097 | GCCCAAGCTGCTTCGAGGCCGTTTCTTGCACAG | 5686 | AQAASRPFLAQ | 10275 | AASRPFL | 1.3791 | 1.903527 |

FIG. 33

| Label | ID | DNA sequence | ID | Peptide (AQ) | ID | Peptide | Value 1 | Value 2 |
|---|---|---|---|---|---|---|---|---|
| TP5 | 1098 | GCCCAAACTACTTCTAGGCCGTTTCTTGCACAG | 5687 | AQTTSRPFLAQ | 10276 | TTSRPFL | 1.353519 | -0.09501 |
| SyS17 | 1099 | GCCCAAGCTCGTGTGGGGTTTGGCTCAGGCACAG | 5688 | AQARVGLAQAQ | 10277 | ARVGLAQ | 1.345499 | 1.982916 |
| GP5 | 1100 | GCCCAAGGGACTAGTCCGAATCTTGCGGCACAG | 5689 | AQGTSPNLAAQ | 10278 | GTSPNLA | 1.306429 | 0.315395 |
| SyS19 | 1101 | GCCCAAGTGCGTACGGGGTATAGTTCTGCACAG | 5690 | AQVRTGYSSAQ | 10279 | VRTGYSS | 1.302979 | 4.055383 |
| SyS20 | 1102 | GCCCAAATTCGGGTGGGGGTATAGTTCTGCACAG | 5691 | AQIRVGYSSAQ | 10280 | IRVGYSS | 1.286795 | 1.856458 |
| TP6 | 1103 | GCCCAAACTACTTTGCGTCCGTTATTGCACAG | 5692 | AQTTLRPFIAQ | 10281 | TTLRPFI | 1.284391 | -0.12323 |
| SyP9 | 1104 | GCCCAAGGTATTACGTCTCTGTTTAAGGCACAG | 5693 | AQGITSLFKAQ | 10282 | GITSLFK | 1.251837 | 0.032947 |
| SyS21 | 1105 | GCCCAAACCACCCAAACCCCCTTCAGAGCACAG | 5694 | AQTTQTPFRAQ | 10283 | TTQTPFR | 1.192121 | 2.176002 |
| TP8 | 1106 | GCCCAAACTGTGTCGAGGCCGTTTTTGGCACAG | 5695 | AQTVSRPFLAQ | 10284 | TVSRPFL | 1.171604 | -0.12785 |
| SyP11 | 1107 | GCCCAATATGGGACGAATCCGTTTCGTGCACAG | 5696 | AQYGTNPFRAQ | 10285 | YGTNPFR | 1.13664 | -0.03961 |
| SyS25 | 1108 | GCCCAACCCACCACCATGGTCGACAGCAGCGCACAG | 5697 | AQPTMVDSSAQ | 10286 | PTMVDSS | 1.099202 | 0.266059 |
| GP9 | 1109 | GCCCAAAATAAGGCTAGTTCTCAGAATGCACAG | 5698 | AQNKASSQNAQ | 10287 | NKASSQN | 1.084711 | 0.150465 |
| GP10 | 1110 | GCCCAAACTTTTCGTAGTTGTTGAATGATGCACAG | 5699 | AQTFRSSNDAQ | 10288 | TFRSSND | 1.032118 | 0.297543 |
| GP11 | 1111 | GCCCAACTGCCGGATCGTTATCCTAATGCACAG | 5700 | AQLPDRYPNAQ | 10289 | LPDRYPN | 1.019382 | 0.311223 |
| GP12 | 1112 | GCCCAACAGAATGTTACGGAAGGGTGTTGCACAG | 5701 | AQQNVTKGVAQ | 10290 | QNVTKGV | 1.000865 | 0.069558 |
| SyS26 | 1113 | GCCCAAGCTCAGTCTCCGATTCTTCGGGCACAG | 5702 | AQAQSPILRAQ | 10291 | AQSPILR | 0.979922 | 0.194304 |
| SyS27 | 1114 | GCCCAAGTGGCTACTGGTTATTCTTCGGCACAG | 5703 | AQVATGYSSAQ | 10292 | VATGYSS | 0.978116 | 1.060347 |
| GP13 | 1115 | GCCCAATTGAATTCGAATCGGCCTAATGCACAG | 5704 | AQLNSNRPNAQ | 10293 | LNSNRPN | 0.9672 | 0.275423 |
| GP14 | 1116 | GCCCAAACGATTCGTAATAATACGATTGCACAG | 5705 | AQTIRNNTIAQ | 10294 | TIRNNTI | 0.959641 | 0.134651 |
| SyP21 | 1117 | GCCCAAGATCTTAGTCGTATTTTTAAGGCACAG | 5706 | AQDLSRIFKAQ | 10295 | DLSRIFK | 0.950386 | 0.011306 |
| SyS28 | 1118 | GCCCAACTCAGCAACAGCGCCAGCAAGCACAG | 5707 | AQLSNSASQAQ | 10296 | LSNSASQ | 0.941212 | 0.142825 |
| SyS29 | 1119 | GCCCAACTCGAAAAACATGGTCATGAGCGCACAG | 5708 | AQLENMVMSAQ | 10297 | LENMVMS | 0.937552 | 0.152227 |
| SyS30 | 1120 | GCCCAATTGACTCAGCAGACGGATGTTGCACAG | 5709 | AQLTQQTDVAQ | 10298 | LTQQTDV | 0.936974 | 0.055201 |
| SyS31 | 1121 | GCCCAAGCGGCCTCGCCCACGCCACCGCACAG | 5710 | AQAGLAHATAQ | 10299 | AGLAHAT | 0.936046 | 0.0038 |
| SyS32 | 1122 | GCCCAAAATGCTCATACTGCGCTGGATGCACAG | 5711 | AQNAHTALDAQ | 10300 | NAHTALD | 0.933184 | 0.121259 |
| TP14 | 1123 | GCCCAATGGCCGATTCTTCGGGCTGATGCACAG | 5712 | AQWPILRADAQ | 10301 | WPILRAD | 0.931545 | -0.12619 |
| GP15 | 1124 | GCCCAAGCGCTGGCTGGTCTGTCTCTGGCACAG | 5713 | AQALAGLSLAQ | 10302 | ALAGLSL | 0.930454 | 0.12621 |
| GS21 | 1125 | GCCCAACGTATTGATATGCCTTTTAAGGCACAG | 5714 | AQRIDMPFKAQ | 10303 | RIDMPFK | 0.920205 | 0.015073 |
| GP16 | 1126 | GCCCAAACGATGTCGTTGAGTAGTAGTGCACAG | 5715 | AQTMSLSSSAQ | 10304 | TMSLSSS | 0.919718 | 0.304165 |
| GS23 | 1127 | GCCCAACAAAACGTGCCAAAAACCTGCGCACAG | 5716 | AQQNVAKNLAQ | 10305 | QNVAKNL | 0.916602 | 0.813873 |
| GS33 | 1128 | GCCCAATTCGACAACCCCAACAACGTCGCACAG | 5717 | AQFDNPNNVAQ | 10306 | FDNPNNV | 0.915503 | 0.086072 |
| GS24 | 1129 | GCCCAAGTCCTCATGAGAGAAAGCCTCGCACAG | 5718 | AQVLMRESLAQ | 10307 | VLMRESL | 0.914386 | 0.141782 |

FIG. 33 (Continued)

| | | | | | | | | |
|---|---|---|---|---|---|---|---|---|
| SyS34 | 1130 | GCCCAACACCACGACACCGGCAGCGCCGCACAG | 5719 | AQHHDTGSAAQ | 10308 | HHDTGSA | 0.912951 | -0.01452 |
| GP17 | 1131 | GCCCAAGATGCGCCGAATAGTGTGGATGCACAG | 5720 | AQDAPNSVDAQ | 10309 | DAPNSVD | 0.901999 | 0.074694 |
| GP18 | 1132 | GCCCAAACTGGGAGTAGGGATGCTAAGGCACAG | 5721 | AQTASRDAKAQ | 10310 | TASRDAK | 0.889552 | 0.305208 |
| TS16 | 1133 | GCCCAAACTAATTATACGAAGCAGATTGCACAG | 5722 | AQTNYTKQIAQ | 10311 | TNYTKQI | 0.889024 | 1.292832 |
| GP20 | 1134 | GCCCAACCTCATAATGCTTCTGTGTTGGCACAG | 5723 | AQPHNASVLAQ | 10312 | PHNASVL | 0.864707 | 0.119015 |
| TS17 | 1135 | GCCCAAACCAACAACACCAGAAACATCGCACAG | 5724 | AQTNNTRNIAQ | 10313 | TNNTRNI | 0.862873 | 3.066317 |
| GP21 | 1136 | GCCCAAATGGTTCCTAATCATTCTGGTGCACAG | 5725 | AQMVPNHSGAQ | 10314 | MVPNHSG | 0.859604 | 0.10671 |
| SyS36 | 1137 | GCCCAACCGGTGCCGCAGTCTGAGCATGCACAG | 5726 | AQPVPQSEHAQ | 10315 | PVPQSEH | 0.852761 | 0.005712 |
| SyS37 | 1138 | GCCCAACTCTACCACGGCGGCAGCACCGCACAG | 5727 | AQLYHGGSTAQ | 10316 | LYHGGST | 0.851158 | 1.723386 |
| GP22 | 1139 | GCCCAAATGATTCATACTAGGGAGACGGCACAG | 5728 | AQMIHTRETAQ | 10317 | MIHTRET | 0.850116 | 0.21081 |
| TS18 | 1140 | GCCCAAACTAATAATACGAAGCCTCTTGCACAG | 5729 | AQTNNTKPLAQ | 10318 | TNNTKPL | 0.849557 | 1.523 |
| TS20 | 1141 | GCCCAACTCAACACCACCAGAAACACCGCACAG | 5730 | AQLNTTRNTAQ | 10319 | LNTTRNT | 0.839304 | 2.098399 |
| GP24 | 1142 | GCCCAAGCTTTGCATAATTCTCAGAATGCACAG | 5731 | AQALHNSQNAQ | 10320 | ALHNSQN | 0.827469 | 0.061402 |
| TS21 | 1143 | GCCCAAGTGAATAGTACGAGGAATGTTGCACAG | 5732 | AQVNSTRNVAQ | 10321 | VNSTRNV | 0.826565 | 1.260315 |
| GP25 | 1144 | GCCCAAGGTGTTGGGGTTGTTACGAAGGCACAG | 5733 | AQGVGVVTKAQ | 10322 | GVGVVTK | 0.820556 | 0.292663 |
| GP26 | 1145 | GCCCAAGTTTGTCGAAGCAGTTGGCTGCACAG | 5734 | AQVLSKQLAAQ | 10323 | VLSKQLA | 0.816495 | 0.216922 |
| SyS38 | 1146 | GCCCAATCTAAGTCTCTGCAGCCGTTGGTCACAG | 5735 | AQSKSLQPLAQ | 10324 | SKSLQPL | 0.815502 | -0.01826 |
| TS22 | 1147 | GCCCAATCGAATTCTACGCGGTGGTTGGTCACAG | 5736 | AQSNSTRLVAQ | 10325 | SNSTRLV | 0.815119 | 1.172623 |
| TS23 | 1148 | GCCCAACTCAACCAAACAAATCGCACAG | 5737 | AQLNQTKQIAQ | 10326 | LNQTKQI | 0.811665 | 0.576331 |
| TS24 | 1149 | GCCCAAAACAACAGCGTCAGACAACTCGCACAG | 5738 | AQNNSVRQLAQ | 10327 | NNSVRQL | 0.806765 | 2.286879 |
| SyS40 | 1150 | GCCCAAATGTCGGGGTATTGCATACTGCACAG | 5739 | AQMSGYSHTAQ | 10328 | MSGYSHT | 0.804194 | -0.01048 |
| GS26 | 1151 | GCCCAAGTCAAAGTCCCATCATCACCGCACAG | 5740 | AQVKVPIITAQ | 10329 | VKVPIIT | 0.799412 | -0.10413 |
| TS25 | 1152 | GCCCAAGGGAATAATACTCGGGCGGTGGCACAG | 5741 | AQGNNTRAVAQ | 10330 | GNNTRAV | 0.797634 | 1.315071 |
| TS26 | 1153 | GCCCAACAGAATCAGATTAAGAATATTGCACAG | 5742 | AQQNQIKNIAQ | 10331 | QNQIKNI | 0.797303 | 0.74103 |
| TS27 | 1154 | GCCCAAACCAACAACATGACCAAACCCTCGCACAG | 5743 | AQTNMTKPLAQ | 10332 | TNMTKPL | 0.791064 | 0.75073 |
| TS28 | 1155 | GCCCAAAACAACAGCACCAGACTCAGCGCACAG | 5744 | AQNNSTRLSAQ | 10333 | NNSTRLS | 0.790429 | 1.381045 |
| SyS41 | 1156 | GCCCAAAGCATGCTCACCAGCATCGTCGCACAG | 5745 | AQSMLTSIVAQ | 10334 | SMLTSIV | 0.790252 | 0.060228 |
| SyS42 | 1157 | GCCCAACTCAACGCCACCGCCAGCAGAGCACAG | 5746 | AQLNATASRAQ | 10335 | LNATASR | 0.785269 | 1.621315 |
| SyS43 | 1158 | GCCCAAAATACTGGGGTGCAGGTTAGGGCACAG | 5747 | AQNTGVQVRAQ | 10336 | NTGVQVR | 0.785026 | -0.11955 |
| TS29 | 1159 | GCCCAAACCAACACCGTCAGACCCATCGCACAG | 5748 | AQTNTVRPIAQ | 10337 | TNTVRPI | 0.780569 | 1.015192 |
| SyP24 | 1160 | GCCCAACAGTCTACGCGGGGGCTACTGCACAG | 5749 | AQQSTPGATAQ | 10338 | QSTPGAT | 0.779842 | -0.03057 |
| SP19 | 1161 | GCCCAAGGTCATTCTGAGAATTCTCGTGTGCACAG | 5750 | AQGHSENSRAQ | 10339 | GHSENSR | 0.778724 | -0.03149 |

FIG. 33 (Continued)

| | | | | | | | | |
|---|---|---|---|---|---|---|---|---|
| SyS44 | 1162 | GCCCAACTCCCACCCAAACCCTCAGAGCACAG | 5751 | AQLPTQTLRAQ | 10340 | LPTQTLR | 0.773756 | 0.51102 |
| GS27 | 1163 | GCCCAAAAGAATGCTCCGATGCCTGATGCACAG | 5752 | AQKNAPMPDAQ | 10341 | KNAPMPD | 0.772397 | 0.130152 |
| TS31 | 1164 | GCCCAAGAAGCAACAGCACCAAACCACCGCACAG | 5753 | AQSNSTKPTAQ | 10342 | SNSTKPT | 0.768053 | 2.108136 |
| SyS45 | 1165 | GCCCAACCTATTATTACTATGCCTGCTGCACAG | 5754 | AQPIITMPAAQ | 10343 | PIITMPA | 0.767318 | -0.10299 |
| GS28 | 1166 | GCCCAACCCTCAAAGGCATCGGCAGGCACAG | 5755 | AQPLKGIGSAQ | 10344 | PLKGIGS | 0.767253 | -0.07052 |
| GS29 | 1167 | GCCCAAGTCCTCAGCGTCAACCACCTCGCACAG | 5756 | AQVLSVNHLAQ | 10345 | VLSVNHL | 0.765014 | 0.050802 |
| SyS46 | 1168 | GCCCAAAGTGTGGCTGCTGTGCATATGGCACAG | 5757 | AQSVAAVHMAQ | 10346 | SVAAVHM | 0.764013 | 0.277236 |
| TS32 | 1169 | GCCCAAAGCAACAGCATCAGACTCGTCGCACAG | 5758 | AQSNSIRLVAQ | 10347 | SNSIRLV | 0.763114 | 1.058208 |
| TS33 | 1170 | GCCCAACATAATGATACTCGTCCTCTTGCACAG | 5759 | AQHNDTRPLAQ | 10348 | HNDTRPL | 0.759962 | -0.04126 |
| GS31 | 1171 | GCCCAACCTCCGGTGAGGTCTACGGCTGCACAG | 5760 | AQPPVRSTAAQ | 10349 | PPVRSTA | 0.755777 | -0.09946 |
| TS34 | 1172 | GCCCAAATGAACACCGTCAGAAACCTCGCACAG | 5761 | AQMNTVRNLAQ | 10350 | MNTVRNL | 0.754463 | 1.394996 |
| GS32 | 1173 | GCCCAATTGACGGATGGTCATCGGATTGCACAG | 5762 | AQLTDGHRIAQ | 10351 | LTDGHRI | 0.754429 | 0.32562 |
| TS35 | 1174 | GCCCAAACGAATGCGGTGAAGCTGACTGCACAG | 5763 | AQTNAVKLTAQ | 10352 | TNAVKLT | 0.752766 | 1.157992 |
| SyS48 | 1175 | GCCCAACGTGTGGATGCGGTTTGAGTGCACAG | 5764 | AQRVDAVLSAQ | 10353 | RVDAVLS | 0.750458 | 0.650222 |
| TS36 | 1176 | GCCCAAACCAACGCCGTCAAAAGCACCGCACAG | 5765 | AQTNAVKSTAQ | 10354 | TNAVKST | 0.749271 | 1.812411 |
| SyS49 | 1177 | GCCCAAATGCTCAACACCACCACCGCCAGAGCACAG | 5766 | AQMLNTTARAQ | 10355 | MLNTTAR | 0.747921 | 2.456673 |
| TS37 | 1178 | GCCCAAGGCAACAACAGTCTGGGGGTAGTGCGTTGGCACAG | 5767 | AQGNNTRPTAQ | 10356 | GNNTRPT | 0.747523 | 1.945144 |
| GP29 | 1179 | GCCCAACAGTCTGGGGGTAGTGCGTTGGCACAG | 5768 | AQQSGGSALAQ | 10357 | QSGGSAL | 0.744332 | 0.320051 |
| SyS50 | 1180 | GCCCAAGTGATTGCTTTGTCTACTATGGCACAG | 5769 | AQVIALSTMAQ | 10358 | VIALSTM | 0.743901 | -0.08342 |
| TS38 | 1181 | GCCCAACTGAATACGATTCGGAATGTGGCACAG | 5770 | AQLNTIRNVAQ | 10359 | LNTIRNV | 0.743811 | 0.509953 |
| TS39 | 1182 | GCCCAAAGCAACGCCACCAGAAGCGTCGCACAG | 5771 | AQSNATRSVAQ | 10360 | SNATRSV | 0.740235 | 2.030618 |
| TS40 | 1183 | GCCCAAGGCAACGGCACCAAATTCATCGCACAG | 5772 | AQGNGTKFIAQ | 10361 | GNGTKFI | 0.736944 | 0.870325 |
| TS41 | 1184 | GCCCAAAGCAACAACACCATCAGACCCGTCGCACAG | 5773 | AQSNTIRPVAQ | 10362 | SNTIRPV | 0.736197 | 0.921801 |
| TS42 | 1185 | GCCCAAAGCAACAGCACCAGAGCCATCGCACAG | 5774 | AQSNSTRAIAQ | 10363 | SNSTRAI | 0.734716 | 1.769995 |
| SyS51 | 1186 | GCCCAATTTCATTTGACTGATGATAGGGGTGCACAG | 5775 | AQFHLTDRGAQ | 10364 | FHLTDRG | 0.733831 | -0.11858 |
| GS33 | 1187 | GCCCAACCGATTAGGTCGGATACTGTTGGCACAG | 5776 | AQPIRSDTVAQ | 10365 | PIRSDTV | 0.731286 | -0.03233 |
| GS34 | 1188 | GCCCAAGCCAACCAAATCCACACAACCGCACAG | 5777 | AQANQIHNTAQ | 10366 | ANQIHNT | 0.730071 | 1.693251 |
| TS44 | 1189 | GCCCAATCGAATACGGTTCGGAATACTGCACAG | 5778 | AQSNTVRNTAQ | 10367 | SNTVRNT | 0.727807 | 1.688407 |
| SyS52 | 1190 | GCCCAAACCAGCCTCGGCTACAGCAGGCACAG | 5779 | AQTSLGYSSAQ | 10368 | TSLGYSS | 0.727167 | 0.736367 |
| SyS53 | 1191 | GCCCAAATCAGCGGCGTCCAAACCAGAGCACAG | 5780 | AQISGVQTRAQ | 10369 | ISGVQTR | 0.724309 | -0.03855 |
| TS45 | 1192 | GCCCAATGAATGCTGTTAGGCAGACTGCACAG | 5781 | AQSNAVRQTAQ | 10370 | SNAVRQT | 0.72361 | 1.522098 |
| SyS54 | 1193 | GCCCAATCTCTTTCTGAGCTTAGGATTGCACAG | 5782 | AQSLSELRIAQ | 10371 | SLSELRI | 0.723061 | -0.02338 |

FIG. 33 (Continued)

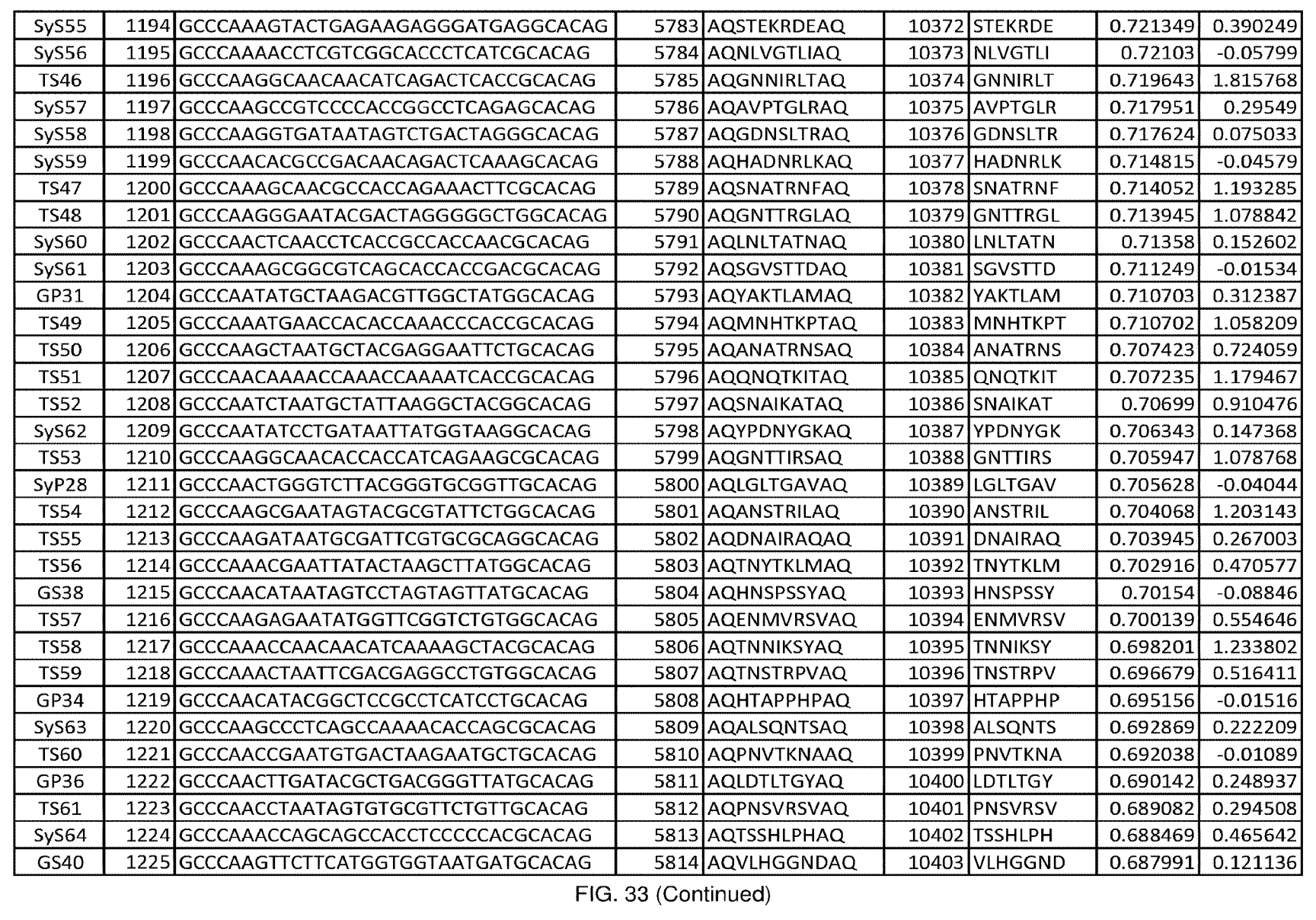

| | | | | | | | | |
|---|---|---|---|---|---|---|---|---|
| SyS55 | 1194 | GCCCAAAGTACTGAGAAGAGAGGGATGAGGCACAG | 5783 | AQSTEKRDEAQ | 10372 | STEKRDE | 0.721349 | 0.390249 |
| SyS56 | 1195 | GCCCAAAACCTCGTCGGCACCCTCATCGCACAG | 5784 | AQNLVGTLIAQ | 10373 | NLVGTLI | 0.72103 | -0.05799 |
| TS46 | 1196 | GCCCAAGGCAACAACATCAGACTCACCGCACAG | 5785 | AQGNNIRLTAQ | 10374 | GNNIRLT | 0.719643 | 1.815768 |
| SyS57 | 1197 | GCCCAAGCCGTCCCACCGGCCTCAGAGCACAG | 5786 | AQAVPTGLRAQ | 10375 | AVPTGLR | 0.717951 | 0.29549 |
| SyS58 | 1198 | GCCCAAGGTGATAATAGTCTGACTAGGGCACAG | 5787 | AQGDNSLTRAQ | 10376 | GDNSLTR | 0.717624 | 0.075033 |
| SyS59 | 1199 | GCCCAACACGCGACAACAGACTCAAAGCACAG | 5788 | AQHADNRLKAQ | 10377 | HADNRLK | 0.714815 | -0.04579 |
| TS47 | 1200 | GCCCAAAGCAACGCCACCAGAAACTTCGCACAG | 5789 | AQSNATRNFAQ | 10378 | SNATRNF | 0.714052 | 1.193285 |
| TS48 | 1201 | GCCCAAGGGAATACGACTAGGGGGCTGGCACAG | 5790 | AQGNTTRGLAQ | 10379 | GNTTRGL | 0.713945 | 1.078842 |
| SyS60 | 1202 | GCCCAACTCAACCTCACCGCCACCAACGCACAG | 5791 | AQLNLTATNAQ | 10380 | LNLTATN | 0.71358 | 0.152602 |
| SyS61 | 1203 | GCCCAAAGCGGCGGTCAGCACCACCGACGCACAG | 5792 | AQSGVSTTDAQ | 10381 | SGVSTTD | 0.711249 | -0.01534 |
| GP31 | 1204 | GCCCAATATGCTAAGACGTTGGCTATGGCACAG | 5793 | AQYAKTLAMAQ | 10382 | YAKTLAM | 0.710703 | 0.312387 |
| TS49 | 1205 | GCCCAAATGAACCACACCAAACCACCGCACAG | 5794 | AQMNHTKPTAQ | 10383 | MNHTKPT | 0.710702 | 1.058209 |
| TS50 | 1206 | GCCCAAGCTAATGCTACGAGGAATTCTGCACAG | 5795 | AQANATRNSAQ | 10384 | ANATRNS | 0.707423 | 0.724059 |
| TS51 | 1207 | GCCCAACAAAACCAAACCAAAATCACCGCACAG | 5796 | AQQNQTKITAQ | 10385 | QNQTKIT | 0.707235 | 1.179467 |
| TS52 | 1208 | GCCCAATCTAATGCTATTAAGGCTACGGCACAG | 5797 | AQSNAIKATAQ | 10386 | SNAIKAT | 0.70699 | 0.910476 |
| SyS62 | 1209 | GCCCAATATCCTGATAATTATGGTAAGGCACAG | 5798 | AQYPDNYGKAQ | 10387 | YPDNYGK | 0.706343 | 0.147368 |
| TS53 | 1210 | GCCCAAGGCAACACCACCATCAGAAGCGCACAG | 5799 | AQGNTTIRSAQ | 10388 | GNTTIRS | 0.705947 | 1.078768 |
| SyP28 | 1211 | GCCCAACTGGGTCTTACGGGTGCGGTTGCACAG | 5800 | AQLGLTGAVAQ | 10389 | LGLTGAV | 0.705628 | -0.04044 |
| TS54 | 1212 | GCCCAAGCGAATAGTACGCGTATTCTGGCACAG | 5801 | AQANSTRILAQ | 10390 | ANSTRIL | 0.704068 | 1.203143 |
| TS55 | 1213 | GCCCAAGATAATGCGATTCGTGCGCAGGCACAG | 5802 | AQDNAIRAQAQ | 10391 | DNAIRAQ | 0.703945 | 0.267003 |
| TS56 | 1214 | GCCCAAACGAATTATACTAAGCTTATGGCACAG | 5803 | AQTNYTKLMAQ | 10392 | TNYTKLM | 0.702916 | 0.470577 |
| GS38 | 1215 | GCCCAACAACATAGTCCTAGTAGTTATGCACAG | 5804 | AQHNSPSSYAQ | 10393 | HNSPSSY | 0.70154 | -0.08846 |
| TS57 | 1216 | GCCCAAGAGAATATGGTTCGGTGTCGTGGCACAG | 5805 | AQENMVRSVAQ | 10394 | ENMVRSV | 0.700139 | 0.554646 |
| TS58 | 1217 | GCCCAAACCAACAACATCAAAAGCTACGCACAG | 5806 | AQTNNIKSYAQ | 10395 | TNNIKSY | 0.698201 | 1.233802 |
| TS59 | 1218 | GCCCAACCAACTAATTCGACGAGGCCTGTGGCACAG | 5807 | AQTNSTRPVAQ | 10396 | TNSTRPV | 0.696679 | 0.516411 |
| GP34 | 1219 | GCCCAACATACGGCTCCGCCTCATCCTGCACAG | 5808 | AQHTAPPHPAQ | 10397 | HTAPPHP | 0.695156 | -0.01516 |
| SyS63 | 1220 | GCCCAAGCCCTCAGCCAAAACACCAGCGCACAG | 5809 | AQALSQNTSAQ | 10398 | ALSQNTS | 0.692869 | 0.222209 |
| TS60 | 1221 | GCCCAACCGAATGTGACTAAGAATGCTGCACAG | 5810 | AQPNVTKNAAQ | 10399 | PNVTKNA | 0.692038 | -0.01089 |
| GP36 | 1222 | GCCCAACTTGATACGCTGACGGGTTATGCACAG | 5811 | AQLDTLTGYAQ | 10400 | LDTLTGY | 0.690142 | 0.248937 |
| TS61 | 1223 | GCCCAACCTAATAGTAGTGCGTTCTGTTGCACAG | 5812 | AQPNSVRSVAQ | 10401 | PNSVRSV | 0.689082 | 0.294508 |
| SyS64 | 1224 | GCCCAAACCAGCAGCCACCTCCCCACGCACAG | 5813 | AQTSSHLPHAQ | 10402 | TSSHLPH | 0.688469 | 0.465642 |
| GS40 | 1225 | GCCCAAGTTCTTCATGGTGGTAATGATGCACAG | 5814 | AQVLHGGNDAQ | 10403 | VLHGGND | 0.687991 | 0.121136 |

FIG. 33 (Continued)

| | | | | | | | | |
|---|---|---|---|---|---|---|---|---|
| TS62 | 1226 | GCCCAAAGCAACTACGTCAAAAGCGCCGCACAG | 5815 | AQSNYVKSAAQ | 10404 | SNYVKSA | 0.687276 | 0.620002 |
| TS63 | 1227 | GCCCAAGACAACAACAGCACCAGATGGGCACAG | 5816 | AQDNNSTRWAQ | 10405 | DNNSTRW | 0.687057 | 0.34274 |
| GP37 | 1228 | GCCCAAACTGTGTGATGAAGGGTTTACTGCACAG | 5817 | AQTVMKGFTAQ | 10406 | TVMKGFT | 0.687036 | 0.307342 |
| SyS65 | 1229 | GCCCAAAGCCACACCCTCAGCACCCTCGCACAG | 5818 | AQSHTLSTLAQ | 10407 | SHTLSTL | 0.686592 | 0.104749 |
| SyS66 | 1230 | GCCCAACCTGGTCCTCAGCAGGCGAAGGCACAG | 5819 | AQPGPQQAKAQ | 10408 | PGPQQAK | 0.685365 | 0.364455 |
| GS41 | 1231 | GCCCAAACTTTTGGGACGTCTAAGTTGGCACAG | 5820 | AQTFGTSKLAQ | 10409 | TFGTSKL | 0.684153 | 0.041123 |
| SyS67 | 1232 | GCCCAAAGCAAGCGCCGTCACCAACAGAGCACAG | 5821 | AQSNAVTNRAQ | 10410 | SNAVTNR | 0.683838 | 2.350107 |
| GP38 | 1233 | GCCCAATTGTCTATGTCGACGGTGCCTGCACAG | 5822 | AQLSMSTVPAQ | 10411 | LSMSTVP | 0.682136 | 0.463832 |
| GS42 | 1234 | GCCCAAAGGCGTTATGATGGTAGGGAGGCACAG | 5823 | AQRRYDGREAQ | 10412 | RRYDGRE | 0.681722 | -0.04926 |
| TS64 | 1235 | GCCCAAACCAACAGCACCAAAAACATCGCACAG | 5824 | AQTNSTKNIAQ | 10413 | TNSTKNI | 0.678439 | 2.312433 |
| GS43 | 1236 | GCCCAAATTAATGCTCAGTGGTCTGCGGCACAG | 5825 | AQINAQWSAAQ | 10414 | INAQWSA | 0.672085 | 0.020513 |
| SyS68 | 1237 | GCCCAAGCCAAACCAGCAACGACCCCGCACAG | 5826 | AQAQTSNDPAQ | 10415 | AQTSNDP | 0.669325 | 0.289379 |
| TS65 | 1238 | GCCCAAACGAATGAGACTAGGAGGATGGTGGCACAG | 5827 | AQTNETRMVAQ | 10416 | TNETRMV | 0.669307 | 0.50614 |
| TS66 | 1239 | GCCCAAGCCAACGCCACCAGAGGCGTCGCACAG | 5828 | AQANATRGVAQ | 10417 | ANATRGV | 0.667153 | 0.206293 |
| SyS69 | 1240 | GCCCAAGCGGATGTGAATGCTTCGGGGTGCACAG | 5829 | AQADVNASGAQ | 10418 | ADVNASG | 0.666574 | -0.04779 |
| GP39 | 1241 | GCCCAACTTAGTGAGCGGAATTATGTGGCACAG | 5830 | AQLSERNYVAQ | 10419 | LSERNYV | 0.665675 | 0.088761 |
| GP40 | 1242 | GCCCAAAGTGGTGAGCTTGCGCGGGCGGCACAG | 5831 | AQSGELARAAQ | 10420 | SGELARA | 0.663381 | 0.117091 |
| TS67 | 1243 | GCCCAAGGGAATACTGCTAAGAATATTGCACAG | 5832 | AQGNTAKNIAQ | 10421 | GNTAKNI | 0.662988 | 0.420415 |
| TS68 | 1244 | GCCCAAGACAACGCCGTCAGACCCCTCGCACAG | 5833 | AQDNAVRPLAQ | 10422 | DNAVRPL | 0.662435 | 0.259838 |
| SyS70 | 1245 | GCCCAAATGATGCTCAGCGGCCTCAACGCACAG | 5834 | AQMMLSGLNAQ | 10423 | MMLSGLN | 0.660837 | 0.004421 |
| TS70 | 1246 | GCCCAACCCAACACCATCAGAAACGTCGCACAG | 5835 | AQPNTIRNVAQ | 10424 | PNTIRNV | 0.660528 | 0.629407 |
| TS71 | 1247 | GCCCAAGAGAATTTGACGCGTGGGGTGGCACAG | 5836 | AQENLTRGVAQ | 10425 | ENLTRGV | 0.659884 | 0.188249 |
| GP41 | 1248 | GCCCAATTTAGTGCTCGGAGTACGGGGGCACAG | 5837 | AQFSARSTGAQ | 10426 | FSARSTG | 0.659095 | 0.105157 |
| TS72 | 1249 | GCCCAAGAAAACGCCACCAGAACCTACGCACAG | 5838 | AQENATRTYAQ | 10427 | ENATRTY | 0.657305 | 1.105462 |
| TS73 | 1250 | GCCCAAGGCAACAGCACCAGAATGAACGCACAG | 5839 | AQGNSTRMNAQ | 10428 | GNSTRMN | 0.656999 | 0.923491 |
| TS74 | 1251 | GCCCAAGGGAATTCTACTAAGTCTCCTGCACAG | 5840 | AQGNSTKSPAQ | 10429 | GNSTKSP | 0.656908 | 0.716749 |
| GS44 | 1252 | GCCCAAATGCAAACCACCCTCCACCTCGCACAG | 5841 | AQMQTTLHLAQ | 10430 | MQTTLHL | 0.656525 | -0.09797 |
| SyS71 | 1253 | GCCCAAAACCCACCCTCATCACCCTCGCACAG | 5842 | AQNPTLITLAQ | 10431 | NPTLITL | 0.655924 | 0.146275 |
| SyS72 | 1254 | GCCCAACTTATTTCTGGTCATGCGCAGGCACAG | 5843 | AQLISGHAQAQ | 10432 | LISGHAQ | 0.655121 | 0.171881 |
| SyS73 | 1255 | GCCCAATTCAACCAAGTCAGAAGCCTCGCACAG | 5844 | AQFNQVRSLAQ | 10433 | FNQVRSL | 0.65493 | 0.025869 |
| GS45 | 1256 | GCCCAAATGAACATCCTCAGAGAGAGTCGCACAG | 5845 | AQMNILREVAQ | 10434 | MNILREV | 0.654097 | -0.09985 |
| GP42 | 1257 | GCCCAAAGTGCTATGATGCGTGGTGTTGCACAG | 5846 | AQSAMMRGVAQ | 10435 | SAMMRGV | 0.653566 | -0.06697 |

FIG. 33 (Continued)

| | | | | | | | | |
|---|---|---|---|---|---|---|---|---|
| SyS74 | 1258 | GCCCAACCCATGCTCAGCAGCCCAGCGCACAG | 5847 | AQPMLSSPSAQ | 10436 | PMLSSPS | 0.652269 | -0.07485 |
| TS75 | 1259 | GCCCAACAGAATAATACGCTTAGGTCGGCACAG | 5848 | AQQNNTLRSAQ | 10437 | QNNTLRS | 0.651653 | 0.733737 |
| GS46 | 1260 | GCCCAAAGGCATTCGGATCCGGTGGAGGCACAG | 5849 | AQRHSDPVEAQ | 10438 | RHSDPVE | 0.65144 | -0.07331 |
| GS47 | 1261 | GCCCAAGTGAATACGACGTTTCTACGCACAG | 5850 | AQVNTTFSTAQ | 10439 | VNTTFST | 0.65142 | -0.00755 |
| TS76 | 1262 | GCCCAAATCAACAGCACCAGAGGCATCGCACAG | 5851 | AQINSTRGIAQ | 10440 | INSTRGI | 0.650374 | 0.746658 |
| TS77 | 1263 | GCCCAACCAACGCCGTCAGAGACCTCGCACAG | 5852 | AQTNAVRDLAQ | 10441 | TNAVRDL | 0.649865 | 0.608962 |
| TS78 | 1264 | GCCCAATCTAATAGTACTAGGCTGTCGGCACAG | 5853 | AQSNSTRLSAQ | 10442 | SNSTRLS | 0.649567 | 1.213202 |
| SyS75 | 1265 | GCCCAAACGTCTATTGCTGGGTCGTTTGCACAG | 5854 | AQTSIAGSFAQ | 10443 | TSIAGSF | 0.647793 | 0.065679 |
| SS27 | 1266 | GCCCAACTCGGCAGCACCTACCCCAGAGCACAG | 5855 | AQLGSTYPRAQ | 10444 | LGSTYPR | 0.644533 | -0.23408 |
| SyS76 | 1267 | GCCCAAGCCAACGTCACCACCCAAAGAGCACAG | 5856 | AQANVTTQRAQ | 10445 | ANVTTQR | 0.643299 | 0.597905 |
| TS79 | 1268 | GCCCAAAGCAACAGCGTCAGACTCAGCGCACAG | 5857 | AQSNSVRLSAQ | 10446 | SNSVRLS | 0.641635 | 0.657122 |
| GS48 | 1269 | GCCCAAGCTACGAATGAGCGTGATCGGGCACAG | 5858 | AQATNEPDRAQ | 10447 | ATNEPDR | 0.641008 | -0.06388 |
| GS49 | 1270 | GCCCAAAGAATGAACCCGAACAAAGCGCACAG | 5859 | AQRMNPEQSAQ | 10448 | RMNPEQS | 0.640866 | 0.123792 |
| GS50 | 1271 | GCCCAATCGGTTAGTGGTTCGGCTAATGCACAG | 5860 | AQSVSGSANAQ | 10449 | SVSGSAN | 0.640362 | -0.07276 |
| GS51 | 1272 | GCCCAACCGAGTAATAGTACTACGCCGTGCACAG | 5861 | AQPSNSTTRAQ | 10450 | PSNSTTR | 0.639664 | 0.069013 |
| GP43 | 1273 | GCCCAACTTTTCATGGTACGCATGAGGCACAG | 5862 | AQLFHGTHEAQ | 10451 | LFHGTHE | 0.639176 | 0.186361 |
| SyS77 | 1274 | GCCCAACCCCAACTCGGCAGCACCAAAGCACAG | 5863 | AQPQLGSTKAQ | 10452 | PQLGSTK | 0.638022 | 0.187838 |
| SyS78 | 1275 | GCCCAACCATCAGCGCAACAGACTCGCACAG | 5864 | AQPISANRLAQ | 10453 | PISANRL | 0.637814 | -0.06902 |
| SyS79 | 1276 | GCCCAAAATTCGGGTAATCTTTCTATGGCACAG | 5865 | AQNSGNLSMAQ | 10454 | NSGNLSM | 0.637206 | 0.248456 |
| SyS80 | 1277 | GCCCAAAAGGTTGAGGCTATTGGGATGGCACAG | 5866 | AQKVEAIGMAQ | 10455 | KVEAIGM | 0.63585 | 0.196256 |
| SyS81 | 1278 | GCCCAAAAGACTTTGCTTAATAGTGTTGCACAG | 5867 | AQKTLLNSVAQ | 10456 | KTLLNSV | 0.635567 | -0.07329 |
| GS52 | 1279 | GCCCAAAATGCTATGGATCTTAAGGTGGCACAG | 5868 | AQNAMDLKVAQ | 10457 | NAMDLKV | 0.633592 | -0.04013 |
| SyS82 | 1280 | GCCCAAATGATGGGTAATGGGTCTTCGGCACAG | 5869 | AQMMGNGSSAQ | 10458 | MMGNGSS | 0.632846 | -0.04467 |
| TS80 | 1281 | GCCCAAAGCAACAGCACCAAAGCCCTCGCACAG | 5870 | AQSNSTKALAQ | 10459 | SNSTKAL | 0.630646 | 1.07834 |
| TS81 | 1282 | GCCCAATCTAATAGTACGGCGGGTACGGCACAG | 5871 | AQSNSTRGTAQ | 10460 | SNSTRGT | 0.630359 | 1.275033 |
| GS53 | 1283 | GCCCAAAGCCTCAGCAGCCTCCACGTCGCACAG | 5872 | AQSLSSLHVAQ | 10461 | SLSSLHV | 0.629137 | -0.08892 |
| SyS83 | 1284 | GCCCAAACCCTCAGCGGCGCCCTCACCGCACAG | 5873 | AQTLSGALTAQ | 10462 | TLSGALT | 0.628275 | 0.306806 |
| TS82 | 1285 | GCCCAACCGAATACGGTGAGGAATAATGCACAG | 5874 | AQPNTVRNNAQ | 10463 | PNTVRNN | 0.627943 | 1.035691 |
| TS83 | 1286 | GCCCAAAATAATAATGTGAAGATGACTGCACAG | 5875 | AQNNNVKMTAQ | 10464 | NNNVKMT | 0.627302 | 0.23573 |
| GP46 | 1287 | GCCCAAAGTGTTGCTAAGCCTTTTATGGCACAG | 5876 | AQSVAKPFMAQ | 10465 | SVAKPFM | 0.627075 | 0.17477 |
| SyP29 | 1288 | GCCCAAACGCAGACGACTCGGCTTTCGGCACAG | 5877 | AQTQTTRLSAQ | 10466 | TQTTRLS | 0.625657 | -0.04236 |
| TS84 | 1289 | GCCCAAAATAATGCGACTCGGGGTGGGGGCACAG | 5878 | AQNNATRGGAQ | 10467 | NNATRGG | 0.622765 | 0.76061 |

FIG. 33 (Continued)

| | | | | | | | | |
|---|---|---|---|---|---|---|---|---|
| TS85 | 1290 | GCCCAAACCAACACCACCGCCAGAATCGCACAG | 5879 | AQTNTTARIAQ | 10468 | TNTTARI | 0.621665 | 0.649749 |
| TS86 | 1291 | GCCCAAGAGAATAGTATTCGGACTATTGCACAG | 5880 | AQENSIRTIAQ | 10469 | ENSIRTI | 0.619021 | 0.750947 |
| GS55 | 1292 | GCCCAAATTAGGGAGACTTCTGGGAAGGCACAG | 5881 | AQIRETSGKAQ | 10470 | IRETSGK | 0.618732 | -0.00781 |
| SyS84 | 1293 | GCCCAAAGCATCTACTACCACCGAAGCACAG | 5882 | AQSIYYHTEAQ | 10471 | SIYYHTE | 0.618441 | -0.07907 |
| SyS85 | 1294 | GCCCAAGTCCTCGACAACAGCGGCCAAGCACAG | 5883 | AQVLDNSGQAQ | 10472 | VLDNSGQ | 0.618183 | -0.1396 |
| GS56 | 1295 | GCCCAAAGCCACAACATGACCATCAGAGCACAG | 5884 | AQSHNMTIRAQ | 10473 | SHNMTIR | 0.614114 | 0.473069 |
| SyS86 | 1296 | GCCCAAACCATCCCAGCGCCGGCAAAGCACAG | 5885 | AQTIPSAGKAQ | 10474 | TIPSAGK | 0.612816 | 0.150798 |
| SyP30 | 1297 | GCCCCACCTAGGCATACTTTGAGTCAGGCACAG | 5886 | APPRHTLSQAQ | 10475 | PRHTLSQ | 0.60799 | -0.00929 |
| SyS87 | 1298 | GCCCAATCGCTTAATGTGCGAGGATGTGGCACAG | 5887 | AQSLNVQDVAQ | 10476 | SLNVQDV | 0.607203 | 0.057645 |
| GP48 | 1299 | GCCCAATATCAGTCTCTGGCTAATCCGGCACAG | 5888 | AQYQSLANPAQ | 10477 | YQSLANP | 0.607005 | 0.036857 |
| GS58 | 1300 | GCCCAAATTCTGAATATGTCTACGGATGCACAG | 5889 | AQILNMSTDAQ | 10478 | ILNMSTD | 0.606834 | -0.1435 |
| SyS88 | 1301 | GCCCAAGTCCTCCACCTCGGCCACAGCGCACAG | 5890 | AQVLHLGHSAQ | 10479 | VLHLGHS | 0.605932 | 0.104512 |
| SyS89 | 1302 | GCCCAAGGTGTTACTCAGACTCCGCGTGCACAG | 5891 | AQGVTQTPRAQ | 10480 | GVTQTPR | 0.6059 | 0.243764 |
| TS88 | 1303 | GCCCAAACCAACGACACCAGAGAATCGCACAG | 5892 | AQTNDTRRIAQ | 10481 | TNDTRRI | 0.604587 | 1.419603 |
| SyS90 | 1304 | GCCCAACAAACCGACCACCAGCAGAGCACAG | 5893 | AQQTDHTSRAQ | 10482 | QTDHTSR | 0.604031 | 0.279435 |
| TS90 | 1305 | GCCCAAAAGAATGAGAATTAAGAATGTGGCACAG | 5894 | AQKNEIKNVAQ | 10483 | KNEIKNV | 0.603838 | 0.384157 |
| GP49 | 1306 | GCCCAATGGACTGGTAATGAGAGGCTTGCACAG | 5895 | AQWTGNERLAQ | 10484 | WTGNERL | 0.603412 | -0.0735 |
| SyS91 | 1307 | GCCCAAGGTAAGAGTGATGTCTATGCGGGCACAG | 5896 | AQGKSDAMRAQ | 10485 | GKSDAMR | 0.603322 | 0.227787 |
| TS91 | 1308 | GCCCAAGGGAATGCGACTCGTACTTATGCACAG | 5897 | AQGNATRTYAQ | 10486 | GNATRTY | 0.602016 | 0.746216 |
| SyS92 | 1309 | GCCCAAGCCAGCAACCTCGGCCTCCCCGCACAG | 5898 | AQASNLGLPAQ | 10487 | ASNLGLP | 0.600647 | 0.212421 |
| SyS93 | 1310 | GCCCAAAGCAGCCTCAGCGGCAGCCCCGCACAG | 5899 | AQSSLSGSPAQ | 10488 | SSLSGSP | 0.599424 | 0.229985 |
| SyS94 | 1311 | GCCCAAGCCGCGTCAACCAAGGCGTCGCACAG | 5900 | AQAAVNQGVAQ | 10489 | AAVNQGV | 0.599283 | 0.365845 |
| GS60 | 1312 | GCCCAAGACCAAAACCAACCCAGAGAAGCACAG | 5901 | AQDQNQPREAQ | 10490 | DQNQPRE | 0.59872 | -0.04719 |
| GS61 | 1313 | GCCCAACTCACCCAAGACAAACAAGCCGCACAG | 5902 | AQLTQDKQAAQ | 10491 | LTQDKQA | 0.59843 | 0.025835 |
| SyS95 | 1314 | GCCCAATTCGGCAGCAACGAACAACGCACACAG | 5903 | AQFGSNEHNAQ | 10492 | FGSNEHN | 0.59773 | 0.246632 |
| GS62 | 1315 | GCCCAACTGAATCAGCCGAATGTGCGGGCACAG | 5904 | AQLNQPNVRAQ | 10493 | LNQPNVR | 0.59703 | -0.00684 |
| TS92 | 1316 | GCCCAAATGAATACTACACGCGTAATCTGGCACAG | 5905 | AQMNTTRNLAQ | 10494 | MNTTRNL | 0.596819 | 0.171297 |
| TS93 | 1317 | GCCCAAACTAATTCTACTAGGACGAGTGCACAG | 5906 | AQTNSTRTSAQ | 10495 | TNSTRTS | 0.596817 | 0.587886 |
| SyS96 | 1318 | GCCCAATTGAGCTTTCGCATGTGCCTGCACAG | 5907 | AQFELSHVPAQ | 10496 | FELSHVP | 0.595373 | 0.012267 |
| SyS97 | 1319 | GCCCAAGAAGGCCTCGGCAACGCCGCGCACAG | 5908 | AQEGLGNAAAQ | 10497 | EGLGNAA | 0.59339 | -0.02116 |
| SyS98 | 1320 | GCCCAACTCACCGTCACCCTCAACCACGCACAG | 5909 | AQLTVTLNHAQ | 10498 | LTVTLNH | 0.593104 | 0.120283 |
| SyS99 | 1321 | GCCCAATTTGGGAATGCGGATTCAGTCTGCACAG | 5910 | AQFGNAIQSAQ | 10499 | FGNAIQS | 0.593063 | 0.321334 |

FIG. 33 (Continued)

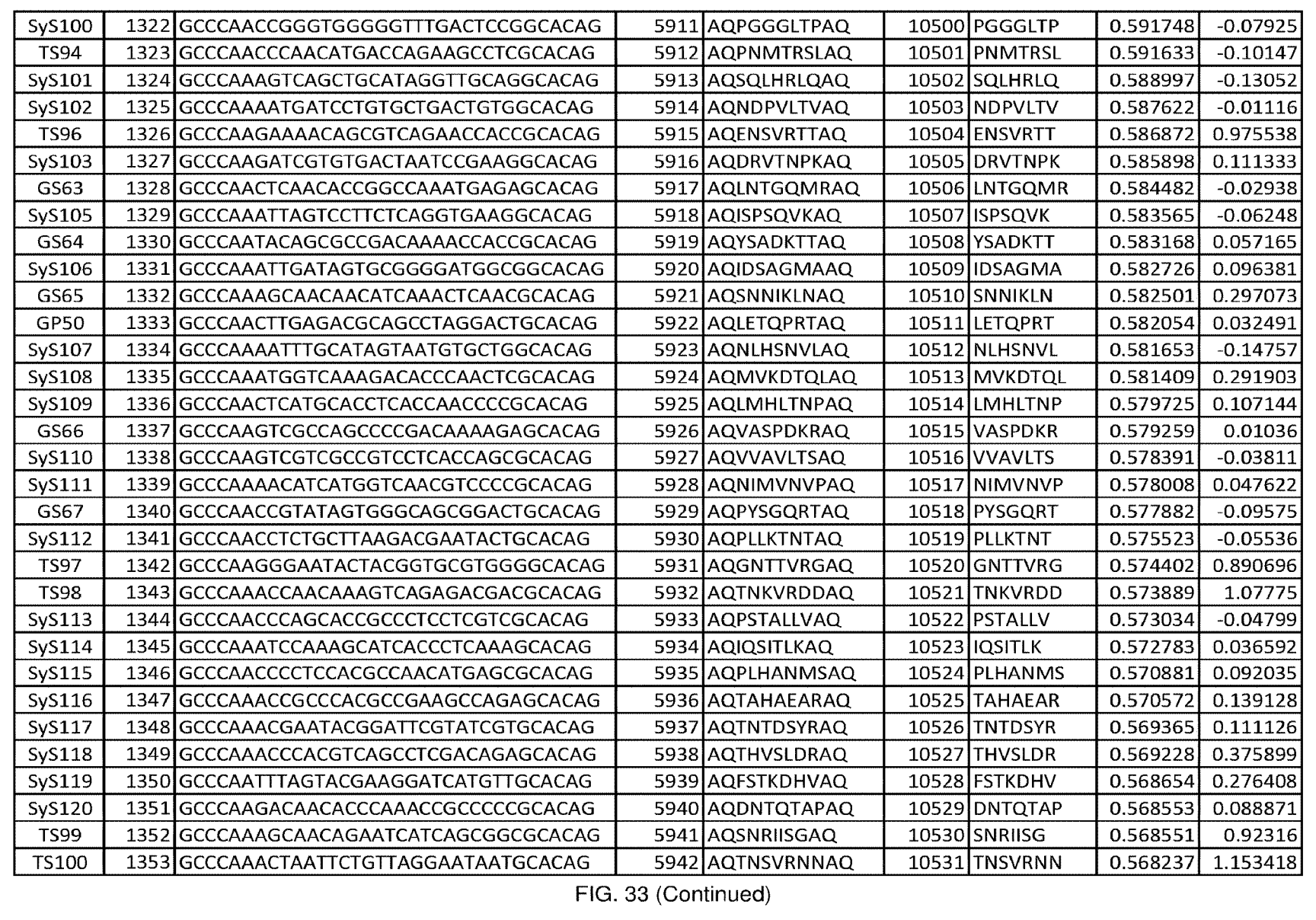

| | | | | | | | | |
|---|---|---|---|---|---|---|---|---|
| SyS100 | 1322 | GCCCAACCGGGTGGGGTTTGACTCCGGCACAG | 5911 | AQPGGGLTPAQ | 10500 | PGGGLTP | 0.591748 | -0.07925 |
| TS94 | 1323 | GCCCAACCCAACATGACCAGAAGCCTGCACAG | 5912 | AQPNMTRSLAQ | 10501 | PNMTRSL | 0.591633 | -0.10147 |
| SyS101 | 1324 | GCCCAAAGTCAGCTGCATAGGTTGCAGGCACAG | 5913 | AQSQLHRLQAQ | 10502 | SQLHRLQ | 0.588997 | -0.13052 |
| SyS102 | 1325 | GCCCAAAATGATCCTGTGCTGACTGTGGCACAG | 5914 | AQNDPVLTVAQ | 10503 | NDPVLTV | 0.587622 | -0.01116 |
| TS96 | 1326 | GCCCAAGAGAAACAGCGTCAGAACCACCGCACAG | 5915 | AQENSVRTTAQ | 10504 | ENSVRTT | 0.586872 | 0.975538 |
| SyS103 | 1327 | GCCCAAGATCGTGTGACTAATCCGAAGGCACAG | 5916 | AQDRVTNPKAQ | 10505 | DRVTNPK | 0.585898 | 0.111333 |
| GS63 | 1328 | GCCCAACTCAACACCGGCCAAATGAGAGGCACAG | 5917 | AQLNTGQMRAQ | 10506 | LNTGQMR | 0.584482 | -0.02938 |
| SyS105 | 1329 | GCCCAAATTAGTCCTTCTCAGGTGAAGGCACAG | 5918 | AQISPSQVKAQ | 10507 | ISPSQVK | 0.583565 | -0.06248 |
| GS64 | 1330 | GCCCAATACAGCGCCGACAAAACCACCGCACAG | 5919 | AQYSADKTTAQ | 10508 | YSADKTT | 0.583168 | 0.057165 |
| SyS106 | 1331 | GCCCAAATTGATAGTGCGGGGATGGCGGCACAG | 5920 | AQIDSAGMAAQ | 10509 | IDSAGMA | 0.582726 | 0.096381 |
| GS65 | 1332 | GCCCAAAGCAACAACATCAAACTCAACGCACAG | 5921 | AQSNNIKLNAQ | 10510 | SNNIKLN | 0.582501 | 0.297073 |
| GP50 | 1333 | GCCCAACTTGAGACGCAGCCTAGGACTGCACAG | 5922 | AQLETQPRTAQ | 10511 | LETQPRT | 0.582054 | 0.032491 |
| SyS107 | 1334 | GCCCAAAATTTGCATAGTAATGTGCTGGCACAG | 5923 | AQNLHSNVLAQ | 10512 | NLHSNVL | 0.581653 | -0.14757 |
| SyS108 | 1335 | GCCCAAATGGTCAAAGACACCCAACTCGCACAG | 5924 | AQMVKDTQLAQ | 10513 | MVKDTQL | 0.581409 | 0.291903 |
| SyS109 | 1336 | GCCCAACTCATGCACCTCACCAACCCCGCACAG | 5925 | AQLMHLTNPAQ | 10514 | LMHLTNP | 0.579725 | 0.107144 |
| GS66 | 1337 | GCCCAAGTCGCCAGCCCGACAAAAGAGCACAG | 5926 | AQVASPDKRAQ | 10515 | VASPDKR | 0.579259 | 0.01036 |
| SyS110 | 1338 | GCCCAAGTCGTCGCCGTCCTCACCAGCGCACAG | 5927 | AQVVAVLTSAQ | 10516 | VVAVLTS | 0.578391 | -0.03811 |
| SyS111 | 1339 | GCCCAAAAACATCATGGTCAACGTCCCGCACAG | 5928 | AQNIMVNVPAQ | 10517 | NIMVNVP | 0.578008 | 0.047622 |
| GS67 | 1340 | GCCCAACCGTATAGTGGGCAGCGGACTGCACAG | 5929 | AQPYSGQRTAQ | 10518 | PYSGQRT | 0.577882 | -0.09575 |
| SyS112 | 1341 | GCCCAACCTCTGCTTAAGACGAATACTGCACAG | 5930 | AQPLLKTNTAQ | 10519 | PLLKTNT | 0.575523 | -0.05536 |
| TS97 | 1342 | GCCCAAGGGAATACTACGGTGCGTGGGGCACAG | 5931 | AQGNTTVRGAQ | 10520 | GNTTVRG | 0.574402 | 0.890696 |
| TS98 | 1343 | GCCCAAAACCAACAAAGTCAGAGACGACGCACAG | 5932 | AQTNKVRDDAQ | 10521 | TNKVRDD | 0.573889 | 1.07775 |
| SyS113 | 1344 | GCCCAACCCAGCACCGCCCTCCTCGTCGCACAG | 5933 | AQPSTALLVAQ | 10522 | PSTALLV | 0.573034 | -0.04799 |
| SyS114 | 1345 | GCCCAAATCCAAAGCATCACCCTCAAAGCACAG | 5934 | AQIQSITLKAQ | 10523 | IQSITLK | 0.572783 | 0.036592 |
| SyS115 | 1346 | GCCCAACCCTCCAGCCCAACATGAGCGCACAG | 5935 | AQPLHANMSAQ | 10524 | PLHANMS | 0.570881 | 0.092035 |
| SyS116 | 1347 | GCCCAAACGCCCAGCGCGAAGCCAGAGCACAG | 5936 | AQTAHAEARAQ | 10525 | TAHAEAR | 0.570572 | 0.139128 |
| SyS117 | 1348 | GCCCAAACGAATACGGATTCGTATCGTGCACAG | 5937 | AQTNTDSYRAQ | 10526 | TNTDSYR | 0.569365 | 0.111126 |
| SyS118 | 1349 | GCCCAAACCCACGTCAGCCTCGACAGAGCACAG | 5938 | AQTHVSLDRAQ | 10527 | THVSLDR | 0.569228 | 0.375899 |
| SyS119 | 1350 | GCCCAATTTAGTACGAAGGATCATGTTGCACAG | 5939 | AQFSTKDHVAQ | 10528 | FSTKDHV | 0.568654 | 0.276408 |
| SyS120 | 1351 | GCCCAAGACAACACCAACCGCCCCGCCGCACAG | 5940 | AQDNTQTAPAQ | 10529 | DNTQTAP | 0.568553 | 0.088871 |
| TS99 | 1352 | GCCCAAAGCAACAGAATCATCAGCGGCGCACAG | 5941 | AQSNRIISGAQ | 10530 | SNRIISG | 0.568551 | 0.92316 |
| TS100 | 1353 | GCCCAAAACTAATTCTGTTAGGAATAATGCACAG | 5942 | AQTNSVRNNAQ | 10531 | TNSVRNN | 0.568237 | 1.153418 |

FIG. 33 (Continued)

| | | | | | | | | |
|---|---|---|---|---|---|---|---|---|
| TS101 | 1354 | GCCCAAAGCAACGAAGTCAGAAACATGGCACAG | 5943 | AQSNEVRNMAQ | 10532 | SNEVRNM | 0.567847 | 0.744396 |
| SyS121 | 1355 | GCCCAAGAACTCTACAAACCCAGCAGAGCACAG | 5944 | AQELYKPSRAQ | 10533 | ELYKPSR | 0.567258 | -0.07221 |
| GS69 | 1356 | GCCCAATGGATTACGGGGGTGCGAGTGCACAG | 5945 | AQWITGGASAQ | 10534 | WITGGAS | 0.567159 | 0.345096 |
| TS102 | 1357 | GCCCAAAACAACACAGCGTCAGACCCACCGCACAG | 5946 | AQNNSVRPTAQ | 10535 | NNSVRPT | 0.566945 | 0.624336 |
| GS70 | 1358 | GCCCAACACACGCCGTCCTCAGAACCGCACAG | 5947 | AQHTAVLRTAQ | 10536 | HTAVLRT | 0.565911 | -0.03197 |
| SyS122 | 1359 | GCCCAAAATACTTTGTCTCTTGTCTCCTGCACAG | 5948 | AQNTLSLAPAQ | 10537 | NTLSLAP | 0.564955 | 0.155579 |
| SyS123 | 1360 | GCCCAACCCAACGCCAGCGTCAACAGCGCACAG | 5949 | AQPNASVNSAQ | 10538 | PNASVNS | 0.564885 | 0.097515 |
| GS71 | 1361 | GCCCAAGTTACTGGTGGGAATACTTATGCACAG | 5950 | AQVTGGNTYAQ | 10539 | VTGGNTY | 0.564099 | -0.05591 |
| SyS124 | 1362 | GCCCAAGTCAACGAAAACCTCATCGAAGCACAG | 5951 | AQVNENLIEAQ | 10540 | VNENLIE | 0.563902 | -0.13408 |
| SyS125 | 1363 | GCCCAAGTTTGACGACTCATTCGAATGCACAG | 5952 | AQVLTTHSNAQ | 10541 | VLTTHSN | 0.563552 | -0.14541 |
| GS72 | 1364 | GCCCAACACACCCAACTCCCCTCACGCACAG | 5953 | AQHTQLPLTAQ | 10542 | HTQLPLT | 0.562802 | -0.07685 |
| SyS126 | 1365 | GCCCAACGGCAGTCTCTTGAGGCGTTGGCACAG | 5954 | AQRQSLEALAQ | 10543 | RQSLEAL | 0.562715 | -0.07009 |
| SyS127 | 1366 | GCCCAACCCGACGTCACCGAAGGCAGAGCACAG | 5955 | AQPDVTEGRAQ | 10544 | PDVTEGR | 0.560929 | -0.0307 |
| SyS128 | 1367 | GCCCAACCGACTAATATATGCTTGATGCACAG | 5956 | AQPTNIMLDAQ | 10545 | PTNIMLD | 0.560313 | -0.07894 |
| SyS129 | 1368 | GCCCAACCAACCAACATGAGCGCCATGAATCGCACAG | 5957 | AQPNMSAMIAQ | 10546 | PNMSAMI | 0.559451 | 0.270198 |
| SyS130 | 1369 | GCCCAAATTATGAATGGTCAGGCTCTGGCACAG | 5958 | AQIMNGQALAQ | 10547 | IMNGQAL | 0.558677 | 0.015194 |
| TS103 | 1370 | GCCCAAAATAATAATTGACGCGTTTTGCACAG | 5959 | AQNNNSTRFAQ | 10548 | NNNSTRF | 0.558656 | 0.432697 |
| TS104 | 1371 | GCCCAAGCCAACGTCACCAGAAGCACCGCACAG | 5960 | AQANVTRSTAQ | 10549 | ANVTRST | 0.558653 | 0.70621 |
| SyS131 | 1372 | GCCCAACAGAATCTTGGTCTTAATGTGGCACAG | 5961 | AQQNLGLNVAQ | 10550 | QNLGLNV | 0.558202 | -0.12084 |
| SyS132 | 1373 | GCCCAACAAGCCAAATGAGCAGCGCCGGCACAG | 5962 | AQQAQMSSAAQ | 10551 | QAQMSSA | 0.557238 | 0.147605 |
| SyS133 | 1374 | GCCCAACTCACCATGGCCACCAACGTCGCACAG | 5963 | AQLTMATNVAQ | 10552 | LTMATNV | 0.556779 | 0.286866 |
| SyS134 | 1375 | GCCCAAGATCGTGATTCTGTGCAGAATGCACAG | 5964 | AQDRDSVQNAQ | 10553 | DRDSVQN | 0.55654 | -0.05483 |
| GS73 | 1376 | GCCCAAGTCAACCCCACCAACAACCTCGCACAG | 5965 | AQVNPTNNLAQ | 10554 | VNPTNNL | 0.555076 | -0.00968 |
| GP51 | 1377 | GCCCAACCGTCTTTACGACTATGAGTGCACAG | 5966 | AQPSFTTMSAQ | 10555 | PSFTTMS | 0.554811 | 0.065283 |
| GS74 | 1378 | GCCCAAAGGGAGAGCGCCTATTCCTAAGGCACAG | 5967 | AQRETPIPKAQ | 10556 | RETPIPK | 0.553803 | -0.0639 |
| SyS135 | 1379 | GCCCAAAGCCTCAACTTCACCACCGCCGCACAG | 5968 | AQSLNFTTAAQ | 10557 | SLNFTTA | 0.553055 | 0.475212 |
| SyS136 | 1380 | GCCCAAGGTATGAGTGGGGTTGCTCAGGCACAG | 5969 | AQGMSGVAQAQ | 10558 | GMSGVAQ | 0.552736 | -0.0578 |
| GP52 | 1381 | GCCCAAAAGGTTGATGCGGCTCAGAGTGCACAG | 5970 | AQKVDAAQSAQ | 10559 | KVDAAQS | 0.552569 | 0.100209 |
| GS75 | 1382 | GCCCAACATATTACGACTAATGTGTCTGCACAG | 5971 | AQHITTNVSAQ | 10560 | HITTNVS | 0.552479 | 0.112469 |
| SyP32 | 1383 | GCCCAAGAGCGGGAGTCGGCTCGTCTTGCACAG | 5972 | AQERESARLAQ | 10561 | ERESARL | 0.551876 | -0.04251 |
| TS106 | 1384 | GCCCAAGATAATAGGACTCAGAGGACGGGCACAG | 5973 | AQDNRTQRTAQ | 10562 | DNRTQRT | 0.551636 | 0.853173 |
| SyS137 | 1385 | GCCCAATCTGCGCTAATGTGACTATTGCACAG | 5974 | AQSAPNVTIAQ | 10563 | SAPNVTI | 0.551278 | 0.041441 |

FIG. 33 (Continued)

| | | | | | | | | |
|---|---|---|---|---|---|---|---|---|
| TS107 | 1386 | GCCCAAGAGAAAACGGCACCAGAAACACCGCACAG | 5975 | AQENGTRNTAQ | 10564 | ENGTRNT | 0.55012 | 0.5646 |
| SyS138 | 1387 | GCCCAAGGCACCGCCGTCTTCACCGCCGCACAG | 5976 | AQGTAVFTAAQ | 10565 | GTAVFTA | 0.549912 | 0.15966 |
| SyS139 | 1388 | GCCCAAGCCAACAACATGAGCCAAACCGCACAG | 5977 | AQANNMSQTAQ | 10566 | ANNMSQT | 0.549519 | 0.239635 |
| TS108 | 1389 | GCCCAAGGTAATCATCACTTATAATCTGGCACAG | 5978 | AQGNHTYNLAQ | 10567 | GNHTYNL | 0.549264 | -0.25467 |
| GP53 | 1390 | GCCCAACTGAGTCCTTCGAATTCTAATGCACAG | 5979 | AQLSPSNSNAQ | 10568 | LSPSNSN | 0.549019 | -0.07079 |
| SyS140 | 1391 | GCCCAAATGGGCGCCGACCAGAACCGCACAG | 5980 | AQMGADHRTAQ | 10569 | MGADHRT | 0.548749 | 0.159265 |
| TS109 | 1392 | GCCCAAAGTAATTCGACGCGTGGTTCTGCACAG | 5981 | AQSNSTRGSAQ | 10570 | SNSTRGS | 0.548705 | 0.187139 |
| SyS141 | 1393 | GCCCAAAATACTTCTGGTGTGCCTAAGGCACAG | 5982 | AQNTSGVPKAQ | 10571 | NTSGVPK | 0.548579 | -0.08828 |
| GS78 | 1394 | GCCCAAATCAACACCGCCGTCGTCAGCGCACAG | 5983 | AQINTAVVSAQ | 10572 | INTAVVS | 0.54846 | -0.10485 |
| SyS142 | 1395 | GCCCAAATGGGGGTTCAGGTTATGTGGCACAG | 5984 | AQMGVQAYVAQ | 10573 | MGVQAYV | 0.54845 | -0.12925 |
| TS110 | 1396 | GCCCAAGGGAATTTGTTAAGCCGAATGCACAG | 5985 | AQGNFVKPNAQ | 10574 | GNFVKPN | 0.547942 | 0.278497 |
| TS111 | 1397 | GCCCAAGTGAATTCGGTGAGGATGATTGCACAG | 5986 | AQVNSVRMIAQ | 10575 | VNSVRMI | 0.547171 | 0.096718 |
| GS79 | 1398 | GCCCAACACGACAGCGCCAACAGCAGAGCACAG | 5987 | AQHDSANSRAQ | 10576 | HDSANSR | 0.54671 | -0.08012 |
| SyS143 | 1399 | GCCCAACTCGGCGTCAGAGACGACAGCGCACAG | 5988 | AQLGVRDDSAQ | 10577 | LGVRDDS | 0.545708 | -0.07131 |
| TS113 | 1400 | GCCCAAAGCAACGCCGTCAGAGCCAACGCACAG | 5989 | AQSNAVRANAQ | 10578 | SNAVRAN | 0.545674 | 0.453866 |
| SyS144 | 1401 | GCCCAACCCGTCCTCGCCGCCACCATGGCACAG | 5990 | AQPVLAATMAQ | 10579 | PVLAATM | 0.545458 | -0.13314 |
| GP54 | 1402 | GCCCAAAATAAAGCCTGTGTCTGGTAATGCACAG | 5991 | AQNKPVSGNAQ | 10580 | NKPVSGN | 0.544076 | 0.079545 |
| SyS145 | 1403 | GCCCAAGTCGGCCTCGCCAGCCACCGCACAG | 5992 | AQVGLASHTAQ | 10581 | VGLASHT | 0.541637 | -0.04601 |
| SyS146 | 1404 | GCCCAAGGCAGCAACACCAACATGAAAGCACAG | 5993 | AQGSNTNMKAQ | 10582 | GSNTNMK | 0.540634 | 0.026539 |
| GS81 | 1405 | GCCCAAGTTGCTACTACTGTGCATAATGCACAG | 5994 | AQVATTVHNAQ | 10583 | VATTVHN | 0.540191 | -0.11662 |
| GS82 | 1406 | GCCCAAAACACCCTCGACACGAGAGTCGCACAG | 5995 | AQNTLDSRVAQ | 10584 | NTLDSRV | 0.539923 | -0.05177 |
| SyS147 | 1407 | GCCCAAAGGGAGGCTAATTGCAGGCGGCACAG | 5996 | AQREANLQAAQ | 10585 | REANLQA | 0.539717 | 0.293254 |
| SyS148 | 1408 | GCCCAAGTCGACGCCCTCAGCCACCATGGCACAG | 5997 | AQVDALSHMAQ | 10586 | VDALSHM | 0.539694 | 0.216373 |
| GS83 | 1409 | GCCCAACTTCGTCTTGCTGGTCTTGCTGCACAG | 5998 | AQLRLAGLAAQ | 10587 | LRLAGLA | 0.539525 | -0.09739 |
| GP55 | 1410 | GCCCAAATTACGGTGACTAATTATTCGGCACAG | 5999 | AQITVTNYSAQ | 10588 | ITVTNYS | 0.539447 | 0.273677 |
| SyS149 | 1411 | GCCCAATGGGACAGCGGCAGCGGCGAAGCACAG | 6000 | AQWDSGSGEAQ | 10589 | WDSGSGE | 0.539198 | -0.07979 |
| SyS150 | 1412 | GCCCAATTCGCCAGCGAAACCGTCGCCGCACAG | 6001 | AQFASETVAAQ | 10590 | FASETVA | 0.537906 | -0.02698 |
| SyS151 | 1413 | GCCCAACAGAATGTTACGGGGACGAGGGCACAG | 6002 | AQQNVTGTRAQ | 10591 | QNVTGTR | 0.537867 | 0.272466 |
| SyS152 | 1414 | GCCCAACTTAATGGGTTGAATGTGTCTGCACAG | 6003 | AQLNGLNVSAQ | 10592 | LNGLNVS | 0.537505 | -0.02999 |
| GS84 | 1415 | GCCCAAAATATGCTTAAGCAGAGTGAGGCACAG | 6004 | AQNMLKQSEAQ | 10593 | NMLKQSE | 0.537354 | -0.06179 |
| SyS153 | 1416 | GCCCAATTTAATGAGGTTCCGAAGGCGGCACAG | 6005 | AQFNEVPKAAQ | 10594 | FNEVPKA | 0.537144 | -0.03003 |
| SyS154 | 1417 | GCCCAACTCGGCGACATCACCGGCTTCGCACAG | 6006 | AQLGDITGFAQ | 10595 | LGDITGF | 0.537047 | -0.10198 |

FIG. 33 (Continued)

| | | | | | | | | |
|---|---|---|---|---|---|---|---|---|
| SyS155 | 1418 | GCCCAAATTTCGGCTTCTCATTCTCGTGCACAG | 6007 | AQISASHSRAQ | 10596 | ISASHSR | 0.536983 | -0.06923 |
| SyS156 | 1419 | GCCCAAAGTCAGAGACGCAGATTGCTCTTGCACAG | 6008 | AQSQTQIALAQ | 10597 | SQTQIAL | 0.53684 | -0.07569 |
| SyS157 | 1420 | GCCCAAAATATGGCTACTCAGATGAAGGCACAG | 6009 | AQNMATQMKAQ | 10598 | NMATQMK | 0.536747 | -0.11797 |
| SyS158 | 1421 | GCCCAAGTCAACCACAACATCAGACTCGCACAG | 6010 | AQVNHNIRLAQ | 10599 | VNHNIRL | 0.53652 | -0.01096 |
| SyS159 | 1422 | GCCCAAAACGCCCTCCAAGTCCCGTCGCACAG | 6011 | AQNALQVPVAQ | 10600 | NALQVPV | 0.536474 | 0.059794 |
| SyS160 | 1423 | GCCCAAAATTCGACGGGTATTGATACGGCACAG | 6012 | AQNSTGIDTAQ | 10601 | NSTGIDT | 0.53526 | -0.06524 |
| SyS161 | 1424 | GCCCAAGTTGTTGCTGGGCATCTTAATGCACAG | 6013 | AQVVAGHLNAQ | 10602 | VVAGHLN | 0.534827 | -0.11989 |
| SyS162 | 1425 | GCCCAACGGAATGATGCGATTCTGAATGCACAG | 6014 | AQRNDAILNAQ | 10603 | RNDAILN | 0.53456 | 0.251531 |
| GS85 | 1426 | GCCCAAAATCGGGTTGATTCGCGGGCTGCACAG | 6015 | AQNRVDSRAAQ | 10604 | NRVDSRA | 0.53408 | 0.01415 |
| GS86 | 1427 | GCCCAATCGACGCATTCTACTTATGTGGCACAG | 6016 | AQSTHSTYVAQ | 10605 | STHSTYV | 0.533753 | -0.09066 |
| SyS164 | 1428 | GCCCAAAGTGGGCATGGGACTCTGCGGGCACAG | 6017 | AQSGHGTLRAQ | 10606 | SGHGTLR | 0.532267 | -0.1652 |
| SyS165 | 1429 | GCCCAACCCAACAGCACCACCCTCAGCGCACAG | 6018 | AQPNSTTLSAQ | 10607 | PNSTTLS | 0.531723 | -0.01811 |
| GS87 | 1430 | GCCCAAGACACCAAACCCACACCGCACACAG | 6019 | AQDTKPTNTAQ | 10608 | DTKPTNT | 0.531589 | 0.18326 |
| SyS166 | 1431 | GCCCAAAACAGAGACACCATCAACAACGCACAG | 6020 | AQNRDTINNAQ | 10609 | NRDTINN | 0.531212 | 0.532142 |
| GS88 | 1432 | GCCCAACCCAGAACCCTCAGCGACGGCGCACAG | 6021 | AQPRTLSDGAQ | 10610 | PRTLSDG | 0.530962 | 0.113902 |
| GS89 | 1433 | GCCCAAACCAAAGACGTCACCACCAGCGCACAG | 6022 | AQTKDVTTSAQ | 10611 | TKDVTTS | 0.53023 | -0.05088 |
| SS31 | 1434 | GCCCAACTGGGTAATCCTACGCCTTCTGCACAG | 6023 | AQLGNPTPSAQ | 10612 | LGNPTPS | 0.529624 | -0.27772 |
| GP56 | 1435 | GCCCAATATCAGGCGATGTATAGGGATGCACAG | 6024 | AQYQAMYRDAQ | 10613 | YQAMYRD | 0.528592 | 0.013767 |
| GS90 | 1436 | GCCCAAAGCGGCGGTCCAAGAATTCGACGCACAG | 6025 | AQSGVQEFDAQ | 10614 | SGVQEFD | 0.528493 | -0.16214 |
| SyS167 | 1437 | GCCCAATCTAATCATCTGTCGACGGTTGCACAG | 6026 | AQSNHLSTVAQ | 10615 | SNHLSTV | 0.528046 | 0.269982 |
| SyS168 | 1438 | GCCCAACACGACGAAAGAGCCAACATGGCACAG | 6027 | AQHDERANMAQ | 10616 | HDERANM | 0.526932 | 0.005367 |
| TS114 | 1439 | GCCCAAACGAATAGTACTCGGTCGCCTGCACAG | 6028 | AQTNSTRSPAQ | 10617 | TNSTRSP | 0.526707 | 0.094198 |
| SP27 | 1440 | GCCCAACCGACGGATAAGTCTTATCCGGCACAG | 6029 | AQPTDKSYPAQ | 10618 | PTDKSYP | 0.525687 | -0.03596 |
| SyS170 | 1441 | GCCCAAATGACCGAACAAAGAACCGCCGCACAG | 6030 | AQMTEQRTAAQ | 10619 | MTEQRTA | 0.524729 | 0.151606 |
| GS92 | 1442 | GCCCAAACCAACGCCACCCAGCAAAGCACAG | 6031 | AQTNATHSKAQ | 10620 | TNATHSK | 0.523113 | 0.600566 |
| GP58 | 1443 | GCCCAAAATCGGGGTACTTTTAGTGCGGCACAG | 6032 | AQNRGTFSAAQ | 10621 | NRGTFSA | 0.522986 | -0.0735 |
| TS115 | 1444 | GCCCAAAACACCACCAAATTCAACACCGCACAG | 6033 | AQNTKFNTAQ | 10622 | NTTKFNT | 0.522899 | 0.168453 |
| SyS171 | 1445 | GCCCAAGGGATTCCGCCTTTGACTAAGGCACAG | 6034 | AQGIPPLTKAQ | 10623 | GIPPLTK | 0.522659 | 0.148866 |
| SyS172 | 1446 | GCCCAAACCGCCAACAGCACCCAAAGAGCACAG | 6035 | AQTANSTQRAQ | 10624 | TANSTQR | 0.522626 | 0.365056 |
| SyS173 | 1447 | GCCCAAACTCAGGGTCCGGGTCCGAAGGCACAG | 6036 | AQTQGPGPKAQ | 10625 | TQGPGPK | 0.522239 | 0.297383 |
| TS116 | 1448 | GCCCAAATGAATACTACGCGGAATTATGCACAG | 6037 | AQMNTTRNYAQ | 10626 | MNTTRNY | 0.522193 | 0.354477 |
| GS94 | 1449 | GCCCAACTCAGAGAGAAGGCACCTTCATGGCACAG | 6038 | AQLREGTFMAQ | 10627 | LREGTFM | 0.521554 | -0.02029 |

FIG. 33 (Continued)

| | | | | | | | | |
|---|---|---|---|---|---|---|---|---|
| SyS174 | 1450 | GCCCAAAACATCAGCAGCACGACAGAGCACAG | 6039 | AQNISSTDRAQ | 10628 | NISSTDR | 0.521154 | 0.307406 |
| SyP33 | 1451 | GCCCAATCGGTTAGTCGGCCGTTTCAGGCACAG | 6040 | AQSVSRPFQAQ | 10629 | SVSRPFQ | 0.520365 | -0.03773 |
| GS96 | 1452 | GCCCAACCTATGTCTGCTAATGGGAAGGCACAG | 6041 | AQPMSANGKAQ | 10630 | PMSANGK | 0.518792 | -0.0464 |
| SyS175 | 1453 | GCCCAAGAAGTCAGAGGCAACACCTTCGCACAG | 6042 | AQEVRGNTFAQ | 10631 | EVRGNTF | 0.518514 | 0.312168 |
| GS97 | 1454 | GCCCAATCGCGAGAAGGGTCTGTCTGTGGCACAG | 6043 | AQSQKGLSVAQ | 10632 | SQKGLSV | 0.518477 | -0.04267 |
| SyS176 | 1455 | GCCCAAATTGCTGAGAATCGAGTGCTGCACAG | 6044 | AQIAENLSAAQ | 10633 | IAENLSA | 0.517935 | -0.10864 |
| SyS177 | 1456 | GCCCAATTCAGCAACACATGAACCTCAAAGCACAG | 6045 | AQFSNMNLKAQ | 10634 | FSNMNLK | 0.517734 | -0.05191 |
| GP59 | 1457 | GCCCAACCTCGTGAGCGGGACTTATACTGCACAG | 6046 | AQPRERTYTAQ | 10635 | PRERTYT | 0.516835 | 0.003871 |
| GS99 | 1458 | GCCCAATGGTCGCATAATCCGGATTCTGCACAG | 6047 | AQWSHNPDSAQ | 10636 | WSHNPDS | 0.516248 | -0.11545 |
| GP60 | 1459 | GCCCAAGGTCTTCAGACTCTGATTACGGCACAG | 6048 | AQGLQTLITAQ | 10637 | GLQTLIT | 0.516123 | 0.282215 |
| TS117 | 1460 | GCCCAAAGCAACAGAACCAAAGACATCGCACAG | 6049 | AQSNRTKDIAQ | 10638 | SNRTKDI | 0.515515 | 0.733669 |
| SyS179 | 1461 | GCCCAAGTGACTGAGACGATTCTTAAGGCACAG | 6050 | AQVTETILKAQ | 10639 | VTETILK | 0.515459 | -0.16223 |
| GS100 | 1462 | GCCCAATATGTTACGCGTAGTGGTCTGGCACAG | 6051 | AQYVTRSGLAQ | 10640 | YVTRSGL | 0.515319 | -0.09386 |
| SS32 | 1463 | GCCCAAATGAACGCCAACATCCTCGTCGCACAG | 6052 | AQMNANILVAQ | 10641 | MNANILV | 0.514679 | -0.31431 |
| GP61 | 1464 | GCCCAAACTACGAATCGGGTGGGTACGGCACAG | 6053 | AQTTNRVGTAQ | 10642 | TTNRVGT | 0.51427 | -0.05638 |
| GS101 | 1465 | GCCCAAGTCCTCAAAAGCCACCTCCAAGCACAG | 6054 | AQVLKSHLQAQ | 10643 | VLKSHLQ | 0.51406 | -0.01612 |
| SyS180 | 1466 | GCCCAAAGCGACGGCCTCAGAACCCAAGCACAG | 6055 | AQSDGLRTQAQ | 10644 | SDGLRTQ | 0.514048 | -0.0323 |
| TS118 | 1467 | GCCCAACTCAACAGCGTCAAACCCAAGCACAG | 6056 | AQLNSVKPNAQ | 10645 | LNSVKPN | 0.513525 | -0.03938 |
| SS33 | 1468 | GCCCAAAGCCAAGCCATCGCCCCCAAAGCACAG | 6057 | AQSQAIAPKAQ | 10646 | SQAIAPK | 0.51343 | -0.30374 |
| TS119 | 1469 | GCCCAATCTAATAATGTTCGTGCTCCGGCACAG | 6058 | AQSNNVRAPAQ | 10647 | SNNVRAP | 0.513257 | 0.427193 |
| SyS182 | 1470 | GCCCAAATCAGCCACCTCAGCGAAAGCGCACAG | 6059 | AQISHLSESAQ | 10648 | ISHLSES | 0.511503 | 0.085806 |
| SyS183 | 1471 | GCCCAACTCCTCCCCGGCATGAGATTCGCACAG | 6060 | AQLLPGMRFAQ | 10649 | LLPGMRF | 0.5114 | -0.16587 |
| GS102 | 1472 | GCCCAACTTCTTGCGTCGGCTACGAAGGCACAG | 6061 | AQILASATKAQ | 10650 | LLASATK | 0.510718 | 0.025387 |
| SS34 | 1473 | GCCCAAAACCACAACAGGCATGGTCAGCGCACAG | 6062 | AQNHNGMVSAQ | 10651 | NHNGMVS | 0.510709 | -0.38341 |
| GS103 | 1474 | GCCCAACAGCGGCGAACTCAACAACGCACAG | 6063 | AQHSGELNNAQ | 10652 | HSGELNN | 0.510488 | -0.05547 |
| GS104 | 1475 | GCCCAACTTTCTGCGGCCTAAGGATACTGCACAG | 6064 | AQLSAPKDTAQ | 10653 | LSAPKDT | 0.509967 | -0.10921 |
| SyS184 | 1476 | GCCCAAATTGGGACTCATGTGGGGACGGCACAG | 6065 | AQIGTHVGTAQ | 10654 | IGTHVGT | 0.509748 | -0.17337 |
| SyS185 | 1477 | GCCCAAGCCGTCGCCCTCGCCAGCGCCGCACAG | 6066 | AQAVALASAAQ | 10655 | AVALASA | 0.509614 | -0.02018 |
| SyS186 | 1478 | GCCCAAATTACTCTTCAGTCTAATGCTGCACAG | 6067 | AQITLQSNAAQ | 10656 | ITLQSNA | 0.509556 | 0.125675 |
| SyS187 | 1479 | GCCCAAGTCGACCACAGCCTCACCAGCGCACAG | 6068 | AQVDHSLTSAQ | 10657 | VDHSLTS | 0.509193 | -0.04316 |
| SyS188 | 1480 | GCCCAAGGCAACGAAGCCACCAGCCTCGCACAG | 6069 | AQGNEATSLAQ | 10658 | GNEATSL | 0.508729 | -0.04706 |
| SyS189 | 1481 | GCCCAACCCGTCAGCAGCACCACCCTCGCACAG | 6070 | AQPVSSTTLAQ | 10659 | PVSSTTL | 0.507682 | 0.051712 |

FIG. 33 (Continued)

| | | | | | | | | |
|---|---|---|---|---|---|---|---|---|
| SyS190 | 1482 | GCCCAACCCTACCAAACCAGCAGGCGGCCGCACAG | 6071 | AQPYQTSSAAQ | 10660 | PYQTSSA | 0.507351 | -0.04626 |
| GS105 | 1483 | GCCCAAACCAGCGTCGTCAGCGCCTTCGCACAG | 6072 | AQTSVVSAFAQ | 10661 | TSVVSAF | 0.507058 | -0.11758 |
| SyS191 | 1484 | GCCCAAAACGGGCGTCCCGACAACAACGCACAG | 6073 | AQNGVPDNNAQ | 10662 | NGVPDNN | 0.50693 | 0.070537 |
| SyS192 | 1485 | GCCCAAAGCACCCAAACCATCGGCTTCGCACAG | 6074 | AQSTQTIGFAQ | 10663 | STQTIGF | 0.505905 | 0.112417 |
| GP62 | 1486 | GCCCAAATTCGGAGTTCTGATCTTGCGGCACAG | 6075 | AQIRSSDLAAQ | 10664 | IRSSDLA | 0.505273 | 0.288145 |
| GS106 | 1487 | GCCCAAAAACACCAAAGCGCCAAATACGCACAG | 6076 | AQNTQSAKYAQ | 10665 | NTQSAKY | 0.504002 | -0.02585 |
| GS107 | 1488 | GCCCAAAGTCTTGAGTCGTCTAGGCAGGCACAG | 6077 | AQSLESSRQAQ | 10666 | SLESSRQ | 0.503575 | -0.02602 |
| GS108 | 1489 | GCCCAACTCAACCTCGCCAGCGGCAGAGCACAG | 6078 | AQLNLASGRAQ | 10667 | LNLASGR | 0.503463 | 0.027635 |
| GS110 | 1490 | GCCCAAATGCAGGAGCGGTCGGGAGTATGCACAG | 6079 | AQMQERREYAQ | 10668 | MQERREY | 0.503055 | -0.00468 |
| GS111 | 1491 | GCCCAATGGCTCCTCAAAGACGGCTACGCACAG | 6080 | AQWLLKDGYAQ | 10669 | WLLKDGY | 0.502893 | -0.11186 |
| GS112 | 1492 | GCCCAAGGCAGATACCAAACCACCAGCGCACAG | 6081 | AQGRYQTTSAQ | 10670 | GRYQTTS | 0.502776 | 0.049992 |
| TS120 | 1493 | GCCCAAAATACGACGAAGTTTCGTTTGCACAG | 6082 | AQNTTKFPFAQ | 10671 | NTTKFPF | 0.502408 | -0.33072 |
| SyS193 | 1494 | GCCCAAATGAGCAACGGCATCAGCAGAGCACAG | 6083 | AQMSNGISRAQ | 10672 | MSNGISR | 0.501897 | 0.448521 |
| GP65 | 1495 | GCCCAACCGATTCGGGATCCGGAGAAGGCACAG | 6084 | AQPIRDPEKAQ | 10673 | PIRDPEK | 0.501479 | -0.07322 |
| SyS194 | 1496 | GCCCAAGTACGCTGAGTCCGCATGTTGCACAG | 6085 | AQSTLSPHVAQ | 10674 | STLSPHV | 0.501315 | 0.165485 |
| GS113 | 1497 | GCCCAATTCATGCCCATCAGCAGCGCCGCACAG | 6086 | AQFMPISSAAQ | 10675 | FMPISSA | 0.50124 | -0.12446 |
| SS35 | 1498 | GCCCAAAGAAGGCGACACCCAAAGCAGCGCACAG | 6087 | AQRSDTQSSAQ | 10676 | RSDTQSS | 0.500462 | -0.28596 |
| GS114 | 1499 | GCCCAAGATAATCATGTTATGGCTCGTGCACAG | 6088 | AQDNHVMARAQ | 10677 | DNHVMAR | 0.499435 | 0.39719 |
| GS115 | 1500 | GCCCAAAATCTGTCTTCTTAAGAGTTGGGCACAG | 6089 | AQNLSSKSWAQ | 10678 | NLSSKSW | 0.499211 | -0.15138 |
| SyS195 | 1501 | GCCCAATCTACGATTCTGAAGGATACTGCACAG | 6090 | AQSTILKDTAQ | 10679 | STILKDT | 0.499066 | -0.11454 |
| GS116 | 1502 | GCCCAACCTACTCATCAGTCTAAGCCGCACAG | 6091 | AQPTHQSKPAQ | 10680 | PTHQSKP | 0.498305 | -0.04153 |
| SyS196 | 1503 | GCCCAAACGGAGGTGACTCAGAATAAGGCACAG | 6092 | AQTEVTQNKAQ | 10681 | TEVTQNK | 0.498059 | -0.01173 |
| SyS197 | 1504 | GCCCAACACCTGACACGAACGGCAGCGCACAG | 6093 | AQHLDSNGSAQ | 10682 | HLDSNGS | 0.496498 | -0.10873 |
| GP66 | 1505 | GCCCAAAATACTGATTCTCGTGTGTGGGGCACAG | 6094 | AQNTDSRVGAQ | 10683 | NTDSRVG | 0.496267 | 0.009692 |
| SyS198 | 1506 | GCCCAAAGCATGGGCCTCAAAGAAAAAGCACAG | 6095 | AQSMGLKEKAQ | 10684 | SMGLKEK | 0.495749 | -0.04266 |
| SyS199 | 1507 | GCCCAATTGAGTACGTCGTATACTCGGGCACAG | 6096 | AQLSTSYTRAQ | 10685 | LSTSYTR | 0.495598 | 0.048715 |
| SyS200 | 1508 | GCCCAATCTCGGGATGAGTAATAATCATGCACAG | 6097 | AQSGMSNNHAQ | 10686 | SGMSNNH | 0.494806 | -0.1025 |
| GS117 | 1509 | GCCCAAACCAACTACGACCTCAGAGCCGCACAG | 6098 | AQTNYDLRAAQ | 10687 | TNYDLRA | 0.494623 | -0.03099 |
| SyS201 | 1510 | GCCCAAACCCCCAAAGCCAAGAAATGGCACAG | 6099 | AQTPQSQEMAQ | 10688 | TPQSQEM | 0.494147 | 0.127468 |
| SyS202 | 1511 | GCCCAAAATAGTAATATGGTTACGCCTGCACAG | 6100 | AQNSNMVTPAQ | 10689 | NSNMVTP | 0.493868 | -0.16466 |
| SyS203 | 1512 | GCCCAATCGGCTGTTCCGAATGTTAAGGCACAG | 6101 | AQSAVPNVKAQ | 10690 | SAVPNVK | 0.493528 | 0.157825 |
| SyS204 | 1513 | GCCCAAGTCCTCGTCGCCGGCAGCAGAGCACAG | 6102 | AQVLVAGSRAQ | 10691 | VLVAGSR | 0.492961 | 0.099713 |

FIG. 33 (Continued)

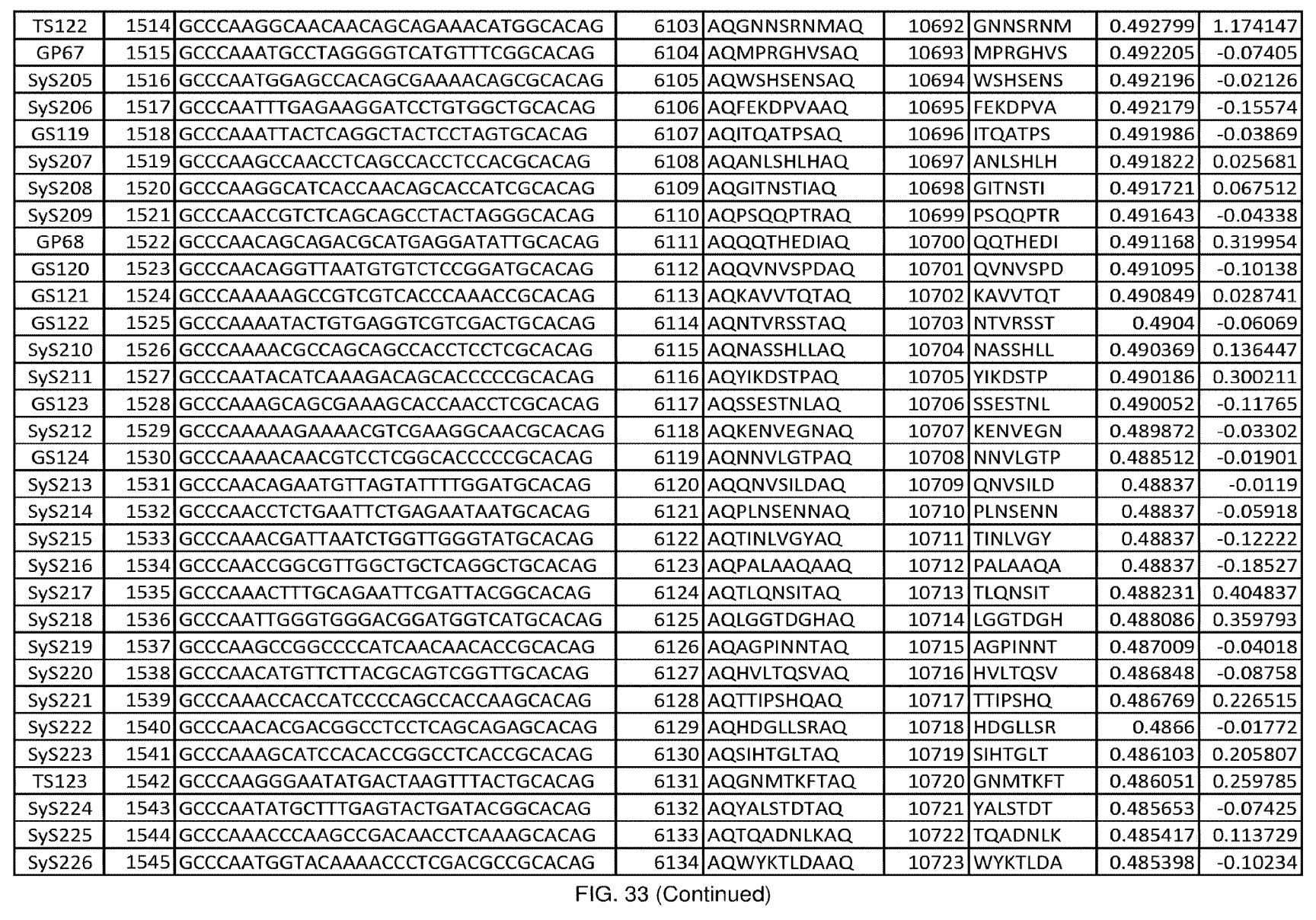

| | | | | | | | | |
|---|---|---|---|---|---|---|---|---|
| TS122 | 1514 | GCCCAAGGCAACAACAGCAGAAACATGGCACAG | 6103 | AQGNNSRNMAQ | 10692 | GNNSRNM | 0.492799 | 1.174147 |
| GP67 | 1515 | GCCCAAATGCCTAGGGGTCATGTTTCGGCACAG | 6104 | AQMPRGHVSAQ | 10693 | MPRGHVS | 0.492205 | -0.07405 |
| SyS205 | 1516 | GCCCAATGGAGCCACAGCGAAAACAGCGCACAG | 6105 | AQWSHSENSAQ | 10694 | WSHSENS | 0.492196 | -0.02126 |
| SyS206 | 1517 | GCCCAATTTGAGAAGGATCCTGTGGCTGCACAG | 6106 | AQFEKDPVAAQ | 10695 | FEKDPVA | 0.492179 | -0.15574 |
| GS119 | 1518 | GCCCAAATTACTCAGGCTACTCCTAGTGCACAG | 6107 | AQITQATPSAQ | 10696 | ITQATPS | 0.491986 | -0.03869 |
| SyS207 | 1519 | GCCCAAGCCAACCTCAGCCACCTCCACGCACAG | 6108 | AQANLSHLHAQ | 10697 | ANLSHLH | 0.491822 | 0.025681 |
| SyS208 | 1520 | GCCCAAGGCATCACCAACAGCACCATCGCACAG | 6109 | AQGITNSTIAQ | 10698 | GITNSTI | 0.491721 | 0.067512 |
| SyS209 | 1521 | GCCCAACCGTCTCAGCAGCCTACTAGGGCACAG | 6110 | AQPSQQPTRAQ | 10699 | PSQQPTR | 0.491643 | -0.04338 |
| GP68 | 1522 | GCCCAACAGCAGACGCATGAGGATATTGCACAG | 6111 | AQQQTHEDIAQ | 10700 | QQTHEDI | 0.491168 | 0.319954 |
| GS120 | 1523 | GCCCAACAGGTTAATGTGTCTCCGGATGCACAG | 6112 | AQQVNVSPDAQ | 10701 | QVNVSPD | 0.491095 | -0.10138 |
| GS121 | 1524 | GCCCAAAAAGCCGTCGTCACCCAAACGCACAG | 6113 | AQKAVVTQTAQ | 10702 | KAVVTQT | 0.490849 | 0.028741 |
| GS122 | 1525 | GCCCAAAATACTGTGAGGTCGTGACTGCACAG | 6114 | AQNTVRSSTAQ | 10703 | NTVRSST | 0.4904 | -0.06069 |
| SyS210 | 1526 | GCCCAAAACGCCAGCAGCCACCTCCTCGCACAG | 6115 | AQNASSHLLAQ | 10704 | NASSHLL | 0.490369 | 0.136447 |
| SyS211 | 1527 | GCCCAATACATCAAAGACAGCACCCCGCACAG | 6116 | AQYIKDSTPAQ | 10705 | YIKDSTP | 0.490186 | 0.300211 |
| GS123 | 1528 | GCCCAAGCAGCGAAAGCACCAACCTCGCACAG | 6117 | AQSSESTNLAQ | 10706 | SSESTNL | 0.490052 | -0.11765 |
| SyS212 | 1529 | GCCCAAAAAGAAAACGTCGAAGGCAACGCACAG | 6118 | AQKENVEGNAQ | 10707 | KENVEGN | 0.489872 | -0.03302 |
| GS124 | 1530 | GCCCAAAACAACGTCCTCGGCACCCCGCACAG | 6119 | AQNNVLGTPAQ | 10708 | NNVLGTP | 0.488512 | -0.01901 |
| SyS213 | 1531 | GCCCAACAGAATGTTAGTATTTGGATGCACAG | 6120 | AQQNVSILDAQ | 10709 | QNVSILD | 0.48837 | -0.0119 |
| SyS214 | 1532 | GCCCAACCTCTGAATTCTGAGAATAATGCACAG | 6121 | AQPLNSENNAQ | 10710 | PLNSENN | 0.48837 | -0.05918 |
| SyS215 | 1533 | GCCCAAACGATTAATCTGGTTGGGTATGCACAG | 6122 | AQTINLVGYAQ | 10711 | TINLVGY | 0.48837 | -0.12222 |
| SyS216 | 1534 | GCCCAACCGGCGTTGGCTGCTCAGGCTGCACAG | 6123 | AQPALAAQAAQ | 10712 | PALAAQA | 0.48837 | -0.18527 |
| SyS217 | 1535 | GCCCAAACTTTGCAGAATTCGATTACGGCACAG | 6124 | AQTLQNSITAQ | 10713 | TLQNSIT | 0.488231 | 0.404837 |
| SyS218 | 1536 | GCCCAATTGGGTGGGACGGATGGTCATGCACAG | 6125 | AQLGGTDGHAQ | 10714 | LGGTDGH | 0.488086 | 0.359793 |
| SyS219 | 1537 | GCCCAAGCGGCCCCATCAACAACACCGCACAG | 6126 | AQAGPINNTAQ | 10715 | AGPINNT | 0.487009 | -0.04018 |
| SyS220 | 1538 | GCCCAACATGTTCTTACGCAGTCGGTTGCACAG | 6127 | AQHVLTQSVAQ | 10716 | HVLTQSV | 0.486848 | -0.08758 |
| SyS221 | 1539 | GCCCAAACCACCATCCCCAGCCACCAAGCACAG | 6128 | AQTTIPSHQAQ | 10717 | TTIPSHQ | 0.486769 | 0.226515 |
| SyS222 | 1540 | GCCCAACACGACGGCCTCCTCAGCAGAGCACAG | 6129 | AQHDGLLSRAQ | 10718 | HDGLLSR | 0.4866 | -0.01772 |
| SyS223 | 1541 | GCCCAAAGCATCCACACCGGCCTCACCGCACAG | 6130 | AQSIHTGLTAQ | 10719 | SIHTGLT | 0.486103 | 0.205807 |
| TS123 | 1542 | GCCCAAGGAATATGACTAAGTTTACTGCACAG | 6131 | AQGNMTKFTAQ | 10720 | GNMTKFT | 0.486051 | 0.259785 |
| SyS224 | 1543 | GCCCAATATGCTTTGAGTACTGATACGGCACAG | 6132 | AQYALSTDTAQ | 10721 | YALSTDT | 0.485653 | -0.07425 |
| SyS225 | 1544 | GCCCAAACCCAAGCCGACAACCTCAAAGCACAG | 6133 | AQTQADNLKAQ | 10722 | TQADNLK | 0.485417 | 0.113729 |
| SyS226 | 1545 | GCCCAATGGTACAAAACCCTCGACGCGCACAG | 6134 | AQWYKTLDAAQ | 10723 | WYKTLDA | 0.485398 | -0.10234 |

FIG. 33 (Continued)

| | | | | | | | | |
|---|---|---|---|---|---|---|---|---|
| GS126 | 1546 | GCCCAACCCCAATACGCCAAAATCAGCGCACAG | 6135 | AQPQYAKISAQ | 10724 | PQYAKIS | 0.485373 | -0.12737 |
| SyS227 | 1547 | GCCCAACTCGCCACCGACAACAAAAGCGCACAG | 6136 | AQLATDNKSAQ | 10725 | LATDNKS | 0.485187 | 0.216017 |
| SyS228 | 1548 | GCCCAACTCAGCGTCGTCATCACCAGCGCACAG | 6137 | AQLSVVITSAQ | 10726 | LSVVITS | 0.484761 | -0.14162 |
| SyS229 | 1549 | GCCCAAAATGTGCCGACTTCGCCGCGGGCACAG | 6138 | AQNVPTSPRAQ | 10727 | NVPTSPR | 0.484481 | -0.00571 |
| SyS230 | 1550 | GCCCAAGCCAGACCCGACCTCAAACTCGCACAG | 6139 | AQARPDLKLAQ | 10728 | ARPDLKL | 0.484242 | 0.080867 |
| SyS231 | 1551 | GCCCAAAGCGCCCTGCCAACACCCTGCACAG | 6140 | AQSALANTLAQ | 10729 | SALANTL | 0.483363 | 0.057201 |
| SyS232 | 1552 | GCCCAACTCATGGACTTCAGCAACCCGCACAG | 6141 | AQLMDFSNPAQ | 10730 | LMDFSNP | 0.483298 | 0.044546 |
| SyS233 | 1553 | GCCCAACCTCGGACGGAGTTGATTAGTGCACAG | 6142 | AQPRTELISAQ | 10731 | PRTELIS | 0.483008 | 0.271785 |
| SyS234 | 1554 | GCCCAAACCAGCGACATCAAAAGCAAAGCACAG | 6143 | AQTSDIKSKAQ | 10732 | TSDIKSK | 0.482661 | 0.009004 |
| GS127 | 1555 | GCCCAAGCAACGCCACCATGAGATTCGCACAG | 6144 | AQSNATMRFAQ | 10733 | SNATMRF | 0.482544 | 0.332692 |
| SyS235 | 1556 | GCCCAAGTCCAAAGCCCCGCCCTCCAAGCACAG | 6145 | AQVQSPALQAQ | 10734 | VQSPALQ | 0.482506 | -0.10268 |
| SS37 | 1557 | GCCCAAACCGCCAACACCAGCAGCAGAGCACAG | 6146 | AQTANTTSRAQ | 10735 | TANTTSR | 0.481309 | -0.14344 |
| GS128 | 1558 | GCCCAACAACACATGACCAGCCAAATCGCACAG | 6147 | AQQHMTSQIAQ | 10736 | QHMTSQI | 0.481226 | 0.067575 |
| GS129 | 1559 | GCCCAAGTAATATGTCGTTGAGTAGTGCACAG | 6148 | AQSNMSLSSAQ | 10737 | SNMSLSS | 0.481136 | -0.01785 |
| SyS237 | 1560 | GCCCAAATTACGGGGATTCCGACGTCGGCACAG | 6149 | AQITGIPTSAQ | 10738 | ITGIPTS | 0.480328 | 0.061154 |
| GS130 | 1561 | GCCCAATTTACTAATAATGTGAGGGATGCACAG | 6150 | AQFTNNVRDAQ | 10739 | FTNNVRD | 0.480193 | 0.04554 |
| SyS238 | 1562 | GCCCAAAACAGCAACGCCGGCGGCAAAGCACAG | 6151 | AQNSNAGGKAQ | 10740 | NSNAGGK | 0.479053 | 0.658688 |
| SyS239 | 1563 | GCCCAATACAACACCGACATCACCAAAGCACAG | 6152 | AQYNTDITKAQ | 10741 | YNTDITK | 0.478109 | 0.317854 |
| SyS240 | 1564 | GCCCAATTTTCGAATCCGGATAAGATGGCACAG | 6153 | AQFSNPDKMAQ | 10742 | FSNPDKM | 0.477665 | -0.02779 |
| SyS241 | 1565 | GCCCAACTCATGACCACCAGCACCATCGCACAG | 6154 | AQLMTTSTIAQ | 10743 | LMTTSTI | 0.476766 | 0.149339 |
| TS124 | 1566 | GCCCAAACGAATAGTACTCTTAGGCAGGCACAG | 6155 | AQTNSTLRQAQ | 10744 | TNSTLRQ | 0.476574 | 0.068959 |
| TS125 | 1567 | GCCCAATCGAATTATACTAAGATTATTGCACAG | 6156 | AQSNYTKIIAQ | 10745 | SNYTKII | 0.475873 | 0.12486 |
| GS132 | 1568 | GCCCAATCTGCTGGGCTTATTCTTCGGCACAG | 6157 | AQSAGLISSAQ | 10746 | SAGLISS | 0.475737 | -0.10204 |
| SyS242 | 1569 | GCCCAAAAGCAGGGTCCGATGCTGTCTGCACAG | 6158 | AQKQGPMLSAQ | 10747 | KQGPMLS | 0.475731 | -0.02565 |
| SyS243 | 1570 | GCCCAAGTGAGGACTCCGGGTGTGTGCAGGCACAG | 6159 | AQVRTPGVQAQ | 10748 | VRTPGVQ | 0.475278 | 0.173488 |
| SyS244 | 1571 | GCCCAAACTCCTGATCATCGGGAGCGGGGCACAG | 6160 | AQTPDHRERAQ | 10749 | TPDHRER | 0.473388 | -0.13798 |
| SyS245 | 1572 | GCCCAAATGAATGCTACTGTTCCTTCTGCACAG | 6161 | AQMNATVPSAQ | 10750 | MNATVPS | 0.472837 | 0.213593 |
| SyS246 | 1573 | GCCCAACTCCACAGCATGTCGCCCCGCACAG | 6162 | AQLHSMLAPAQ | 10751 | LHSMLAP | 0.472535 | 0.03056 |
| SyS247 | 1574 | GCCCAAGACATGCACCACCGCACCGGCACAG | 6163 | AQDMHHSQPAQ | 10752 | DMHHSQP | 0.472429 | 0.422194 |
| GS133 | 1575 | GCCCAAAAACCCTCCCACCACCTACGCGCACAG | 6164 | AQKPLPTTYAQ | 10753 | KPLPTTY | 0.472296 | -0.09564 |
| GS134 | 1576 | GCCCAAGCCATGCAAGTCACCCTCAGCGCACAG | 6165 | AQAMQVTLSAQ | 10754 | AMQVTLS | 0.471652 | -0.13615 |
| GS135 | 1577 | GCCCAAGCCCACCCAGCGCCAGAGCACAG | 6166 | AQSPTHDARAQ | 10755 | SPTHDAR | 0.471243 | -0.00229 |

FIG. 33 (Continued)

| | | | | | | | |
|---|---|---|---|---|---|---|---|
| SyS248 | 1578 | GCCCAAGGCGCTTTCTGTTAAGGAGCTTGCACAG | AQALSVKELAQ | 10756 | ALSVKEL | 0.470954 | -0.13187 |
| GP70 | 1579 | GCCCAACCGTCTCGTGTGCCGACTCAGGCACAG | AQPSRVPTQAQ | 10757 | PSRVPTQ | 0.470688 | -0.07252 |
| SyS250 | 1580 | GCCCAAGGCAGCCTCGGCCTGGCAAAGCACAG | AQGSLGLGKAQ | 10758 | GSLGLGK | 0.470335 | 0.013558 |
| SyS251 | 1581 | GCCCAACACATAGTTCGTATTCGTCGAAGGCACAG | AQHSSYSSKAQ | 10759 | HSSYSSK | 0.469692 | -0.15617 |
| GS136 | 1582 | GCCCAACCGAATCCTAGTAATCCTTCTGCACAG | AQPNPSNPSAQ | 10760 | PNPSNPS | 0.469689 | -0.12006 |
| GP71 | 1583 | GCCCAAACTAAGAATGGTGTTGCGCAGGCACAG | AQTKNGVAQAQ | 10761 | TKNGVAQ | 0.469615 | 0.072268 |
| GP72 | 1584 | GCCCAAGGTAGTACGAGTAGTGCTTATGCACAG | AQGSTSSAYAQ | 10762 | GSTSSAY | 0.469559 | 0.258704 |
| SyS253 | 1585 | GCCCAAAGAAGCACCCACGAAAACACCGCACAG | AQRSTHENTAQ | 10763 | RSTHENT | 0.467377 | 0.19944 |
| SyS254 | 1586 | GCCCAATCTGGTCATGATCGTGATGCTGCACAG | AQSGHDRDAAQ | 10764 | SGHDRDA | 0.466417 | 0.040229 |
| SyS255 | 1587 | GCCCAAAATACTACTCAGTCTTATACTAGTGCACAG | AQNTQSYTSAQ | 10765 | NTQSYTS | 0.466373 | -0.08867 |
| SyS256 | 1588 | GCCCAAGATCGTGTTCCGCATTTGCGGGCACAG | AQDRVPHLRAQ | 10766 | DRVPHLR | 0.466296 | -0.16397 |
| SyS257 | 1589 | GCCCAAAATAATCCGCCTCATATGCGGGCACAG | AQNNPPHMRAQ | 10767 | NNPPHMR | 0.465834 | -0.1254 |
| SyS258 | 1590 | GCCCAAAGAAGCCTCCAAAGCCAATTCGCACAG | AQRSLQSQFAQ | 10768 | RSLQSQF | 0.465601 | -0.06774 |
| SyS259 | 1591 | GCCCAAATTCGTGATGATCGGTCTTTGGCACAG | AQIRDDRSLAQ | 10769 | IRDDRSL | 0.465259 | 0.094784 |
| GS137 | 1592 | GCCCAAATGTTGTCTGCTCCGCTGCCGGCACAG | AQMLSAPLPAQ | 10770 | MLSAPLP | 0.465145 | -0.10658 |
| SyS260 | 1593 | GCCCAAACTTCGAGTATTTGACTACGGCACAG | AQTSSILTTAQ | 10771 | TSSILTT | 0.465093 | 0.037804 |
| SyS261 | 1594 | GCCCAACGTGAGCAGATGAATCTTGTGGCACAG | AQREQMNLVAQ | 10772 | REQMNLV | 0.464872 | -0.01918 |
| SyS262 | 1595 | GCCCAAAAGACGCAGAGTTGAGTAATGCACAG | AQKTQSLSNAQ | 10773 | KTQSLSN | 0.464418 | 0.284303 |
| SyS263 | 1596 | GCCCAATTGAAGACTGCTGAGTATACTGCACAG | AQLKTAEYTAQ | 10774 | LKTAEYT | 0.464287 | 0.205827 |
| SyS264 | 1597 | GCCCAATCGAGTGAGAAGCCGTTTCGGGCACAG | AQSSEKPFRAQ | 10775 | SSEKPFR | 0.464115 | 0.348084 |
| SyS265 | 1598 | GCCCAACCACCAGCGGCGCGTCTTCGGCGCACAG | AQPTSGVFGAQ | 10776 | PTSGVFG | 0.464095 | -0.13314 |
| SyS266 | 1599 | GCCCAAGGCCCAGCCCAGCATCGTCACCATGGCACAG | AQGPSIVTMAQ | 10777 | GPSIVTM | 0.464061 | 0.018407 |
| SyS267 | 1600 | GCCCAAACGAGTGATAAGAGTTCGCTTGCACAG | AQTSDKSSLAQ | 10778 | TSDKSSL | 0.463586 | 0.196158 |
| SyS268 | 1601 | GCCCAAAATACTATTACTATGGCTAAGGCACAG | AQNTITMAKAQ | 10779 | NTITMAK | 0.46346 | 0.027199 |
| GS139 | 1602 | GCCCAACGAATCAGCCTGTTCCGAGTGCACAG | AQRNQPVPSAQ | 10780 | RNQPVPS | 0.463054 | -0.12521 |
| SyS269 | 1603 | GCCCAAAGCGTCCACCTCAACCTCCAAGCACAG | AQSVHLNLQAQ | 10781 | SVHLNLQ | 0.463008 | -0.15411 |
| SyS270 | 1604 | GCCCAATATAATCTGACGATGGTTAGTGCACAG | AQYNLTMVSAQ | 10782 | YNLTMVS | 0.462794 | -0.10646 |
| GS140 | 1605 | GCCCAAAACCGCGACAGCAGCCACCCAGAGCACAG | AQTADSHPRAQ | 10783 | TADSHPR | 0.462708 | -0.06423 |
| SyS271 | 1606 | GCCCAATTGCTTGGTGAGAAGGTGATGGCACAG | AQLLGEKVMAQ | 10784 | LLGEKVM | 0.462387 | 0.138902 |
| SyS272 | 1607 | GCCCAATGGGATCTGACTGCTCCGCAGGCACAG | AQWDLTAPQAQ | 10785 | WDLTAPQ | 0.462376 | -0.1489 |
| SyS273 | 1608 | GCCCAAGTGCTTGCTGATCGTCTTCCGGCACAG | AQVLADRLPAQ | 10786 | VLADRLP | 0.461956 | -0.00299 |
| SyS274 | 1609 | GCCCAATCTCGTGCGCTGCCGAATTCGGCACAG | AQSRALPNSAQ | 10787 | SRALPNS | 0.461886 | -0.05729 |

FIG. 33 (Continued)

| SyS276 | 1610 | GCCCAAAGCAGCCTCAACATGCCCAGAGCACAG | 6199 | AQSSLNMPRAQ | 10788 | SSLNMPR | 0.461752 | 0.063904 |
|---|---|---|---|---|---|---|---|---|
| GS141 | 1611 | GCCCAACAGAGAAGGTTTCGATTTGGCTGCACAG | 6200 | AQQKVSILAAQ | 10789 | QKVSILA | 0.461267 | -0.03269 |
| GS142 | 1612 | GCCCAAAGAGAGGCGACAACAGCAGACTCGCACAG | 6201 | AQRGDNSRLAQ | 10790 | RGDNSRL | 0.461258 | -0.08034 |
| SyS277 | 1613 | GCCCAAAGAATCGACCTCGGCAGCCAAGCACAG | 6202 | AQRIDLGSQAQ | 10791 | RIDLGSQ | 0.461247 | 0.339499 |
| SyS278 | 1614 | GCCCAAGCGTCGCTGGGTCTTCGGGCTGCACAG | 6203 | AQASLGLRAAQ | 10792 | ASLGLRA | 0.461166 | -0.04662 |
| GS143 | 1615 | GCCCAATCGATGCAGAATGGTCTTCGGGCACAG | 6204 | AQSMQNGLRAQ | 10793 | SMQNGLR | 0.460831 | -0.12628 |
| SyS279 | 1616 | GCCCAAACGTTGGCTGTGTGGGGATTGCGGCACAG | 6205 | AQTLAVGIAAQ | 10794 | TLAVGIA | 0.46068 | 0.081823 |
| SyS280 | 1617 | GCCCAAGGGCAGACTGTGACGGGGGCGGCACAG | 6206 | AQGQTVTGAAQ | 10795 | GQTVTGA | 0.460554 | 0.339252 |
| SyS281 | 1618 | GCCCAACATGCTTTGAGTCCTTCTCCGGCACAG | 6207 | AQHALSPSPAQ | 10796 | HALSPSP | 0.459785 | 0.442724 |
| GS144 | 1619 | GCCCAAGTCAGCAGCGTCTTCACCGAAGCACAG | 6208 | AQVSSVFTEAQ | 10797 | VSSVFTE | 0.459264 | -0.12544 |
| GS145 | 1620 | GCCCAATACGGGCGCCGGCGCGTCAAAGCACAG | 6209 | AQYGAGAVKAQ | 10798 | YGAGAVK | 0.459168 | -0.15792 |
| GS146 | 1621 | GCCCAAAAAGAAACCCTCCCCAACGCGCACAG | 6210 | AQKETLPNAAQ | 10799 | KETLPNA | 0.458924 | 0.031664 |
| GS147 | 1622 | GCCCAAATCCCAGCCAAACCCCCTCGCACAG | 6211 | AQIPSQTPLAQ | 10800 | IPSQTPL | 0.458515 | 0.02063 |
| SyS282 | 1623 | GCCCAAAGGCCATCAGCACCTTCGTCGCACAG | 6212 | AQSAISTFVAQ | 10801 | SAISTFV | 0.458157 | 0.041708 |
| SyS283 | 1624 | GCCCAAGTCAACAGCACCAGCAGCACCGCACAG | 6213 | AQVNSTSSTAQ | 10802 | VNSTSST | 0.458101 | 0.362297 |
| GS148 | 1625 | GCCCAACCTACGCGTGATTATAAGGAGGCACAG | 6214 | AQPTRDYKEAQ | 10803 | PTRDYKE | 0.457355 | -0.10546 |
| GS149 | 1626 | GCCCAAAACAACCCGCCAGCACCCAAGCACAG | 6215 | AQNNPASTQAQ | 10804 | NNPASTQ | 0.457315 | -0.17195 |
| SyS284 | 1627 | GCCCAAGTGACGCAGAACGTCTGTTAATGCACAG | 6216 | AQVTQTSVNAQ | 10805 | VTQTSVN | 0.456877 | 0.386968 |
| SyS285 | 1628 | GCCCAATGGGCCGGCACCACCAGCCACGCACAG | 6217 | AQWAGTTSHAQ | 10806 | WAGTTSH | 0.45637 | 0.26665 |
| SyS286 | 1629 | GCCCAAGTCACCGCGGCTTCAGCGCCGCACAG | 6218 | AQVTAGFSAAQ | 10807 | VTAGFSA | 0.455591 | 0.020831 |
| SyS287 | 1630 | GCCCAATTGCATTCTCCTTCTATGCAGGCACAG | 6219 | AQLHSPSMQAQ | 10808 | LHSPSMQ | 0.454973 | -0.08509 |
| GS151 | 1631 | GCCCAATTTCCTACGCAGCCTTCGATGGCACAG | 6220 | AQFPTQPSMAQ | 10809 | FPTQPSM | 0.454886 | -0.05716 |
| SyS288 | 1632 | GCCCAAGCCAAAGCGTCAACGACGGCGCACAG | 6221 | AQAQSVNDGAQ | 10810 | AQSVNDG | 0.454548 | -0.14283 |
| SyS289 | 1633 | GCCCAAGTCGCCAGCACCACCTACACCGCACAG | 6222 | AQVASTTYTAQ | 10811 | VASTTYT | 0.454439 | 0.100393 |
| SyS290 | 1634 | GCCCAACTGGGGGGGTTGAATTCGGTGGCACAG | 6223 | AQLGGLNSVAQ | 10812 | LGGLNSV | 0.454111 | 0.166066 |
| SyS291 | 1635 | GCCCAAGCCGGCGCCCCAGCCTCAGCGCACAG | 6224 | AQAGAPSLSAQ | 10813 | AGAPSLS | 0.452883 | -0.02402 |
| TS126 | 1636 | GCCCAAAGTAATAGGAAGATTGATGATGCACAG | 6225 | AQSNRKIDDAQ | 10814 | SNRKIDD | 0.452682 | 0.231949 |
| GP73 | 1637 | GCCCAATCTCCTAATAATAGGGCTGTGGCACAG | 6226 | AQSPNNRAVAQ | 10815 | SPNNRAV | 0.452479 | 0.244087 |
| SyS293 | 1638 | GCCCAAGTTTGAGGGAGGATCAGTCGGCACAG | 6227 | AQVLREDQSAQ | 10816 | VLREDQS | 0.452095 | -0.02524 |
| SyS294 | 1639 | GCCCAACTTCTTGCGACTGGGCTTAAGGCACAG | 6228 | AQLLATGLKAQ | 10817 | LLATGLK | 0.452095 | -0.17193 |
| GS152 | 1640 | GCCCAAGTCCACCTCAGAAGCCAAATCGCACAG | 6229 | AQVHLRSQIAQ | 10818 | VHLRSQI | 0.451987 | -0.18149 |
| GS153 | 1641 | GCCCAAAGTGCGAATTTGAAGGCACAG | 6230 | AQSANSNLKAQ | 10819 | SANSNLK | 0.451973 | 0.020578 |

FIG. 33 (Continued)

| | | | | | | | | |
|---|---|---|---|---|---|---|---|---|
| SyS295 | 1642 | GCCCAAAGCAAAGCGGCGGCGAAGGCAACGCACAG | 6231 | AQSKAGEGNAQ | 10820 | SKAGEGN | 0.451948 | 0.034237 |
| SyS296 | 1643 | GCCCAAGTCAGCAACCCCGCCATGAAAGCACAG | 6232 | AQVSNPAMKAQ | 10821 | VSNPAMK | 0.451812 | 0.252408 |
| GS154 | 1644 | GCCCAAATCAACGGCAACAACCAAAGAGCACAG | 6233 | AQINGNNQRAQ | 10822 | INGNNQR | 0.451801 | 0.154055 |
| SP30 | 1645 | GCCCAATATAAGTCGACGACTCTTTCTGCACAG | 6234 | AQYKSTTLSAQ | 10823 | YKSTTLS | 0.451779 | -0.05333 |
| SyS297 | 1646 | GCCCAAAAAGAGAGGCCTCGTCGCAGCAGAGCACAG | 6235 | AQKEGLVSRAQ | 10824 | KEGLVSR | 0.451637 | 0.196029 |
| GS155 | 1647 | GCCCAACACCTCAAAGTCATGACCATCGCACAG | 6236 | AQHLKVMTIAQ | 10825 | HLKVMTI | 0.451183 | -0.16304 |
| SyS298 | 1648 | GCCCAAAGAACCAACGACCACAGCAGCGCACAG | 6237 | AQRTNDHSSAQ | 10826 | RTNDHSS | 0.45114 | 0.269153 |
| SyS299 | 1649 | GCCCAACTGCCTTCTCAGTCTGCTAAGGCACAG | 6238 | AQIPSQSAKAQ | 10827 | LPSQSAK | 0.450976 | -0.15061 |
| GS156 | 1650 | GCCCAAATTACGCTGAGGCATTTGCAGGCACAG | 6239 | AQITLRHLQAQ | 10828 | ITLRHLQ | 0.45092 | -0.16814 |
| SyS300 | 1651 | GCCCAACAAAATGATCGCCAACATCCCCGCACAG | 6240 | AQQMIANIPAQ | 10829 | QMIANIP | 0.450647 | 0.113255 |
| SyS301 | 1652 | GCCCAAAGTTCTTCGACTGATCAGCATGCACAG | 6241 | AQSSSTDQHAQ | 10830 | SSSTDQH | 0.450468 | -0.09886 |
| SyS302 | 1653 | GCCCAAAGAAGCACCGACTTCACCCCGCACAG | 6242 | AQRSTDFTPAQ | 10831 | RSTDFTP | 0.450431 | -0.13428 |
| SyS303 | 1654 | GCCCAACAGCATGCGTCTATTTCTGCTGCACAG | 6243 | AQQHASISAAQ | 10832 | QHASISA | 0.450427 | 0.019295 |
| GS157 | 1655 | GCCCAAAAACATCAGCAGCATGCAAATGGCACAG | 6244 | AQNISSMQMAQ | 10833 | NISSMQM | 0.450075 | -0.06541 |
| GS158 | 1656 | GCCCAATCGGGGAATGTTGTGGGGCGGGGCACAG | 6245 | AQSGNVVGRAQ | 10834 | SGNVVGR | 0.449772 | -0.03169 |
| SyS304 | 1657 | GCCCAAAGCAAAGGCGACACCAGCGCCGCACAG | 6246 | AQSKGDTSAAQ | 10835 | SKGDTSA | 0.449763 | 0.203441 |
| SyS306 | 1658 | GCCCAACTGCTGAATACGGGGACTAAGGCACAG | 6247 | AQILNTGTKAQ | 10836 | LLNTGTK | 0.448254 | 0.095948 |
| GS159 | 1659 | GCCCAAGGTACTGGGGTAGTATGAATGCACAG | 6248 | AQGTGASMNAQ | 10837 | GTGASMN | 0.448204 | -0.05716 |
| SyS307 | 1660 | GCCCAACGTCTTGATGCGAATTCTACGGCACAG | 6249 | AQRLDANSTAQ | 10838 | RLDANST | 0.448191 | 0.242147 |
| GS161 | 1661 | GCCCAACTCCCGGAAAGACCCAACAGCGCACAG | 6250 | AQLPERPNSAQ | 10839 | LPERPNS | 0.448013 | -0.01858 |
| SyS308 | 1662 | GCCCAAGCCAGAGAAAATCCTCAACCACGCACAG | 6251 | AQAREILNHAQ | 10840 | AREILNH | 0.447539 | -0.01147 |
| GS162 | 1663 | GCCCAAAACTTCAAAACCACCAACAGCGCACAG | 6252 | AQNFKTTNSAQ | 10841 | NFKTTNS | 0.447528 | 0.230441 |
| GS163 | 1664 | GCCCAAGGCAGAACCGTCCAAGACAGAGACAG | 6253 | AQGRTVQDRAQ | 10842 | GRTVQDR | 0.447505 | 0.075102 |
| GS164 | 1665 | GCCCAAGGTATGAATCAGACGAGACTGCACAG | 6254 | AQGMNQTTTAQ | 10843 | GMNQTTT | 0.446073 | -0.05268 |
| SyS309 | 1666 | GCCCAAGTCGGCAAAGAGACGGGCGTCTGCACAG | 6255 | AQVGKDGVLAQ | 10844 | VGKDGVL | 0.445922 | 0.442273 |
| GS165 | 1667 | GCCCAAGTCACCAGAGACGGGCCAAAGCACAG | 6256 | AQVTRDGAKAQ | 10845 | VTRDGAK | 0.444855 | 0.06699 |
| GS166 | 1668 | GCCCAAGGTACTGCTACGTATGGTAAGGCACAG | 6257 | AQGTATYGKAQ | 10846 | GTATYGK | 0.444487 | -0.00843 |
| SyS310 | 1669 | GCCCAAATGTTGGGTGCTGAGGGGTATGCACAG | 6258 | AQMLGAEGYAQ | 10847 | MLGAEGY | 0.444372 | -0.08881 |
| SyS311 | 1670 | GCCCAAGTCACCCAACAAAACCACCACGCACAG | 6259 | AQVTQQNHHAQ | 10848 | VTQQNHH | 0.444284 | 0.142962 |
| SyS312 | 1671 | GCCCAAACCGTCAACGCCGACCAACTCGCACAG | 6260 | AQTVNADQLAQ | 10849 | TVNADQL | 0.444272 | 0.091137 |
| GS167 | 1672 | GCCCAACAGATGCAGAATAGTCCTATTGCACAG | 6261 | AQQMQNSPIAQ | 10850 | QMQNSPI | 0.443818 | -0.13896 |
| SyS313 | 1673 | GCCCAAGGGACGCTGGCGAGTTCGAAGGCACAG | 6262 | AQGTLASSKAQ | 10851 | GTLASSK | 0.443282 | 0.256025 |

FIG. 33 (Continued)

| | | | | | | | | |
|---|---|---|---|---|---|---|---|---|
| GS169 | 1674 | GCCCAATCTAATGTGACGATTGCGCATGCACAG | 6263 | AQSNVTIAHAQ | 10852 | SNVTIAH | 0.442526 | -0.12177 |
| GS170 | 1675 | GCCCAAGCGAATAATTCTCGTTCGTTTGCACAG | 6264 | AQANNSRPFAQ | 10853 | ANNSRPF | 0.442454 | 0.419078 |
| SyS314 | 1676 | GCCCAAATTGCGACGGCGGGTGGTCCTGCACAG | 6265 | AQIATAGGPAQ | 10854 | IATAGGP | 0.441873 | 0.058602 |
| SyS315 | 1677 | GCCCAAGCCTTCAGCGGCCCCAGCAGAGCACAG | 6266 | AQAFSGPSRAQ | 10855 | AFSGPSR | 0.441659 | 0.035379 |
| SyS316 | 1678 | GCCCAACTCACCAACCTCGTCAGCAGAGCACAG | 6267 | AQLTNLVSRAQ | 10856 | LTNLVSR | 0.441549 | 0.067167 |
| SyS317 | 1679 | GCCCAAGCGGCCAACACCTCGCCCTCGCACAG | 6268 | AQAGQHLALAQ | 10857 | AGQHLAL | 0.441104 | -0.01578 |
| SyS318 | 1680 | GCCCAAAGTGTTGTGGCGTCTGCGAATGCACAG | 6269 | AQSVVASANAQ | 10858 | SVVASAN | 0.441056 | 0.010976 |
| SyS319 | 1681 | GCCCAAGAGACTGTTTCGACTAGTCTTGCACAG | 6270 | AQETVSTSLAQ | 10859 | ETVSTSL | 0.441048 | -0.09691 |
| SyS320 | 1682 | GCCCAAATCCTCGCGCCCTCACCGGCGCACAG | 6271 | AQILAALTGAQ | 10860 | ILAALTG | 0.440956 | -0.10525 |
| SyS321 | 1683 | GCCCAAACGACGGATAAGGCTGCGCTTGCACAG | 6272 | AQTTDKAALAQ | 10861 | TTDKAAL | 0.440639 | 0.0093 |
| SyS322 | 1684 | GCCCAATACCTGACAAACCGGCGCCGCACAG | 6273 | AQYLDKPGAAQ | 10862 | YLDKPGA | 0.43977 | 0.043522 |
| SyS323 | 1685 | GCCCAACCCAACCTCAGCAACCTCATGGCACAG | 6274 | AQPNLSNLMAQ | 10863 | PNLSNLM | 0.439343 | 0.188183 |
| SyS324 | 1686 | GCCCAAATTAATGCGCCTACGGCTAGTGCACAG | 6275 | AQINAPTASAQ | 10864 | INAPTAS | 0.439282 | 0.11633 |
| SyS325 | 1687 | GCCCAACATGGTGGTACGAGTCTGGCTGCACAG | 6276 | AQHGGTSLAAQ | 10865 | HGGTSLA | 0.439114 | 0.231778 |
| SyS326 | 1688 | GCCCAAAATATTCAGTTGTCTCTTGCTGCACAG | 6277 | AQNIQLSLAAQ | 10866 | NIQLSLA | 0.438906 | -0.04774 |
| SyS327 | 1689 | GCCCAAACTCTTCATATGTCTAGTAAGGCACAG | 6278 | AQTLHMSSKAQ | 10867 | TLHMSSK | 0.438887 | -0.06151 |
| GS171 | 1690 | GCCCAAGCCATCATCAACCCCACAGCGCACAG | 6279 | AQAIINPHSAQ | 10868 | AIINPHS | 0.438571 | -0.07991 |
| SyS328 | 1691 | GCCCAAAATACTCTGATTAATGTTAGTGCACAG | 6280 | AQNTLINVSAQ | 10869 | NTLINVS | 0.438518 | -0.09555 |
| SyS329 | 1692 | GCCCAAAACAGCGTCGTCCTCGCCATGGCACAG | 6281 | AQNSVVLAMAQ | 10870 | NSVVLAM | 0.438471 | -0.12176 |
| SyS330 | 1693 | GCCCAAAATATGGCTTCTTTGTCGGCGGCACAG | 6282 | AQNMASLSAAQ | 10871 | NMASLSA | 0.438292 | 0.417265 |
| GS172 | 1694 | GCCCAAGCAGCAGCACCACCTCGCGCACAG | 6283 | AQSSTHLLAAQ | 10872 | SSTHLLA | 0.438222 | -0.05576 |
| SyS331 | 1695 | GCCCAAGACAACAGCAAAGCGACAAAGCACAG | 6284 | AQDNSQSDKAQ | 10873 | DNSQSDK | 0.437981 | -0.03541 |
| GS173 | 1696 | GCCCAAGGCATCACCACCAACGCCCAGCGCACAG | 6285 | AQGITTNAHAQ | 10874 | GITTNAH | 0.437698 | 0.041733 |
| SyS332 | 1697 | GCCCAATCTAGTACTATTAATGGGTATGCACAG | 6286 | AQSSTINGYAQ | 10875 | SSTINGY | 0.437133 | -0.0969 |
| SyS333 | 1698 | GCCCAAAATCATACGCGGATGAATGAGGCACAG | 6287 | AQNHTRMNEAQ | 10876 | NHTRMNE | 0.436984 | 0.166362 |
| GS174 | 1699 | GCCCAAGGCAACCAACAAAAAACCTCGCACAG | 6288 | AQGNQQKNLAQ | 10877 | GNQQKNL | 0.436441 | -0.03233 |
| GS175 | 1700 | GCCCAAGGTACGAGTGATCGGCAGCAGGCACAG | 6289 | AQGTSDRQQAQ | 10878 | GTSDRQQ | 0.436147 | 0.02699 |
| GS176 | 1701 | GCCCAAAGCGACAGCGAATACAAACCCGCACAG | 6290 | AQSDSEYKPAQ | 10879 | SDSEYKP | 0.435589 | -0.08679 |
| SyS334 | 1702 | GCCCAAACGGCTGCGCATGTTAGTTATGCACAG | 6291 | AQTAAHVSYAQ | 10880 | TAAHVSY | 0.435197 | -0.16291 |
| SyS335 | 1703 | GCCCAAATGGCCACCACCACGCCGCGCACAG | 6292 | AQMATTHAAAQ | 10881 | MATTHAA | 0.434993 | 0.274299 |
| TS128 | 1704 | GCCCAAAACAGCGTCAGACAAAGCCTCGCACAG | 6293 | AQNSVRQSLAQ | 10882 | NSVRQSL | 0.434805 | -0.16564 |
| SyS336 | 1705 | GCCCAATCGGGTAGTGGTGTTAGTAGTGCACAG | 6294 | AQSGSGVSSAQ | 10883 | SGSGVSS | 0.434548 | 0.291222 |

FIG. 33 (Continued)

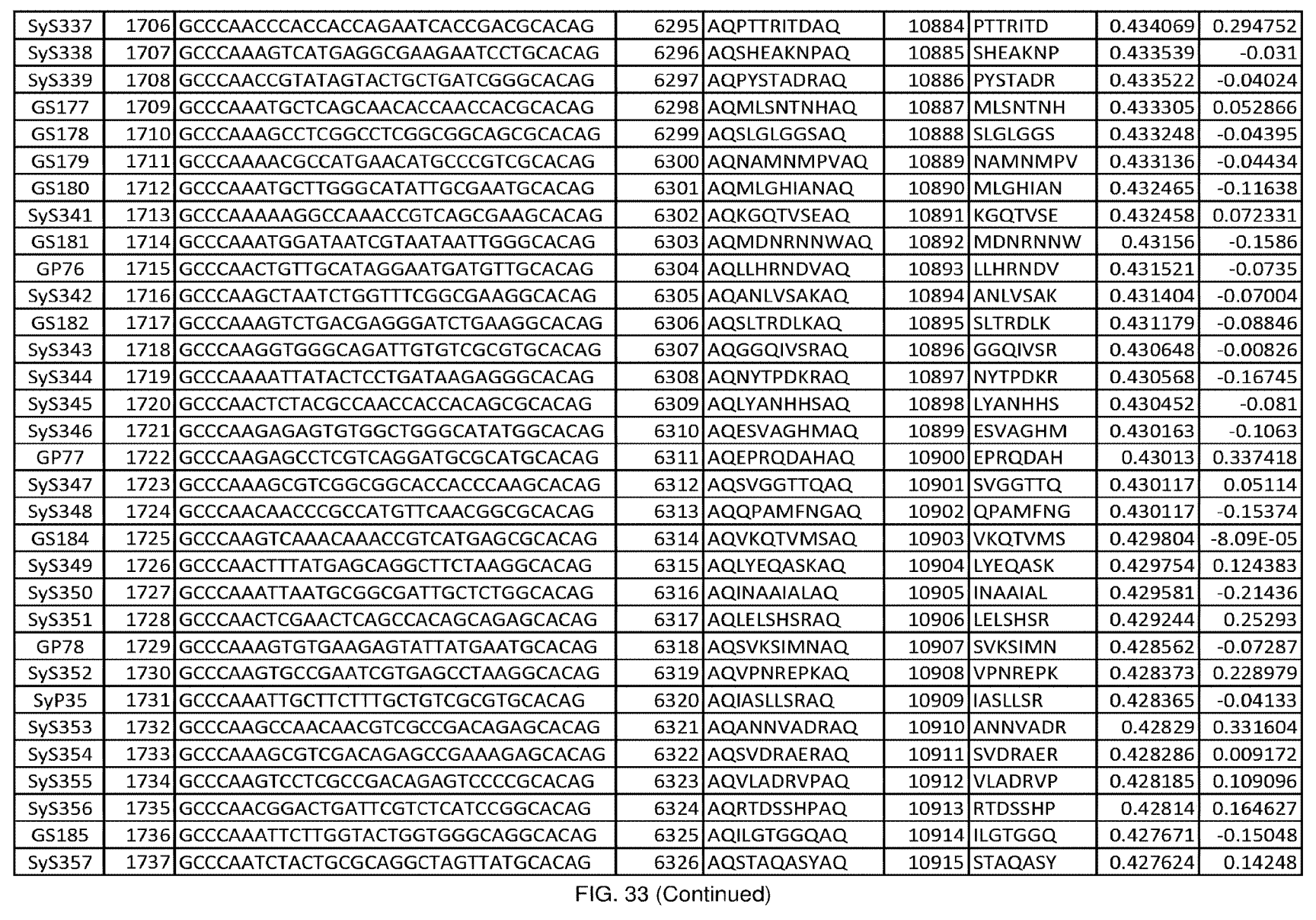

| | | | | | | | | |
|---|---|---|---|---|---|---|---|---|
| SyS337 | 1706 | GCCCAACCACCACCAGAATCACCGACGCACAG | 6295 | AQPTTRITDAQ | 10884 | PTTRITD | 0.434069 | 0.294752 |
| SyS338 | 1707 | GCCCAAAGTCATGAGGCGAAGAATCCTGCACAG | 6296 | AQSHEAKNPAQ | 10885 | SHEAKNP | 0.433539 | -0.031 |
| SyS339 | 1708 | GCCCAACCGTATAGTACTGCTGATCGGGCACAG | 6297 | AQPYSTADRAQ | 10886 | PYSTADR | 0.433522 | -0.04024 |
| GS177 | 1709 | GCCCAAATGCTCAGCAACCAACCACGCACAG | 6298 | AQMLSNTNHAQ | 10887 | MLSNTNH | 0.433305 | 0.052866 |
| GS178 | 1710 | GCCCAAAGCTCGGCCTCGGCGGCAGCGCACAG | 6299 | AQSLGLGGSAQ | 10888 | SLGLGGS | 0.433248 | -0.04395 |
| GS179 | 1711 | GCCCAAAACGCCATGAACATGCCCGTCGCACAG | 6300 | AQNAMNMPVAQ | 10889 | NAMNMPV | 0.433136 | -0.04434 |
| GS180 | 1712 | GCCCAAATGCTTGGGCATATTGCGAATGCACAG | 6301 | AQMLGHIANAQ | 10890 | MLGHIAN | 0.432465 | -0.11638 |
| SyS341 | 1713 | GCCCAAAAAGGCCAAACCGTCAGCGAAGCACAG | 6302 | AQKGQTVSEAQ | 10891 | KGQTVSE | 0.432458 | 0.072331 |
| GS181 | 1714 | GCCCAAATGGATAATCGTAATAATTGGGCACAG | 6303 | AQMDNRNNWAQ | 10892 | MDNRNNW | 0.43156 | -0.1586 |
| GP76 | 1715 | GCCCAACTGTTGCATAGGAATGATGTTGCACAG | 6304 | AQLLHRNDVAQ | 10893 | LLHRNDV | 0.431521 | -0.0735 |
| SyS342 | 1716 | GCCCAAGCTAATCTGGTTTCGGCGAAGGCACAG | 6305 | AQANLVSAKAQ | 10894 | ANLVSAK | 0.431404 | -0.07004 |
| GS182 | 1717 | GCCCAAAGTCTGACGAGGGATCTGAAGGCACAG | 6306 | AQSLTRDLKAQ | 10895 | SLTRDLK | 0.431179 | -0.08846 |
| SyS343 | 1718 | GCCCAAGGTGGGCAGATTGTGTCGCGTGCACAG | 6307 | AQGGQIVSRAQ | 10896 | GGQIVSR | 0.430648 | -0.00826 |
| SyS344 | 1719 | GCCCAAAATTATATCCTGATAAGAGGGCACAG | 6308 | AQNYTPDKRAQ | 10897 | NYTPDKR | 0.430568 | -0.16745 |
| SyS345 | 1720 | GCCCAACTCTACGCCAACCACCAGCGCACAG | 6309 | AQLYANHHSAQ | 10898 | LYANHHS | 0.430452 | -0.081 |
| SyS346 | 1721 | GCCCAAGAGAGTGTGGCTGGGCATATGGCACAG | 6310 | AQESVAGHMAQ | 10899 | ESVAGHM | 0.430163 | -0.1063 |
| GP77 | 1722 | GCCCAAGAGCCTCGTCAGGATGCGCATGCACAG | 6311 | AQEPRQDAHAQ | 10900 | EPRQDAH | 0.43013 | 0.337418 |
| SyS347 | 1723 | GCCCAAAGCGTCGGCGGCGCACCCAAGCACAG | 6312 | AQSVGGTTQAQ | 10901 | SVGGTTQ | 0.430117 | 0.05114 |
| SyS348 | 1724 | GCCCAACAACCCGCCATGTTCAACGGCGCACAG | 6313 | AQQPAMFNGAQ | 10902 | QPAMFNG | 0.430117 | -0.15374 |
| GS184 | 1725 | GCCCAAGTCAAACAAACCGTCATGAGCGCACAG | 6314 | AQVKQTVMSAQ | 10903 | VKQTVMS | 0.429804 | -8.09E-05 |
| SyS349 | 1726 | GCCCAACTTTATGAGCAGGCTTCTAAGGCACAG | 6315 | AQLYEQASKAQ | 10904 | LYEQASK | 0.429754 | 0.124383 |
| SyS350 | 1727 | GCCCAAATTAATGCGGCGATTGCTCTGGCACAG | 6316 | AQINAAIALAQ | 10905 | INAAIAL | 0.429581 | -0.21436 |
| SyS351 | 1728 | GCCCAACTCGAACTCAGCCACAGCAGAGCACAG | 6317 | AQLELSHSRAQ | 10906 | LELSHSR | 0.429244 | 0.25293 |
| GP78 | 1729 | GCCCAAAGTGTGAAAGAGTATTATGAATGCACAG | 6318 | AQSVKSIMNAQ | 10907 | SVKSIMN | 0.428562 | -0.07287 |
| SyS352 | 1730 | GCCCAAGTGCCGAATCGTGAGCCTAAGGCACAG | 6319 | AQVPNREPKAQ | 10908 | VPNREPK | 0.428373 | 0.228979 |
| SyP35 | 1731 | GCCCAAATTGCTTCTTCTTTGCGTGTCGCACAG | 6320 | AQIASLLSRAQ | 10909 | IASLLSR | 0.428365 | -0.04133 |
| SyS353 | 1732 | GCCCAAGCCAACAACGTCGCCGACAGAGCACAG | 6321 | AQANNVADRAQ | 10910 | ANNVADR | 0.42829 | 0.331604 |
| SyS354 | 1733 | GCCCAAAGCGTCGACAGAGCGAAAGAGCACAG | 6322 | AQSVDRAERAQ | 10911 | SVDRAER | 0.428286 | 0.009172 |
| SyS355 | 1734 | GCCCAAGTCCTCGCCGACAGAGTCCCGCACAG | 6323 | AQVLADRVPAQ | 10912 | VLADRVP | 0.428185 | 0.109096 |
| SyS356 | 1735 | GCCCAACGGACTGATTCGTCATCCGGCACAG | 6324 | AQRTDSSHPAQ | 10913 | RTDSSHP | 0.42814 | 0.164627 |
| GS185 | 1736 | GCCCAAATTCTTGGTACTGGTGGGCAGGCACAG | 6325 | AQILGTGGQAQ | 10914 | ILGTGGQ | 0.427671 | -0.15048 |
| SyS357 | 1737 | GCCCAATCTACTGCGCAGGCTAGTTATGCACAG | 6326 | AQSTAQASYAQ | 10915 | STAQASY | 0.427624 | 0.14248 |

FIG. 33 (Continued)

| | | | | | | | | |
|---|---|---|---|---|---|---|---|---|
| SyS358 | 1738 | GCCCAAGTCGGCCCCATCAACACCGTCGCACAG | 6327 | AQVGPINTVAQ | 10916 | VGPINTV | 0.427596 | 0.270593 |
| SyS359 | 1739 | GCCCAACAAACCAACACACCGTCAGAGCACAG | 6328 | AQQTNNTVRAQ | 10917 | QTNNTVR | 0.427534 | 0.514292 |
| TS129 | 1740 | GCCCAACAAGGCAACGCCGTCAGAAGCACCGCACAG | 6329 | AQGNAVRSTAQ | 10918 | GNAVRST | 0.427529 | 1.114857 |
| SyS360 | 1741 | GCCCAACAGAATTGACTAAGGGTCAGGCACAG | 6330 | AQQNLTKGQAQ | 10919 | QNLTKGQ | 0.427304 | 0.307102 |
| GS186 | 1742 | GCCCAAAAACAACTCAGCAAAGACTACGCACAG | 6331 | AQKQLSKDYAQ | 10920 | KQLSKDY | 0.427204 | 0.142161 |
| SyS361 | 1743 | GCCCAAATGGTTCAGAATGGTCTGATTGCACAG | 6332 | AQMVQNGLIAQ | 10921 | MVQNGLI | 0.426778 | 0.092359 |
| SyS362 | 1744 | GCCCAAATCGTCGAACACATGCCCCTCGCACAG | 6333 | AQIVEHMPLAQ | 10922 | IVEHMPL | 0.426165 | -0.1101 |
| GS187 | 1745 | GCCCAATACGACACCACCAGCATCTTCGCACAG | 6334 | AQYDTTSIFAQ | 10923 | YDTTSIF | 0.425436 | -0.10346 |
| GS188 | 1746 | GCCCAAAATAGTATTTCGTCTTCGGCTGCACAG | 6335 | AQNSISSSAAQ | 10924 | NSISSSA | 0.425239 | 0.069039 |
| SyS364 | 1747 | GCCCAAGGCGGCAACAACAGCCTCCACGCACAG | 6336 | AQGGNNSLHAQ | 10925 | GGNNSLH | 0.425087 | 0.214382 |
| SyS365 | 1748 | GCCCAAATTTCTGGTGCGTCTCTTATGGCACAG | 6337 | AQISGASLMAQ | 10926 | ISGASLM | 0.424892 | -0.11822 |
| GP79 | 1749 | GCCCAAGCTACTCTTTCGAGGAATGTTGCACAG | 6338 | AQATLSRNVAQ | 10927 | ATLSRNV | 0.424839 | -0.0735 |
| SyS366 | 1750 | GCCCAACTGGCTAATAATGTTCCGCTTGCACAG | 6339 | AQLANNVPLAQ | 10928 | LANNVPL | 0.424655 | -0.08052 |
| SyS367 | 1751 | GCCCAATGGAGCGACCCCAGCGACCTCGCACAG | 6340 | AQWSDPSDLAQ | 10929 | WSDPSDL | 0.424504 | -0.17072 |
| SyS368 | 1752 | GCCCAAGCAGCCTCACCGACCAACCGCACAG | 6341 | AQSSLTDQPAQ | 10930 | SSLTDQP | 0.424278 | 0.005071 |
| SyS369 | 1753 | GCCCAATACGTCCCCGACCACCACCAGAGCACAG | 6342 | AQYVPDHTRAQ | 10931 | VVPDHTR | 0.424216 | 0.056561 |
| SyS370 | 1754 | GCCCAAAATAATACGGAGGGGTAAGGCGGCACAG | 6343 | AQNNTEGKAAQ | 10932 | NNTEGKA | 0.423868 | 0.141109 |
| TS130 | 1755 | GCCCAAGGTAATAGTGTTTAGGTTGATTGCACAG | 6344 | AQGNSVRLIAQ | 10933 | GNSVRLI | 0.423672 | -0.10341 |
| SyS371 | 1756 | GCCCAAATTGCGCAGTCGAATACTCTTGCACAG | 6345 | AQIAQSNTLAQ | 10934 | IAQSNTL | 0.423532 | 0.211326 |
| GS189 | 1757 | GCCCAACACGACAACGCCACCAAATACGCACAG | 6346 | AQHDNATKYAQ | 10935 | HDNATKY | 0.423515 | 0.078962 |
| SyS372 | 1758 | GCCCAAACTAAGGCTAATGAGATGCAGGCACAG | 6347 | AQTKANEMQAQ | 10936 | TKANEMQ | 0.423482 | 0.265014 |
| GS190 | 1759 | GCCCAATATTTGGGTACGGTTGTTGCGGCACAG | 6348 | AQYLGTVVAAQ | 10937 | YLGTVVA | 0.423467 | -0.07819 |
| SyS373 | 1760 | GCCCAACCTTCGATTGAGCTTAAGCCTGCACAG | 6349 | AQPSIELKPAQ | 10938 | PSIELKP | 0.423417 | -0.09703 |
| SyS374 | 1761 | GCCCAAGCTGCGGGGAATGTTCTTATGGCACAG | 6350 | AQAAGNVLMAQ | 10939 | AAGNVLM | 0.423413 | 0.035242 |
| SyS375 | 1762 | GCCCAAACGTCTGTGGCTAATTTGCGTGCACAG | 6351 | AQTSVANLRAQ | 10940 | TSVANLR | 0.422924 | 0.030491 |
| GS191 | 1763 | GCCCAATTTTCGCGTGAGCCGAAGCCTGCACAG | 6352 | AQFSREPKPAQ | 10941 | FSREPKP | 0.422561 | -0.02217 |
| SyS376 | 1764 | GCCCAAACCCCAGAGAAAACTGGGGCGCACAG | 6353 | AQTPRENWGAQ | 10942 | TPRENWG | 0.422534 | -0.00948 |
| SyS377 | 1765 | GCCCAATCGCAGAATGTTGGTACTAAGGCACAG | 6354 | AQSQNVGTKAQ | 10943 | SQNVGTK | 0.422488 | -0.06393 |
| GS192 | 1766 | GCCCAATATCTGGATAAGGGGAGGACTGCACAG | 6355 | AQYLDKGRTAQ | 10944 | YLDKGRT | 0.422461 | -0.04855 |
| GP80 | 1767 | GCCCAAACGAGTACGACGCCTTTTCTTGCACAG | 6356 | AQTSTTPFLAQ | 10945 | TSTTPFL | 0.422363 | -0.0737 |
| SyS378 | 1768 | GCCCAACGGCAGGATAATCTGGAGCTGGCACAG | 6357 | AQRQDNLELAQ | 10946 | RQDNLEL | 0.422343 | -0.03114 |
| SyS379 | 1769 | GCCCAAATCAGCGACACAGCAGAGTCCACGCACAG | 6358 | AQISDSRVHAQ | 10947 | ISDSRVH | 0.421868 | 0.204338 |

FIG. 33 (Continued)

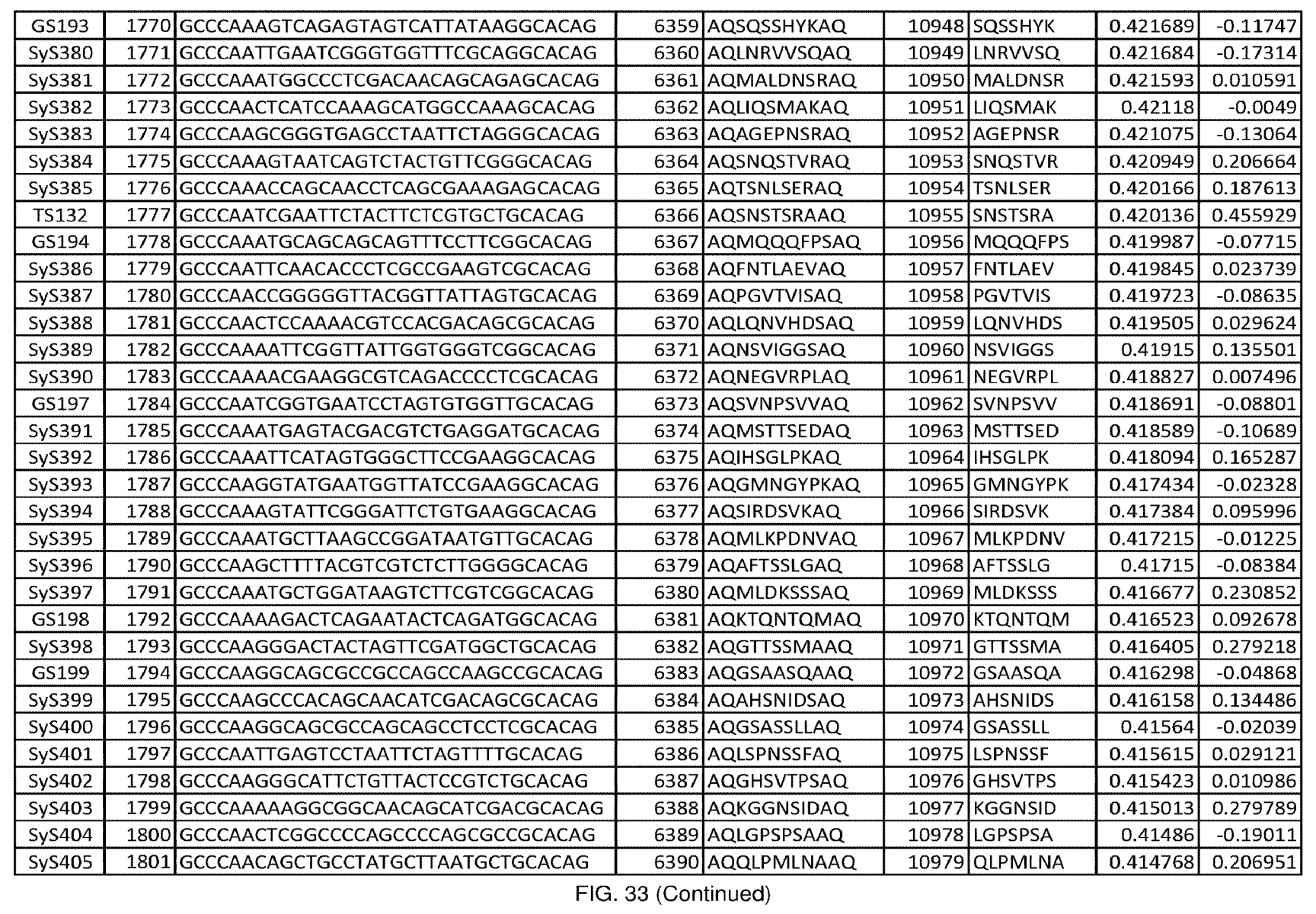

| | | | | | | | | |
|---|---|---|---|---|---|---|---|---|
| GS193 | 1770 | GCCCAAAGTCAGAGTAGTCATTATAAGGCACAG | 6359 | AQSQSSHYKAQ | 10948 | SQSSHYK | 0.421689 | -0.11747 |
| SyS380 | 1771 | GCCCAATTGAATCGGGTGGTTTCGCAGGCACAG | 6360 | AQINRVVSQAQ | 10949 | LNRVVSQ | 0.421684 | -0.17314 |
| SyS381 | 1772 | GCCCAAATGGCCCTCGACAACAGCAGAGCACAG | 6361 | AQMALDNSRAQ | 10950 | MALDNSR | 0.421593 | 0.010591 |
| SyS382 | 1773 | GCCCAACTCATCCAAAGCATGGCCAAAGCACAG | 6362 | AQLIQSMAKAQ | 10951 | LIQSMAK | 0.42118 | -0.0049 |
| SyS383 | 1774 | GCCCAAGCGGGTGAGCCTAATTCTAGGGCACAG | 6363 | AQAGEPNSRAQ | 10952 | AGEPNSR | 0.421075 | -0.13064 |
| SyS384 | 1775 | GCCCAAAGTAATCAGTCTACTGTTCGGGCACAG | 6364 | AQSNQSTVRAQ | 10953 | SNQSTVR | 0.420949 | 0.206664 |
| SyS385 | 1776 | GCCCAAACCAGCAACCTCAGCGAAAGAGCACAG | 6365 | AQTSNLSERAQ | 10954 | TSNLSER | 0.420166 | 0.187613 |
| TS132 | 1777 | GCCCAATCGAATTCTACTTCTCGTGCTGCACAG | 6366 | AQSNSTSRAAQ | 10955 | SNSTSRA | 0.420136 | 0.455929 |
| GS194 | 1778 | GCCCAAATGCAGCAGCAGTTCCTTCGGGCACAG | 6367 | AQMQQQFPSAQ | 10956 | MQQQFPS | 0.419987 | -0.07715 |
| SyS386 | 1779 | GCCCAATTCAACACCCTGCGCGAAGTCGCACAG | 6368 | AQFNTLAEVAQ | 10957 | FNTLAEV | 0.419845 | 0.023739 |
| SyS387 | 1780 | GCCCAACCGGGGGTTACGGTTATTAGTGCACAG | 6369 | AQPGVTVISAQ | 10958 | PGVTVIS | 0.419723 | -0.08635 |
| SyS388 | 1781 | GCCCAACTCCAAAACGTCCACGACAGCGCACAG | 6370 | AQLQNVHDSAQ | 10959 | LQNVHDS | 0.419505 | 0.029624 |
| SyS389 | 1782 | GCCCAAAATTCGGTTATTGGTGGGTCGGCACAG | 6371 | AQNSVIGGSAQ | 10960 | NSVIGGS | 0.41915 | 0.135501 |
| SyS390 | 1783 | GCCCAAAACGAAGGCGTCAGACCCCTCGCACAG | 6372 | AQNEGVRPLAQ | 10961 | NEGVRPL | 0.418827 | 0.007496 |
| GS197 | 1784 | GCCCAATCGGTGAATCCTAGTGTGGTTGCACAG | 6373 | AQSVNPSVVAQ | 10962 | SVNPSVV | 0.418691 | -0.08801 |
| SyS391 | 1785 | GCCCAAATGAGTACGACGTCTGAGGATGCACAG | 6374 | AQMSTTSEDAQ | 10963 | MSTTSED | 0.418589 | -0.10689 |
| SyS392 | 1786 | GCCCAAATTCATAGTGGGCTTCGAAGGCACAG | 6375 | AQIHSGLPKAQ | 10964 | IHSGLPK | 0.418094 | 0.165287 |
| SyS393 | 1787 | GCCCAAGGTATGAATGGTTATCCGAAGGCACAG | 6376 | AQGMNGYPKAQ | 10965 | GMNGYPK | 0.417434 | -0.02328 |
| SyS394 | 1788 | GCCCAAAGTATTCGGGATTCTGTGAAGGCACAG | 6377 | AQSIRDSVKAQ | 10966 | SIRDSVK | 0.417384 | 0.095996 |
| SyS395 | 1789 | GCCCAAAATGCTTAAGCGGGATAAATGTTGCACAG | 6378 | AQMLKPDNVAQ | 10967 | MLKPDNV | 0.417215 | -0.01225 |
| SyS396 | 1790 | GCCCAAGCTTTTACGTCGTCTTCTTGGGGCACAG | 6379 | AQAFTSSLGAQ | 10968 | AFTSSLG | 0.41715 | -0.08384 |
| SyS397 | 1791 | GCCCAAATGCTGGATAAGTCTTCGTCGGCACAG | 6380 | AQMLDKSSSAQ | 10969 | MLDKSSS | 0.416677 | 0.230852 |
| GS198 | 1792 | GCCCAAAAGACTCAGAATACTCAGATGGCACAG | 6381 | AQKTQNTQMAQ | 10970 | KTQNTQM | 0.416523 | 0.092678 |
| SyS398 | 1793 | GCCCAAGGGACTACTAGTTCGATGGCTGCACAG | 6382 | AQGTTSSMAAQ | 10971 | GTTSSMA | 0.416405 | 0.279218 |
| GS199 | 1794 | GCCCAAGGCAGCGGCGCCAAGCCGCACAG | 6383 | AQGSAASQAAQ | 10972 | GSAASQA | 0.416298 | -0.04868 |
| SyS399 | 1795 | GCCCAAGCCCACAGCAACATCGACAGCGCACAG | 6384 | AQAHSNIDSAQ | 10973 | AHSNIDS | 0.416158 | 0.134486 |
| SyS400 | 1796 | GCCCAAGGCAGCGCCAGCAGCCTCCTCGCACAG | 6385 | AQGSASSLLAQ | 10974 | GSASSLL | 0.41564 | -0.02039 |
| SyS401 | 1797 | GCCCAATTGAGTCCTAATTCTAGTTTTGCACAG | 6386 | AQLSPNSSFAQ | 10975 | LSPNSSF | 0.415615 | 0.029121 |
| SyS402 | 1798 | GCCCAAGGGCATTCTGTTACTCCGTCTGCACAG | 6387 | AQGHSVTPSAQ | 10976 | GHSVTPS | 0.415423 | 0.010986 |
| SyS403 | 1799 | GCCCAAAAAGGCGGCAACAGCATCGACGCACAG | 6388 | AQKGGNSIDAQ | 10977 | KGGNSID | 0.415013 | 0.279789 |
| SyS404 | 1800 | GCCCAACTCGGCCCCAGCCCCAGCGCCGCACAG | 6389 | AQLGPSPSAAQ | 10978 | LGPSPSA | 0.41486 | -0.19011 |
| SyS405 | 1801 | GCCCAACAGCTGCCTATGCTTAATGCTGCACAG | 6390 | AQQLPMLNAAQ | 10979 | QLPMLNA | 0.414768 | 0.206951 |

FIG. 33 (Continued)

| | | | | | | | | |
|---|---|---|---|---|---|---|---|---|
| SyS407 | 1802 | GCCCAAGCTACGAATATTCTTACTGCGGCACAG | 6391 | AQATNILTAAQ | 10980 | ATNILTA | 0.413225 | -0.04554 |
| GS201 | 1803 | GCCCAACTCATGCAAAACGGCCAAAAAGCACAG | 6392 | AQLMQNGQKAQ | 10981 | LMQNGQK | 0.413036 | 0.001705 |
| SyS408 | 1804 | GCCCAACATAATAAATGGGCAGGCTTTGGCACAG | 6393 | AQHNNGQALAQ | 10982 | HNNGQAL | 0.412853 | -0.18614 |
| SyS409 | 1805 | GCCCAATCTATTACTCAGACTCTTTCTGCACAG | 6394 | AQSITQTLSAQ | 10983 | SITQTLS | 0.412719 | 0.059774 |
| TS135 | 1806 | GCCCAAGGGAATAGGATTAGTAATACGGCACAG | 6395 | AQGNRISNTAQ | 10984 | GNRISNT | 0.412694 | 0.198634 |
| SyS410 | 1807 | GCCCAAGGTCCTCAGAATGATCCGCCGGCACAG | 6396 | AQGPQNDPPAQ | 10985 | GPQNDPP | 0.41264 | -0.03615 |
| GS202 | 1808 | GCCCAAATCAACGGCATGGGCCCCAACGCACAG | 6397 | AQINGMGPNAQ | 10986 | INGMGPN | 0.412563 | 0.028973 |
| SyS411 | 1809 | GCCCAAACTGGGAATGCGCATCCTAATGCACAG | 6398 | AQTGNAHPNAQ | 10987 | TGNAHPN | 0.412504 | -0.09192 |
| SyS412 | 1810 | GCCCAAGCTGTGAATCTGAATAATGCACAG | 6399 | AQYAVNLNNAQ | 10988 | YAVNLNN | 0.412504 | -0.15859 |
| GS203 | 1811 | GCCCAAGCGTTGATTTCTAATAGTACGGCACAG | 6400 | AQALISNSTAQ | 10989 | ALISNST | 0.412484 | -0.03295 |
| SyS413 | 1812 | GCCCAATCTCATGTTTCTACTACTATGGCACAG | 6401 | AQSHVSTTMAQ | 10990 | SHVSTTM | 0.412469 | 0.018515 |
| SyS414 | 1813 | GCCCAACTGGATGATTTGTGAGGCCGGCACAG | 6402 | AQLDDFVRPAQ | 10991 | LDDFVRP | 0.41244 | -0.19203 |
| GS204 | 1814 | GCCCAAAATAATACTGCGCGGGTCTGTTGCACAG | 6403 | AQNNTARSVAQ | 10992 | NNTARSV | 0.412149 | -0.09946 |
| SyS415 | 1815 | GCCCAAAACAAATACCCCCAACCAGCGCACAG | 6404 | AQNKYPQPSAQ | 10993 | NKYPQPS | 0.412005 | -0.11816 |
| SyS416 | 1816 | GCCCAATATGCGTCGGAGTTGTTTGTTGCACAG | 6405 | AQYASELFVAQ | 10994 | YASELFV | 0.411713 | -0.19254 |
| GS205 | 1817 | GCCCAATTCTACACCGCCAACGCCAGCGCACAG | 6406 | AQFYTANASAQ | 10995 | FYTANAS | 0.411179 | -0.07392 |
| GP83 | 1818 | GCCCAATTTACGAAGTGAATGCGGACTGCACAG | 6407 | AQFTKSNATAQ | 10996 | FTKSNAT | 0.411133 | -0.07308 |
| SyS417 | 1819 | GCCCAACTCGCCGTCAGCCAAATGAGAGCACAG | 6408 | AQLAVSQMRAQ | 10997 | LAVSQMR | 0.411001 | -0.03857 |
| SyS418 | 1820 | GCCCAAAGGAATGGTCAGCTGATTGTGGCACAG | 6409 | AQRNGQLIVAQ | 10998 | RNGQLIV | 0.410978 | 0.234351 |
| SyS419 | 1821 | GCCCAAGACACCGCCAACACGGCCAGAGCACAG | 6410 | AQDTANTARAQ | 10999 | DTANTAR | 0.410859 | 0.147093 |
| GS207 | 1822 | GCCCAAAAACCCACCGAAGTCCAACACGCACAG | 6411 | AQKPTEVQHAQ | 11000 | KPTEVQH | 0.410623 | -0.02471 |
| SyS420 | 1823 | GCCCAACTTACTAATGCGGGCGACTTATGCACAG | 6412 | AQLTNAATYAQ | 11001 | LTNAATY | 0.410298 | 0.266975 |
| SyS421 | 1824 | GCCCAAATCAGCAACGTCCAAGCCAACGCACAG | 6413 | AQISNVQANAQ | 11002 | ISNVQAN | 0.410249 | 0.422795 |
| SyS422 | 1825 | GCCCAAGAGAGTCGTAATAATGGGTTTGCACAG | 6414 | AQESRNNGFAQ | 11003 | ESRNNGF | 0.410147 | -0.09761 |
| SyS423 | 1826 | GCCCAAAGCACCGGCCCCACCATGCACGCACAG | 6415 | AQSTGPTMHAQ | 11004 | STGPTMH | 0.409836 | 0.093513 |
| SyS424 | 1827 | GCCCAAACGCCTGGTGAGTCGCATAAAGGCACAG | 6416 | AQTPGESHKAQ | 11005 | TPGESHK | 0.409786 | -0.15011 |
| GS208 | 1828 | GCCCAAAGCGTCAGCATCGCCAGCAGCGCACAG | 6417 | AQSVSIASSAQ | 11006 | SVSIASS | 0.409517 | -0.03488 |
| SyS425 | 1829 | GCCCAAAATGGTGTTACGCAGTCTAAGGCACAG | 6418 | AQNGVTQSKAQ | 11007 | NGVTQSK | 0.409482 | -0.08464 |
| GS209 | 1830 | GCCCAAGCTAAGAATACGTATGCTTCTGCACAG | 6419 | AQAKNTYASAQ | 11008 | AKNTYAS | 0.409391 | -0.06675 |
| SyS426 | 1831 | GCCCAAGGTACTTCGGATGGTCATAGGGCACAG | 6420 | AQGTSDGHRAQ | 11009 | GTSDGHR | 0.408706 | -0.00891 |
| SP33 | 1832 | GCCCAATGGTCTCAGAATAAGGGGTATGCACAG | 6421 | AQWSQNKGYAQ | 11010 | WSQNKGY | 0.408567 | -0.04954 |
| SyS427 | 1833 | GCCCAAGGTCAGTTGGCGCGGGTCTGTTGCACAG | 6422 | AQGQLARSVAQ | 11011 | GQLARSV | 0.408524 | -0.00072 |

FIG. 33 (Continued)

| | | | | | | | | |
|---|---|---|---|---|---|---|---|---|
| GS210 | 1834 | GCCCAAATCGGCGGCGGCGGCCCAAAAAGCACAG | 6423 | AQIGGGAQKAQ | 11012 | IGGGAQK | 0.408472 | 0.032961 |
| GS211 | 1835 | GCCCAAGCGCGGCAACGCCAGCCACACGCACAG | 6424 | AQAGNASHTAQ | 11013 | AGNASHT | 0.408162 | -0.12162 |
| SyS428 | 1836 | GCCCAATTCAACCAAGTCGGCAAAATGGCACAG | 6425 | AQFNQVGKMAQ | 11014 | FNQVGKM | 0.407791 | 0.16513 |
| SyS429 | 1837 | GCCCAAACGAGGGATACTCTGTATAAGGCACAG | 6426 | AQTRDTLYKAQ | 11015 | TRDTLYK | 0.407466 | -0.16866 |
| SyS430 | 1838 | GCCCAAAACGGCAGCCCCAGCTACAACGCACAG | 6427 | AQNGSPSYNAQ | 11016 | NGSPSYN | 0.407246 | -0.15253 |
| SyS431 | 1839 | GCCCAATTGGCTGAGGCGCATGCTCGTGCACAG | 6428 | AQLAEAHARAQ | 11017 | LAEAHAR | 0.407096 | -0.17435 |
| SyS432 | 1840 | GCCCAACCTATGTCTAATTCGGAGCGTGCACAG | 6429 | AQPMSNSERAQ | 11018 | PMSNSER | 0.407062 | 0.211218 |
| SyS434 | 1841 | GCCCAACACGTCACCAGCCTCAACGACGCACAG | 6430 | AQHVTSLNDAQ | 11019 | HVTSLND | 0.406789 | 0.247538 |
| GS212 | 1842 | GCCCAAGGGGCTCCGCATGTTTCGAGGGCACAG | 6431 | AQGAPHVSRAQ | 11020 | GAPHVSR | 0.406617 | -0.07068 |
| SyS435 | 1843 | GCCCAAAATACTAATGGGAATAGTGCGGCACAG | 6432 | AQNTNGNSAAQ | 11021 | NTNGNSA | 0.405996 | 0.106612 |
| SyS436 | 1844 | GCCCAAAACGAACTCACCGGCATGCTCGCACAG | 6433 | AQNELTGMLAQ | 11022 | NELTGML | 0.405204 | -0.12222 |
| SyS437 | 1845 | GCCCAAAGTTCTCTTTTGCCTGCTGCTGCACAG | 6434 | AQSSLLPAAAQ | 11023 | SSLLPAA | 0.404837 | -0.11667 |
| SyS438 | 1846 | GCCCAACCGGTTGGTCAGTCGTTGACTGCACAG | 6435 | AQPVGQSLTAQ | 11024 | PVGQSLT | 0.404833 | -0.00463 |
| SyS439 | 1847 | GCCCAATTGACTGCTGCGAAGGGTCTTGCACAG | 6436 | AQLTAAKGLAQ | 11025 | LTAAKGL | 0.404775 | -0.07979 |
| GP85 | 1848 | GCCCAACTGATTGGGCGGCTGACTTCTGCACAG | 6437 | AQLIGRLTSAQ | 11026 | LIGRLTS | 0.404569 | -0.07322 |
| GP86 | 1849 | GCCCAAGCTAAGCATAATGATAATATTGCACAG | 6438 | AQAKHNDNIAQ | 11027 | AKHNDNI | 0.404338 | 0.076246 |
| SyS440 | 1850 | GCCCAATTGCGTAGTGGTGATGAGATGGCACAG | 6439 | AQLRSGDEMAQ | 11028 | LRSGDEM | 0.404093 | -0.0112 |
| SyS441 | 1851 | GCCCAACCCAAAACAGCACCACCGCCGCACAG | 6440 | AQPQNSTTAAQ | 11029 | PQNSTTA | 0.404089 | -0.04125 |
| GS213 | 1852 | GCCCAACTGGCTACTGGGCCTCTTTTGCACAG | 6441 | AQLATGPLFAQ | 11030 | LATGPLF | 0.403608 | -0.16394 |
| SyS442 | 1853 | GCCCAAGCGTCTGCTGTGAGTCAGAAGGCACAG | 6442 | AQASAVSQKAQ | 11031 | ASAVSQK | 0.403527 | 0.110544 |
| SyS443 | 1854 | GCCCAAGCGCCTGTTAGTTCTGCGTTGGCACAG | 6443 | AQAPVSSALAQ | 11032 | APVSSAL | 0.40338 | -0.15617 |
| SyS444 | 1855 | GCCCAAACGATGCCGAGTCTGGATAGTGCACAG | 6444 | AQTMPSLDSAQ | 11033 | TMPSLDS | 0.403287 | -0.20951 |
| GS215 | 1856 | GCCCAACATATGAATTTTCCGAATCCGGCACAG | 6445 | AQHMNFPNPAQ | 11034 | HMNFPNP | 0.403183 | -0.14779 |
| SP34 | 1857 | GCCCAAGCGTCTGCGAGGATGGATGCGGGCACAG | 6446 | AQASARMDAAQ | 11035 | ASARMDA | 0.402718 | -0.05379 |
| SyS445 | 1858 | GCCCAAACCGTCATCGTCGGCGGCAGAGCACAG | 6447 | AQTVIVGGRAQ | 11036 | TVIVGGR | 0.402646 | -0.15534 |
| GS216 | 1859 | GCCCAAAGTAGTCAGAGTCAGACTGTTGCACAG | 6448 | AQSSQSQTVAQ | 11037 | SSQSQTV | 0.40259 | -0.00826 |
| SyS446 | 1860 | GCCCAAATCAACACCACCAGCCAAAAAGCACAG | 6449 | AQINTTSQKAQ | 11038 | INTTSQK | 0.402505 | 0.195122 |
| SyS447 | 1861 | GCCCAAGCTGGGGCGCGGTGTTACGGAGGCACAG | 6450 | AQAGARVTEAQ | 11039 | AGARVTE | 0.402225 | 0.012345 |
| GS217 | 1862 | GCCCAACCCGCCCCCCACAGCGGCAGCGCACAG | 6451 | AQPAPHSGSAQ | 11040 | PAPHSGS | 0.402189 | -0.18099 |
| SyS448 | 1863 | GCCCAACTCAACGTCATGTACAACCCCGCACAG | 6452 | AQLNVMYNPAQ | 11041 | LNVMYNP | 0.402132 | -0.11495 |
| GS218 | 1864 | GCCCAAGGGCATGCTCAGACTCTTTATGCACAG | 6453 | AQGHAQTLYAQ | 11042 | GHAQTLY | 0.402085 | -0.07242 |
| GS219 | 1865 | GCCCAAACTCCTAATCTGTCTACTCATGCACAG | 6454 | AQTPNLSTHAQ | 11043 | TPNLSTH | 0.401391 | -0.11638 |

FIG. 33 (Continued)

| | | | | | | | | |
|---|---|---|---|---|---|---|---|---|
| SyS449 | 1866 | GCCCAAAGCGGCCGAAAGAACCAAGTCGCACAG | 6455 | AQSAERTNVAQ | 11044 | SAERTNV | 0.40125 | 0.211168 |
| TS136 | 1867 | GCCCAAAACAACCTCAGACCCGTCTACGCACAG | 6456 | AQNNLRPVYAQ | 11045 | NNLRPVY | 0.401221 | -0.16565 |
| SyS450 | 1868 | GCCCAAAATCAGCAGTCTGCTTATACGGCACAG | 6457 | AQNQQSAYTAQ | 11046 | NQQSAYT | 0.400966 | 0.20764 |
| SyS451 | 1869 | GCCCAAGTCGTCGACGGCAAAACCCAAGCACAG | 6458 | AQVVDGKTQAQ | 11047 | VVDGKTQ | 0.400944 | 0.002558 |
| SyS452 | 1870 | GCCCAACCCCTCCCCAACAACTCGACGCACAG | 6459 | AQPLPQQLDAQ | 11048 | PLPQQLD | 0.40087 | -0.04961 |
| SyS453 | 1871 | GCCCAAGTCGCGAAATCGTCCAACTCGCACAG | 6460 | AQVAEIVQLAQ | 11049 | VAEIVQL | 0.400846 | -0.19011 |
| SS41 | 1872 | GCCCAAGACAGAAACACCACCGTCAGAGCACAG | 6461 | AQDRNTTVRAQ | 11050 | DRNTTVR | 0.40065 | -0.05681 |
| SyS454 | 1873 | GCCCAAAATATGATGAAGACGGGGATGGCACAG | 6462 | AQNMMKTGMAQ | 11051 | NMMKTGM | 0.400506 | 0.125092 |
| SyS455 | 1874 | GCCCAAGTCCAATTCAACACCAGCAAAGCACAG | 6463 | AQVQFNTSKAQ | 11052 | VQFNTSK | 0.400373 | 0.028343 |
| SyS456 | 1875 | GCCCAACCTGGGAATGCTAGTATTCGTGCACAG | 6464 | AQPGNASIRAQ | 11053 | PGNASIR | 0.400324 | -0.16951 |
| SyS457 | 1876 | GCCCAACTCGGCGGCATCCTCAGCGCCGCACAG | 6465 | AQLGGILSAAQ | 11054 | LGGILSA | 0.400238 | -0.08048 |
| SyS458 | 1877 | GCCCAACAGACGGATCATTCGCATCTTGCACAG | 6466 | AQQTDHSHLAQ | 11055 | QTDHSHL | 0.400082 | -0.00343 |
| SyS459 | 1878 | GCCCAAAACGCTGCATGCTGAGTTTAGTGCACAG | 6467 | AQTLHAEFSAQ | 11056 | TLHAEFS | 0.399977 | -0.08783 |
| GP87 | 1879 | GCCCAACTGTCGGATCGTCTGAATGCGGCACAG | 6468 | AQLSDRLNAAQ | 11057 | LSDRLNA | 0.399921 | 0.343918 |
| GS222 | 1880 | GCCCAACTGAATGAGCGTATTGGTGGGGCACAG | 6469 | AQLNERIGGAQ | 11058 | LNERIGG | 0.399725 | 0.141871 |
| SyS460 | 1881 | GCCCAAACTTTGAATTCGACGGCGTCGGCACAG | 6470 | AQTLNSTASAQ | 11059 | TLNSTAS | 0.399702 | -0.02669 |
| GS223 | 1882 | GCCCAATCTGGGCGGGTTGTTGCGCAGGCACAG | 6471 | AQSGRVVAQAQ | 11060 | SGRVVAQ | 0.399629 | -0.09114 |
| TS137 | 1883 | GCCCAAAATAATCGTACGACTAATAATGCACAG | 6472 | AQNNRTTNNAQ | 11061 | NNRTTNN | 0.399086 | 0.311194 |
| SS42 | 1884 | GCCCAAAACGTCCCCAGCAGCACCTACGCACAG | 6473 | AQNVPSSTYAQ | 11062 | NVPSSTY | 0.39867 | -0.28456 |
| SyS461 | 1885 | GCCCAAGTCCCCAGCACCGCCCTCAAAGCACAG | 6474 | AQVPSTALKAQ | 11063 | VPSTALK | 0.3985 | 0.103803 |
| SyS462 | 1886 | GCCCAACCTCCTAATACTCAGAGTCTGGCACAG | 6475 | AQPPNTQSLAQ | 11064 | PPNTQSL | 0.398398 | -0.08905 |
| TS138 | 1887 | GCCCAAACGAATACGACGCGGGCGATGGCACAG | 6476 | AQTNTTRAMAQ | 11065 | TNTTRAM | 0.397943 | 0.551742 |
| TS139 | 1888 | GCCCAAAGCAACAGAACCGTCAGAGAAGCACAG | 6477 | AQSNRTVREAQ | 11066 | SNRTVRE | 0.397876 | 0.454359 |
| SyS463 | 1889 | GCCCAAGCTTCGACTCAGATTATGAGGGCACAG | 6478 | AQASTQIMRAQ | 11067 | ASTQIMR | 0.397639 | -0.12339 |
| SyS464 | 1890 | GCCCAAACGGTGATTAGTTCTAGTCGTGTGCACAG | 6479 | AQTVISSSRAQ | 11068 | TVISSSR | 0.397266 | -0.01675 |
| GS226 | 1891 | GCCCAAGTCTACAGCCCCAAGGCACCGCACAG | 6480 | AQVYSPQGTAQ | 11069 | VYSPQGT | 0.397151 | 0.052156 |
| SyS465 | 1892 | GCCCAAGGCAGCGCCCCACCCAAAGCATGGCACAG | 6481 | AQGSPTQSMAQ | 11070 | GSPTQSM | 0.396853 | 0.092045 |
| SyS466 | 1893 | GCCCAAGCGGTGTCGTGCGGAGGCTCGTGCACAG | 6482 | AQAVSSEARAQ | 11071 | AVSSEAR | 0.396674 | -0.15767 |
| SyS467 | 1894 | GCCCAAGGTTCGGTTGCGACTCTTACTGCACAG | 6483 | AQGSVATLTAQ | 11072 | GSVATLT | 0.396673 | 0.012454 |
| SyS468 | 1895 | GCCCAAAGCGCCAAACACCGGCACCGGCGCACAG | 6484 | AQSANTGTGAQ | 11073 | SANTGTG | 0.396431 | -0.10276 |
| SyS469 | 1896 | GCCCAAATTGTTCAGGGGACTAGTATGGCACAG | 6485 | AQIVQGTSMAQ | 11074 | IVQGTSM | 0.39631 | 0.142036 |
| GS227 | 1897 | GCCCAAACTCCTTCGCTTGGTGTTCTTGCACAG | 6486 | AQTPSLGVLAQ | 11075 | TPSLGVL | 0.395938 | -0.05178 |

FIG. 33 (Continued)

| | | | | | | | | |
|---|---|---|---|---|---|---|---|---|
| SyS470 | 1898 | GCCCAACCCAACACATGATGGGCAGCAGCGCACAG | 6487 | AQPNMMGSSAQ | 11076 | PNMMGSS | 0.395744 | -0.10497 |
| GS228 | 1899 | GCCCAACTCACCCAAAGCCCGCCCCGCGCACAG | 6488 | AQLTQSPAPAQ | 11077 | LTQSPAP | 0.395705 | -0.03746 |
| GS229 | 1900 | GCCCAAAAGGCAGCAACAGCACCCTCGCACAG | 6489 | AQKGSNSTLAQ | 11078 | KGSNSTL | 0.395617 | 0.158094 |
| SyS471 | 1901 | GCCCAACCCATGGCGCGCGCCCCAGAGCACAG | 6490 | AQPMAAAPRAQ | 11079 | PMAAAPR | 0.394928 | -0.11822 |
| GS230 | 1902 | GCCCAAGTTACGACGGGTCCGAGTCGTGCACAG | 6491 | AQVTTGPSRAQ | 11080 | VTTGPSR | 0.39486 | -0.05507 |
| GS231 | 1903 | GCCCAAGTCGTCAGCCCCCTCAGCTACGCACAG | 6492 | AQVVSPLSYAQ | 11081 | VVSPLSY | 0.394822 | -0.12073 |
| SyS472 | 1904 | GCCCAAGTGACGGGGTTCTGTGCAGAAGGCACAG | 6493 | AQVTGSVQKAQ | 11082 | VTGSVQK | 0.394696 | -0.04095 |
| GS232 | 1905 | GCCCAAGGCGGGCACCACCGTCCAAACCGCACAG | 6494 | AQGGTTVQTAQ | 11083 | GGTTVQT | 0.39469 | -0.06883 |
| SyS473 | 1906 | GCCCAAAACAGCGCCCAAATCAACATGGCACAG | 6495 | AQNSAQINMAQ | 11084 | NSAQINM | 0.394642 | 0.174839 |
| GS234 | 1907 | GCCCAACCCGGCACCCAAAAACCCACCGCACAG | 6496 | AQPGTQKPTAQ | 11085 | PGTQKPT | 0.394239 | -0.04567 |
| GP88 | 1908 | GCCCAAGGGAAGGCTAGTCATTATCCTGCACAG | 6497 | AQGKASHYPAQ | 11086 | GKASHYP | 0.394204 | -0.07412 |
| GP89 | 1909 | GCCCAATATAATAGTGTTCCGTCGGCGGCACAG | 6498 | AQYNSVPSAAQ | 11087 | YNSVPSA | 0.393949 | 0.00863 |
| SyS474 | 1910 | GCCCAAGTTTATGAGCGGGTTTCTCATGCACAG | 6499 | AQVYERVSHAQ | 11088 | VYERVSH | 0.393656 | 0.020329 |
| SyS475 | 1911 | GCCCAAGATGTGAATAATAGGTCTATGGCACAG | 6500 | AQDVNNRSMAQ | 11089 | DVNNRSM | 0.393538 | -0.20588 |
| GS235 | 1912 | GCCCAACCTCATGCGGTTTCTATGCTTGCACAG | 6501 | AQPHAVSMLAQ | 11090 | PHAVSML | 0.392826 | -0.1747 |
| GP90 | 1913 | GCCCAAGGGATGCCTGCTCCTCTTGGTGCACAG | 6502 | AQGMPAPLGAQ | 11091 | GMPAPLG | 0.392659 | -0.07169 |
| SyS476 | 1914 | GCCCAACAGCTTCAGATTAATCGGCTGCACAG | 6503 | AQQLQINPAAQ | 11092 | QLQINPA | 0.392185 | -0.12586 |
| SyS477 | 1915 | GCCCAAACTATGGATCTGTCGCCGCGGCACAG | 6504 | AQTMDLSPPAQ | 11093 | TMDLSPP | 0.392185 | -0.12586 |
| SyS478 | 1916 | GCCCAAACCACCGACCTCCACGCCAAAGCACAG | 6505 | AQTTDLHAKAQ | 11094 | TTDLHAK | 0.392056 | -0.00463 |
| GS236 | 1917 | GCCCAACACCACCACCAAACCACCGCACAG | 6506 | AQHHTTQTTAQ | 11095 | HHTTQTT | 0.39199 | -0.07609 |
| SyS479 | 1918 | GCCCAACCGAGTTCTAATTCTACTAATGCACAG | 6507 | AQPSSNSTNAQ | 11096 | PSSNSTN | 0.391964 | -0.12824 |
| SyS480 | 1919 | GCCCAAACCAGATACAACGTGCGACCCCGCACAG | 6508 | AQTRYNVDPAQ | 11097 | TRYNVDP | 0.391808 | 0.095996 |
| SyS481 | 1920 | GCCCAAAGCGTCGTCAGCCTCAGCCCCGCACAG | 6509 | AQSVVSLSPAQ | 11098 | SVVSLSP | 0.391603 | 0.006038 |
| SyS482 | 1921 | GCCCAAGAAAAAGTCGACCAACTCAGAGCACAG | 6510 | AQEKVDQLRAQ | 11099 | EKVDQLR | 0.391412 | -0.13677 |
| SyS483 | 1922 | GCCCAAAGCGACAGCAGACGACAAACCCTCGCACAG | 6511 | AQSDSRQTLAQ | 11100 | SDSRQTL | 0.391412 | -0.13677 |
| SyS484 | 1923 | GCCCAAACTTATCCTGCTACGAGTGATGCACAG | 6512 | AQTYPATSDAQ | 11101 | TYPATSD | 0.391335 | 0.284964 |
| GS237 | 1924 | GCCCAAAGCATGAACGTCGGCAGCGCCGCACAG | 6513 | AQSMNVGSAAQ | 11102 | SMNVGSA | 0.391048 | -0.05003 |
| GS238 | 1925 | GCCCAACTTGAGTCTAGTAATGCTATTGCACAG | 6514 | AQLESSNAIAQ | 11103 | LESSNAI | 0.3905 | -0.13061 |
| GP91 | 1926 | GCCCAATCTCCGACGAATCATCATGCTGCACAG | 6515 | AQSPTNHAPAQ | 11104 | SPTNHAP | 0.389815 | 0.121844 |
| SyS486 | 1927 | GCCCAAGCGCATGAGGGGATGGTTAAGGCACAG | 6516 | AQAHEGMVKAQ | 11105 | AHEGMVK | 0.389656 | 0.111097 |
| SyS487 | 1928 | GCCCAAGTTGATACTTTGTTGTCGAAGGCACAG | 6517 | AQVDTLLSKAQ | 11106 | VDTLLSK | 0.389333 | -0.13837 |
| GS240 | 1929 | GCCCAAACCGCGGGCCAACTCACCTGGGCACAG | 6518 | AQTAGQLTWAQ | 11107 | TAGQLTW | 0.38913 | -0.16432 |

FIG. 33 (Continued)

| | | | | | | | |
|---|---|---|---|---|---|---|---|
| SyS488 | 1930 | GCCCAAATGGGCATGGACGGCCAAATCGCACAG | 6519 | AQMGMDGQIAQ | 11108 | MGMDGQI | 0.38907 | -0.16766 |
| SyS489 | 1931 | GCCCAAGAGAGCTGGGAGAATGGTCGTGTGCACAG | 6520 | AQELENGRRAQ | 11109 | ELENGRR | 0.38896 | -0.14888 |
| GS241 | 1932 | GCCCAACTCGACCTCAGCGTCAGCAGAGCACAG | 6521 | AQLDLSVSRAQ | 11110 | LDLSVSR | 0.388881 | -0.12807 |
| SyS490 | 1933 | GCCCAATCTCAGCATCCGAATATGACGGCACAG | 6522 | AQSQHPNMTAQ | 11111 | SQHPNMT | 0.388765 | 0.328765 |
| SyS491 | 1934 | GCCCAATATCATGAGGTGTCGGAGCATGCACAG | 6523 | AQYHEVSEHAQ | 11112 | YHEVSEH | 0.388683 | -0.07979 |
| GS242 | 1935 | GCCCAAATGCGGTCGCCGCCTCCTACGGCACAG | 6524 | AQMRSPPPTAQ | 11113 | MRSPPPT | 0.388551 | -0.14906 |
| GS243 | 1936 | GCCCAAGGTAGTGGTAGTTCGACGATTGCACAG | 6525 | AQGSGSSTIAQ | 11114 | GSGSSTI | 0.388493 | -0.05911 |
| SyS492 | 1937 | GCCCAAGGTGGTGATGCTGGGAGGTGGGCACAG | 6526 | AQGGDAGRWAQ | 11115 | GGDAGRW | 0.388134 | -0.0507 |
| SyS493 | 1938 | GCCCAAAAGGCTGAGGCGATGGTTATTGCACAG | 6527 | AQKAEAMVIAQ | 11116 | KAEAMVI | 0.387828 | -0.0246 |
| SyS494 | 1939 | GCCCAAGCCAACAAAGACCTCGGCGTCGCACAG | 6528 | AQANKDLGVAQ | 11117 | ANKDLGV | 0.387437 | 0.102738 |
| GS244 | 1940 | GCCCAAACGTCGTCGGAGAATAGGACTGCACAG | 6529 | AQTSSENRTAQ | 11118 | TSSENRT | 0.387311 | -0.10606 |
| SyS495 | 1941 | GCCCAAGGCCCGACAGAAACCGCCGCCGCACAG | 6530 | AQGPDRTAAAQ | 11119 | GPDRTAA | 0.387298 | -0.02676 |
| SyS496 | 1942 | GCCCAAGGCAGCACCGTCGTCCACCTCGCACAG | 6531 | AQGSTVVHLAQ | 11120 | GSTVVHL | 0.386932 | 0.060317 |
| SyS497 | 1943 | GCCCAAACTGCGGTGGTGGTGCCTCAGGCACAG | 6532 | AQTAVVVPQAQ | 11121 | TAVVVPQ | 0.386787 | 0.055989 |
| SyS498 | 1944 | GCCCAAGCGGTTAATATTGCTAATGCGGCACAG | 6533 | AQAVNIANAAQ | 11122 | AVNIANA | 0.386669 | -0.05398 |
| SyS499 | 1945 | GCCCAATTGCTGTCTCAGAGTGGGGTGGCACAG | 6534 | AQLLSQSGVAQ | 11123 | LLSQSGV | 0.386652 | -0.15808 |
| SyS500 | 1946 | GCCCAACACACCGGCGAAGGCAAACTCGCACAG | 6535 | AQHTGEGKLAQ | 11124 | HTGEGKL | 0.386636 | 0.213701 |
| SyS501 | 1947 | GCCCAAAGCAACGGCAACAACATCAGAGCACAG | 6536 | AQSNGNNIRAQ | 11125 | SNGNNIR | 0.386253 | 0.22344 |
| GS245 | 1948 | GCCCAAGAAGTCACCCTCATGCACAAAGCACAG | 6537 | AQEVTLMHKAQ | 11126 | EVTLMHK | 0.386174 | -0.15766 |
| GP92 | 1949 | GCCCAACTTACTACTACGGGGAGTAATGCACAG | 6538 | AQLTTTGSNAQ | 11127 | LTTTGSN | 0.385682 | 0.152692 |
| GS247 | 1950 | GCCCAAGACATCAGCGGCAAAATCGCGGCACAG | 6539 | AQDISGKIAAQ | 11128 | DISGKIA | 0.385274 | -0.05387 |
| GS249 | 1951 | GCCCAAATTTCGCCGAATGTTTATAGTGCACAG | 6540 | AQISPNVYSAQ | 11129 | ISPNVYS | 0.384876 | 0.050202 |
| GS250 | 1952 | GCCCAATATAATAAGCTTGTTGATGGTGCACAG | 6541 | AQYNKLVDGAQ | 11130 | YNKLVDG | 0.38484 | -0.16146 |
| GS251 | 1953 | GCCCAATTTCATACGCATCCTACGAGTGCACAG | 6542 | AQFHTHPTSAQ | 11131 | FHTHPTS | 0.384812 | -0.07443 |
| GP93 | 1954 | GCCCAACCTACTCTGGAGGCTACGAGTGCACAG | 6543 | AQPTLEATSAQ | 11132 | PTLEATS | 0.384801 | 0.117964 |
| SyS503 | 1955 | GCCCAAGAACTCGGCAGAAACGGCCCCGCACAG | 6544 | AQELGRNGPAQ | 11133 | ELGRNGP | 0.38437 | 0.084485 |
| SyS504 | 1956 | GCCCAAGTCGACAAAGTCGAAAGACTCGCACAG | 6545 | AQVDKVERLAQ | 11134 | VDKVERL | 0.384245 | -0.07403 |
| SyS505 | 1957 | GCCCAAACCACCACCATGACCCCAGAGCACAG | 6546 | AQTTTMTPRAQ | 11135 | TTTMTPR | 0.384195 | 0.082987 |
| SyS506 | 1958 | GCCCAACTCCAACAAATCCCCACCCCGCACAG | 6547 | AQLQQIPTPAQ | 11136 | LQQIPTP | 0.384174 | -0.14405 |
| SyS507 | 1959 | GCCCAAACGACAGACAGCAACAGCCTCCAAGCACAG | 6548 | AQTDSNSLQAQ | 11137 | TDSNSLQ | 0.384026 | -0.11495 |
| GS252 | 1960 | GCCCAAGACGACAGAGAGCGTCAGATTCGCACAG | 6549 | AQDDRSVRFAQ | 11138 | DDRSVRF | 0.384013 | -0.08841 |
| GS253 | 1961 | GCCCAACTTGCTACTCAGAATGCTTCGGCACAG | 6550 | AQLATQNASAQ | 11139 | LATQNAS | 0.383747 | -0.11907 |

FIG. 33 (Continued)

| | | | | | | | | |
|---|---|---|---|---|---|---|---|---|
| GS254 | 1962 | GCCCAAGTCGGCACCCACATCCACAGCGCACAG | 6551 | AQVGTHIHSAQ | 11140 | VGTHIHS | 0.383741 | -0.07376 |
| SyS508 | 1963 | GCCCAAGGCGAAAGAAGCAGCAGCGTCAAAGCACAG | 6552 | AQSERSSVKAQ | 11141 | SERSSVK | 0.38368 | -0.04815 |
| GS255 | 1964 | GCCCAAGGCTACGCCCACAGCATGATCGCACAG | 6553 | AQGYAHSMIAQ | 11142 | GYAHSMI | 0.383633 | -0.16718 |
| GS256 | 1965 | GCCCAACCGTTGAGTGGGGGTGTTCGTGCACAG | 6554 | AQPLSGGVRAQ | 11143 | PLSGGVR | 0.383535 | -0.18245 |
| GS257 | 1966 | GCCCAACTCACCTACGTCGCCAGCAGCGCACAG | 6555 | AQLTYVASSAQ | 11144 | LTYVASS | 0.383535 | -0.18245 |
| GS258 | 1967 | GCCCAAGTCGACAAAACCCTCAGCAGAGCACAG | 6556 | AQVDKTLSRAQ | 11145 | VDKTLSR | 0.383399 | 0.00026 |
| SyS509 | 1968 | GCCCAACCAACCTCGTCGGCGTCCCGCACAG | 6557 | AQPNLVGVPAQ | 11146 | PNLVGVP | 0.383392 | -0.17259 |
| SS45 | 1969 | GCCCAAACCAAAATCGACACCGTCAGAGCACAG | 6558 | AQTKIDTVRAQ | 11147 | TKIDTVR | 0.383311 | -0.33355 |
| SyS510 | 1970 | GCCCAAAGCGGCGGCACCCAAGCCAGAGCACAG | 6559 | AQSGGTQARAQ | 11148 | SGGTQAR | 0.383037 | 0.132131 |
| SyS511 | 1971 | GCCCAACATAGTACGCCGCTGGTGTCGGCACAG | 6560 | AQHSTPLVSAQ | 11149 | HSTPLVS | 0.382943 | 0.058414 |
| SyS512 | 1972 | GCCCAACATTCGGGGACGAATCTTCGTGCACAG | 6561 | AQHSGTNLRAQ | 11150 | HSGTNLR | 0.382943 | -0.13556 |
| SyS513 | 1973 | GCCCAAGGCGCAGCCTAGGCTGGTGACTGCACAG | 6562 | AQAQPRLVTAQ | 11151 | AQPRLVT | 0.382943 | -0.13556 |
| SyS514 | 1974 | GCCCAACCTCTTGGTGCGCATGGTTCGGCACAG | 6563 | AQPLGAHGSAQ | 11152 | PLGAHGS | 0.382943 | -0.16466 |
| SyS515 | 1975 | GCCCAAATCAGCGACGCCAGCGTCCTCGCACAG | 6564 | AQISDASVLAQ | 11153 | ISDASVL | 0.382943 | -0.16466 |
| SyS516 | 1976 | GCCCAAATGAGCGTCGGCGTCAAAACCGCACAG | 6565 | AQMSVGVKTAQ | 11154 | MSVGVKT | 0.382941 | 0.297777 |
| GS259 | 1977 | GCCCAAAACATCGCCGAAGGCCTCAGCGCACAG | 6566 | AQNIAEGLSAQ | 11155 | NIAEGLS | 0.382807 | -0.14958 |
| SyS517 | 1978 | GCCCAATCGTCGAATTCTGATGGGATTGCACAG | 6567 | AQSSNSDGIAQ | 11156 | SSNSDGI | 0.382517 | -0.12782 |
| SyS518 | 1979 | GCCCAAGTCGGCCAAACCACCAACAGCGCACAG | 6568 | AQVGQTTNSAQ | 11157 | VGQTTNS | 0.382475 | 0.202682 |
| SyS519 | 1980 | GCCCAAGAGTCGAAGCGGCCCTTTTCTTGCACAG | 6569 | AQESKRPFLAQ | 11158 | ESKRPFL | 0.382336 | -0.02035 |
| SyP37 | 1981 | GCCCAAAGTCAGGAGAATAGTCGTACTGCACAG | 6570 | AQSQENSRTAQ | 11159 | SQENSRT | 0.382175 | -0.03831 |
| SyS520 | 1982 | GCCCAAAATACTGGGACTGATCATCCGGCACAG | 6571 | AQNTGTDHPAQ | 11160 | NTGTDHP | 0.382096 | 0.093385 |
| TS140 | 1983 | GCCCAAGGGAATTGGGTTAAGGATATTGCACAG | 6572 | AQGNWVKDIAQ | 11161 | GNWVKDI | 0.382083 | 0.231014 |
| SyS521 | 1984 | GCCCAAAGACTCACCGAAACCGTCACGCACAG | 6573 | AQRLTETVTAQ | 11162 | RLTETVT | 0.381934 | -0.02213 |
| SyS522 | 1985 | GCCCAAGGCGAAATCGGGCGTCCTCTACGCACAG | 6574 | AQGEIGVLYAQ | 11163 | GEIGVLY | 0.381809 | -0.12707 |
| SyS523 | 1986 | GCCCAACTGGCTCCGGAGCCGCTTAAGGCACAG | 6575 | AQLAPEPLKAQ | 11164 | LAPEPLK | 0.38143 | -0.18527 |
| SyS524 | 1987 | GCCCAAAACAAACTCCCCGCCCTGGCACAG | 6576 | AQNKLPPALAQ | 11165 | NKLPPAL | 0.381262 | 0.008029 |
| SyS525 | 1988 | GCCCAAAATATTGGGACTCGGGATGCGGCACAG | 6577 | AQNIGTRDAAQ | 11166 | NIGTRDA | 0.38124 | -0.20466 |
| GS262 | 1989 | GCCCAAACCGTCAGAGAACTCCAACCGCACAG | 6578 | AQTVRELQPAQ | 11167 | TVRELQP | 0.380962 | -0.03275 |
| SyS526 | 1990 | GCCCAAGAGAATCATGGTACGACTAGTGCACAG | 6579 | AQENHGTTSAQ | 11168 | ENHGTTS | 0.380821 | 0.0704 |
| GS263 | 1991 | GCCCAACAACACGACAGAAACTACGTCGCACAG | 6580 | AQHTDRNYVAQ | 11169 | HTDRNYV | 0.380666 | -0.06073 |
| SyS528 | 1992 | GCCCAAACTGTTGGTCCGACGTCTCATGCACAG | 6581 | AQTVGPTSHAQ | 11170 | TVGPTSH | 0.380499 | 0.283908 |
| SyS529 | 1993 | GCCCAAGGCCTCGTCAAAGACCACCCCGCACAG | 6582 | AQGLVKDHPAQ | 11171 | GLVKDHP | 0.380297 | 0.060613 |

FIG. 33 (Continued)

| | | | | | | | | |
|---|---|---|---|---|---|---|---|---|
| SyS530 | 1994 | GCCCAAATCAACGCCCTCACCAACGGGCACAG | 6583 | AQINALTNGAQ | 11172 | INALTNG | 0.380078 | 0.298241 |
| SyS531 | 1995 | GCCCAACCCTCGACAGCAACAGAGACGCACAG | 6584 | AQPLDSNRDAQ | 11173 | PLDSNRD | 0.380007 | -0.00615 |
| GP94 | 1996 | GCCCAACTTAAGGTGACGAAGAGATTGATGCACAG | 6585 | AQLKVTKIDAQ | 11174 | LKVTKID | 0.379542 | -0.07197 |
| GS264 | 1997 | GCCCAACATAATAGTAATCCTGGGTTGGCACAG | 6586 | AQHNSNPGLAQ | 11175 | HNSNPGL | 0.379381 | -0.02297 |
| GS265 | 1998 | GCCCAAACCACCGTCATCTCAAAACCGCACAG | 6587 | AQTTVILKTAQ | 11176 | TTVILKT | 0.379349 | -0.13952 |
| GS266 | 1999 | GCCCAACTTGGTAAGGGTATGACTGCGGCACAG | 6588 | AQLGKGMTAAQ | 11177 | LGKGMTA | 0.379294 | 0.02198 |
| SyS532 | 2000 | GCCCAATTCAGCATCAGCGACCTCAAAGCACAG | 6589 | AQFSISDLKAQ | 11178 | FSISDLK | 0.379031 | -0.02524 |
| SyS533 | 2001 | GCCCAAAGTACGGATACTCATCTTCCTGCACAG | 6590 | AQSTDTHLPAQ | 11179 | STDTHLP | 0.378372 | -0.01675 |
| TS141 | 2002 | GCCCAATTGAATGCTGTTAAGAATGTTGCACAG | 6591 | AQLNAVKNVAQ | 11180 | LNAVKNV | 0.378181 | 0.632673 |
| GP95 | 2003 | GCCCAACGTTCGACTCCGAATACGATTGCACAG | 6592 | AQRSTPNTIAQ | 11181 | RSTPNTI | 0.377505 | 0.34596 |
| GP96 | 2004 | GCCCAATTGAGTATTAAGTTGCAGAATGCACAG | 6593 | AQLSIKLQNAQ | 11182 | LSIKLQN | 0.377502 | -0.02247 |
| SyS534 | 2005 | GCCCAAAGTCTTGCGATTACTAGTAGTGCACAG | 6594 | AQSLAITSSAQ | 11183 | SLAITSS | 0.37731 | -0.04258 |
| GS270 | 2006 | GCCCAACGGCAGGATATTACTATTGCTGCACAG | 6595 | AQRQDITIAAQ | 11184 | RQDITIA | 0.377132 | -0.06485 |
| GS271 | 2007 | GCCCAAGGTAATGCTACGCCTCGGTCTGCACAG | 6596 | AQGNATPRSAQ | 11185 | GNATPRS | 0.377091 | 0.192946 |
| SyS536 | 2008 | GCCCAAAGCCTCGTCGGCACCACCAGCGCACAG | 6597 | AQSLVGTTSAQ | 11186 | SLVGTTS | 0.376972 | 0.04223 |
| GS272 | 2009 | GCCCAATGGCAGACTCAGGATAAGGAGGCACAG | 6598 | AQWQTQDKEAQ | 11187 | WQTQDKE | 0.376959 | -0.16753 |
| SyS537 | 2010 | GCCCAAACGCCTAATGTGCCGTCTCCGGCACAG | 6599 | AQTPNVPSPAQ | 11188 | TPNVPSP | 0.376726 | -0.06646 |
| SyS539 | 2011 | GCCCAAATTAATACTATTAGTCCGAAGGCACAG | 6600 | AQINTISPKAQ | 11189 | INTISPK | 0.376382 | -0.16102 |
| SyS541 | 2012 | GCCCAACCCCTCGGCACCAGCAACACCGCACAG | 6601 | AQPLGTSNTAQ | 11190 | PLGTSNT | 0.376355 | 0.102187 |
| SyS542 | 2013 | GCCCAAAGCCAAGTCAACGGCGGCAAAGCACAG | 6602 | AQSQVNGGKAQ | 11191 | SQVNGGK | 0.37633 | 0.282579 |
| SyS543 | 2014 | GCCCAACCGATTAATGATAAGGTGATGGCACAG | 6603 | AQPINDKVMAQ | 11192 | PINDKVM | 0.376049 | 0.017194 |
| GS545 | 2015 | GCCCAAAACGTCAGCAGCATCCTCGCACAG | 6604 | AQNVSSSILAQ | 11193 | NVSSSIL | 0.375885 | 0.134279 |
| GS273 | 2016 | GCCCAACAGGCGAATTGGACTGCGTCTGCACAG | 6605 | AQQANWTASAQ | 11194 | QANWTAS | 0.375563 | -0.10129 |
| SyS546 | 2017 | GCCCAAAGACCCGAAAAACCACACAGCAGCGCACAG | 6606 | AQRPENHSSAQ | 11195 | RPENHSS | 0.375415 | 0.065176 |
| GS274 | 2018 | GCCCAAACTAGGAATTTGGATGTTCATGCACAG | 6607 | AQTRNLDVHAQ | 11196 | TRNLDVH | 0.374612 | -0.17829 |
| SyS547 | 2019 | GCCCAAATTAATAGTTCGTTTTCTAAGGCACAG | 6608 | AQINSSFSKAQ | 11197 | INSSFSK | 0.374256 | -0.0095 |
| SyS548 | 2020 | GCCCAATCTATTCAGGGGTCTCAGCGGGCACAG | 6609 | AQSIQGSQRAQ | 11198 | SIQGSQR | 0.374054 | 0.007566 |
| SyS549 | 2021 | GCCCAAGTTGTGGCGGTTGGTCAGTTTGCACAG | 6610 | AQVVAVGQFAQ | 11199 | VVAVGQF | 0.373702 | -0.13556 |
| TS143 | 2022 | GCCCAAGTCAACAAAGTCAGAGACGTCGCACAG | 6611 | AQVNKVRDVAQ | 11200 | VNKVRDV | 0.373538 | -0.18383 |
| SyS550 | 2023 | GCCCAAAAGCCTAATGCTCAGATTCAGGCACAG | 6612 | AQKPNAQIQAQ | 11201 | KPNAQIQ | 0.373406 | -0.06161 |
| SyS551 | 2024 | GCCCAAATGTCTATTGGTACGGGGTTCGGCACAG | 6613 | AQMSIGTGSAQ | 11202 | MSIGTGS | 0.373384 | 0.053851 |
| GS276 | 2025 | GCCCAAGGGCTGCAGGCGACGTATTCTGCACAG | 6614 | AQGLQATYSAQ | 11203 | GLQATYS | 0.373212 | -0.09754 |

FIG. 33 (Continued)

| | | | | | | | | |
|---|---|---|---|---|---|---|---|---|
| SyS552 | 2026 | GCCCAACAAACCCTCAGGCGCCAGCAGGCACAG | 6615 | AQQTLSASSAQ | 11204 | QTLSASS | 0.373145 | -0.04342 |
| GS277 | 2027 | GCCCAAGAGACCCCCCAACAAATTCCCGCACAG | 6616 | AQDPPNKFPAQ | 11205 | DPPNKFP | 0.373042 | 0.030997 |
| SyS554 | 2028 | GCCCAAAGAATCAGCACCCTCGGCCTCGCACAG | 6617 | AQRISTLGLAQ | 11206 | RISTLGL | 0.373026 | -0.22891 |
| SyS555 | 2029 | GCCCAAAATTCGGATCGTTCGGTTAGTGCACAG | 6618 | AQNSDRSVSAQ | 11207 | NSDRSVS | 0.372705 | -0.18284 |
| GP97 | 2030 | GCCCAATATAATCTGCGTCTTGGGGGGCACAG | 6619 | AQYNLRLGGAQ | 11208 | YNLRLGG | 0.37241 | -0.00505 |
| SyS556 | 2031 | GCCCAAGTTCAGGATCGGGCGATGACTGCACAG | 6620 | AQVQDRAMTAQ | 11209 | VQDRAMT | 0.37233 | 0.095998 |
| SyS557 | 2032 | GCCCAAAGCAGCAGCACCCTCCCAGAGCACAG | 6621 | AQSSSTLPRAQ | 11210 | SSSTLPR | 0.37218 | 0.075239 |
| SyS558 | 2033 | GCCCAAGGCGGCGGTCCAAACCGACAGCGCACAG | 6622 | AQGGVQTDSAQ | 11211 | GGVQTDS | 0.371805 | -0.08222 |
| SS48 | 2034 | GCCCAATTGTGTCTAATAATACTCGGGCACAG | 6623 | AQLLSNNTRAQ | 11212 | LLSNNTR | 0.371753 | -0.20449 |
| SyS559 | 2035 | GCCCAATATCATGCTGCTCAGGCTGTTGCACAG | 6624 | AQYHAAQAVAQ | 11213 | YHAAQAV | 0.371353 | 0.02988 |
| GP98 | 2036 | GCCCAAATGAGTGGTGGTGGGTAGTTCGGCACAG | 6625 | AQMSGVGSSAQ | 11214 | MSGVGSS | 0.371229 | 0.337397 |
| SyS560 | 2037 | GCCCAACTCACCGGCCAAGTCCTCGTCGCACAG | 6626 | AQLTGQVLVAQ | 11215 | LTGQVLV | 0.370851 | -0.08343 |
| SyS561 | 2038 | GCCCAAGCGGTTAATAGGCTGCCTATTGCACAG | 6627 | AQAVNRLPIAQ | 11216 | AVNRLPI | 0.370811 | -0.12454 |
| SyS562 | 2039 | GCCCAAAGTTCTCAGATGCCGTTGCGGGCACAG | 6628 | AQSSQMPLRAQ | 11217 | SSQMPLR | 0.370795 | -0.05174 |
| GS279 | 2040 | GCCCAAGCAGCAACATCGCCGACAGCGCACAG | 6629 | AQSSNIADSAQ | 11218 | SSNIADS | 0.370754 | -0.10675 |
| SyS563 | 2041 | GCCCAAGTTGTTACGCCGCAGATTAGTGCACAG | 6630 | AQVVTPQISAQ | 11219 | VVTPQIS | 0.37058 | -0.15746 |
| GS280 | 2042 | GCCCAAGATTCTAAGAAGATGAGTTGGGCACAG | 6631 | AQDSKKMSWAQ | 11220 | DSKKMSW | 0.370419 | -0.09553 |
| SyS564 | 2043 | GCCCAAGAGACGTATAAGACTACTCTGGCACAG | 6632 | AQETYKTTLAQ | 11221 | ETYKTTL | 0.370166 | -0.03857 |
| SyS565 | 2044 | GCCCAACTTACTATGGGTAATTCTCTGGCACAG | 6633 | AQLTMGNSLAQ | 11222 | LTMGNSL | 0.36988 | 0.014405 |
| SyS566 | 2045 | GCCCAATTTAAGGTTAGTATTCAGCAGGCACAG | 6634 | AQFKVSIQQAQ | 11223 | FKVSIQQ | 0.369779 | -0.20345 |
| SyS567 | 2046 | GCCCAAGATGGTCATGCTCATCTTCCGGCACAG | 6635 | AQDGHAHLPAQ | 11224 | DGHAHLP | 0.369646 | -0.11191 |
| SyS568 | 2047 | GCCCAAACCGCCGTCAGCCTCAGCAACGCACAG | 6636 | AQTAVSLSNAQ | 11225 | TAVSLSN | 0.369523 | -0.01275 |
| SyS569 | 2048 | GCCCAAAGCCAAAACCAAATGCAAACCGCACAG | 6637 | AQSQNQMQTAQ | 11226 | SQNQMQT | 0.369507 | -0.13071 |
| SyS570 | 2049 | GCCCAACAGAGTGTGACTACGCAGCATGCACAG | 6638 | AQQSVTTQHAQ | 11227 | QSVTTQH | 0.369126 | 0.146422 |
| SyS571 | 2050 | GCCCAACTCAGCACCGCCCTCACCGTCGCACAG | 6639 | AQLSTALTVAQ | 11228 | LSTALTV | 0.369039 | -0.00037 |
| SyS572 | 2051 | GCCCAACTCGCCAACGCCGTCACCAAAGCACAG | 6640 | AQLANAVTKAQ | 11229 | LANAVTK | 0.368954 | 0.183009 |
| GS281 | 2052 | GCCCAAACCGGCCACGTCCACGAAAACGCACAG | 6641 | AQTGHVHENAQ | 11230 | TGHVHEN | 0.368935 | -0.08669 |
| SyS573 | 2053 | GCCCAATCGATTTCGGATACGGCTTCTGCACAG | 6642 | AQSISDTASAQ | 11231 | SISDTAS | 0.368929 | -0.0313 |
| GS282 | 2054 | GCCCAACCCGTCGTCCAAAGCGTCGGGCACAG | 6643 | AQPVVQSVGAQ | 11232 | PVVQSVG | 0.368793 | -0.15766 |
| GS283 | 2055 | GCCCAACAACACCTCAGCACCGTCAACGCACAG | 6644 | AQQHLSTVNAQ | 11233 | QHLSTVN | 0.368559 | -0.15574 |
| SyS575 | 2056 | GCCCAACTGAGTCATAATACGACGCATGCACAG | 6645 | AQLSHNTTHAQ | 11234 | LSHNTTH | 0.368528 | 0.093848 |
| SyS576 | 2057 | GCCCAACCTTCGAATTTTCTGAATTCTGCACAG | 6646 | AQPSNFSNSAQ | 11235 | PSNFSNS | 0.368509 | 0.141011 |

FIG. 33 (Continued)

| | | | | | | | |
|---|---|---|---|---|---|---|---|
| SyS577 | 2058 | GCCCAATTTGATAAGTCTGTTCCTAGTGCACAG | 6647 | AQFDKSVPSAQ | 11236 | FDKSVPS | 0.368326 | -0.04816 |
| GS284 | 2059 | GCCCAAACCCAAGCCACCGAAAAAGACGCACAG | 6648 | AQTQATEKDAQ | 11237 | TQATEKD | 0.368256 | -0.09754 |
| SyS578 | 2060 | GCCCAATTGAGTGCGAAGGCTAGTCAGGCACAG | 6649 | AQLSAKASQAQ | 11238 | LSAKASQ | 0.368184 | 0.299581 |
| SyS579 | 2061 | GCCCAATCGGTTCAGCTGCGGTGTCGGCACAG | 6650 | AQSVQPAVSAQ | 11239 | SVQPAVS | 0.367991 | 0.197439 |
| SyS580 | 2062 | GCCCAAAGTTTGATGCATGGGACGGCTGCACAG | 6651 | AQSLMHGTPAQ | 11240 | SLMHGTP | 0.367985 | 0.049386 |
| GS285 | 2063 | GCCCAACCCACCATCAGAACCAACACCGCACAG | 6652 | AQPTIRTNTAQ | 11241 | PTIRTNT | 0.367694 | -0.04787 |
| SyS581 | 2064 | GCCCAAAATGATTCGCTTAAGGTTAATGCACAG | 6653 | AQNDSLKVNAQ | 11242 | NDSLKVN | 0.367645 | -0.2268 |
| SyS582 | 2065 | GCCCAAAGCACCCAACCCGTCAACAGAGCACAG | 6654 | AQSTQPVNRAQ | 11243 | STQPVNR | 0.367609 | -0.15981 |
| GS286 | 2066 | GCCCAATCTTCGGATAAGCATAATCCTGCACAG | 6655 | AQSSDKHNPAQ | 11244 | SSDKHNP | 0.367604 | 0.108588 |
| SyS583 | 2067 | GCCCAATTCCTCGAAAACGCCAAAATCGCACAG | 6656 | AQFLENAKIAQ | 11245 | FLENAKI | 0.367535 | 0.026006 |
| SyS584 | 2068 | GCCCAAGTGTCTACTGGTACTCTTAAGGCACAG | 6657 | AQVSTGTLKAQ | 11246 | VSTGTLK | 0.367523 | -0.07858 |
| GS287 | 2069 | GCCCAACGTGATGCGTCGTCTTTGAGTACTGCACAG | 6658 | AQRDASLSTAQ | 11247 | RDASLST | 0.36722 | -0.14238 |
| SyS585 | 2070 | GCCCAAAAGGGTACTGAGATTAAGCTTGCACAG | 6659 | AQKGTEIKLAQ | 11248 | KGTEIKL | 0.367015 | -0.01863 |
| SyS586 | 2071 | GCCCAAATTATGAATCAGCTGGGTGATGCACAG | 6660 | AQIMNQLGDAQ | 11249 | IMNQLGD | 0.36699 | -0.08828 |
| SyS587 | 2072 | GCCCAACCTAGTAATAATACTCAGATTGCACAG | 6661 | AQPSNNTQIAQ | 11250 | PSNNTQI | 0.366851 | -0.10646 |
| SyS588 | 2073 | GCCCAAACTTCGAGTAGTATTACGACTGCACAG | 6662 | AQTSSSITTAQ | 11251 | TSSSITT | 0.366832 | 0.041648 |
| SyS589 | 2074 | GCCCAAAGGGATCTGAATGCGCATAATGCACAG | 6663 | AQRDLNAHNAQ | 11252 | RDLNAHN | 0.366746 | 0.001434 |
| SyS590 | 2075 | GCCCAAACCGGCTTCGCCAGAAGCGAAGCACAG | 6664 | AQTGFARSEAQ | 11253 | TGFARSE | 0.366503 | -0.14283 |
| GS288 | 2076 | GCCCAACTCGAACAACTCGCCCCCAAAGCACAG | 6665 | AQLEQLAPKAQ | 11254 | LEQLAPK | 0.36606 | -0.18054 |
| SyS591 | 2077 | GCCCAAGCCGCCATGCAAAGCGAAAGAGCACAG | 6666 | AQAAMQSERAQ | 11255 | AAMQSER | 0.365747 | 0.085313 |
| SyS290 | 2078 | GCCCAACAGCTTAATTATGAGGCGCATGCACAG | 6667 | AQQLNYEAHAQ | 11256 | QLNYEAH | 0.36537 | -0.15497 |
| SyS592 | 2079 | GCCCAAGCCAACCCGGCAGCCTCCTCGCACAG | 6668 | AQANPGSLLAQ | 11257 | ANPGSLL | 0.365151 | 0.332343 |
| GS291 | 2080 | GCCCAACTTAGGCATATTGAGACGCCTGCACAG | 6669 | AQLRHIETPAQ | 11258 | LRHIETP | 0.365122 | -0.10472 |
| SS49 | 2081 | GCCCAACTTCCTCAGAATTCGGCGAAGGCACAG | 6670 | AQLPQNSAKAQ | 11259 | LPQNSAK | 0.36494 | -0.2215 |
| SyS593 | 2082 | GCCCAAGCCGGCAGCCCCATCAGCAGAGCACAG | 6671 | AQAGSPISRAQ | 11260 | AGSPISR | 0.364661 | 0.254221 |
| SyS594 | 2083 | GCCCAAAGAGCCACCAACGTCGAAGTCGCACAG | 6672 | AQRATNVEVAQ | 11261 | RATNVEV | 0.364602 | 0.350302 |
| SyS595 | 2084 | GCCCAACCCAACCCAACCAACAGAGGCGCACAG | 6673 | AQPQPNNRGAQ | 11262 | PQPNNRG | 0.364568 | 0.149339 |
| SyS596 | 2085 | GCCCAATCTCCTTCGACGCCTCATCTTGCACAG | 6674 | AQSPSTPHLAQ | 11263 | SPSTPHL | 0.364561 | -0.038 |
| SyS597 | 2086 | GCCCAACTTTCGAATACTTTGACTAATGCACAG | 6675 | AQLSNTLTNAQ | 11264 | LSNTLTN | 0.364377 | -0.02217 |
| GS292 | 2087 | GCCCAATCGAATAGGGAGGGTTTGATGGCACAG | 6676 | AQSNREGLMAQ | 11265 | SNREGLM | 0.364262 | -0.06434 |
| SyS598 | 2088 | GCCCAAGTGCGCCCACAGCCCCCCAGCGCACAG | 6677 | AQVAHSPPSAQ | 11266 | VAHSPPS | 0.364259 | 0.059626 |
| GS293 | 2089 | GCCCAAAGCGTCAAAAACATGCTCACCGCACAG | 6678 | AQSVKNMLTAQ | 11267 | SVKNMLT | 0.364054 | -0.01456 |

FIG. 33 (Continued)

| | | | | | | | | |
|---|---|---|---|---|---|---|---|---|
| GS294 | 2090 | GCCCAAGGGCTTTCGACTGGTCTTGCTGCACAG | 6679 | AQGLSTGLAAQ | 11268 | GLSTGLA | 0.36383 | -0.09664 |
| GS295 | 2091 | GCCCAAGCCATGAGCAGACCGAACTCGCACAG | 6680 | AQAMSRPELAQ | 11269 | AMSRPEL | 0.363746 | -0.09205 |
| SyS599 | 2092 | GCCCAAGCCATGGACCTCAAACTCCAAGCACAG | 6681 | AQAMDLKLQAQ | 11270 | AMDLKLQ | 0.363654 | -0.13677 |
| SyS600 | 2093 | GCCCAAGCCGTCGCCGGCCCCACCAAAGCACAG | 6682 | AQAVAGPTKAQ | 11271 | AVAGPTK | 0.363564 | 0.026302 |
| SyS601 | 2094 | GCCCAACCTACTCTTGGGTCGCGTACTGCACAG | 6683 | AQPTLGSRTAQ | 11272 | PTLGSRT | 0.363533 | 0.006254 |
| SyS602 | 2095 | GCCCAAAGTGAGAATCCTATTGATCCGGCACAG | 6684 | AQSENPIDPAQ | 11273 | SENPIDP | 0.363529 | -0.19011 |
| SyS603 | 2096 | GCCCAAACCAACAACAGCCCGGCACCGCACAG | 6685 | AQTNNSPGTAQ | 11274 | TNNSPGT | 0.36339 | 0.163927 |
| SyS604 | 2097 | GCCCAACACACCAGCCCACCAGCCTCGCACAG | 6686 | AQHTSPTSLAQ | 11275 | HTSPTSL | 0.363168 | 0.036859 |
| GS297 | 2098 | GCCCAAAACAACGCGGCATCAGCATGGCACAG | 6687 | AQNNAGISMAQ | 11276 | NNAGISM | 0.362679 | -0.08459 |
| GS298 | 2099 | GCCCAACTCGTCTACAGCAACAACACCGCACAG | 6688 | AQLVYSNNTAQ | 11277 | LVYSNNT | 0.362616 | -0.14524 |
| SyS605 | 2100 | GCCCAACGGCGAGTCAGTCTACGACTGCACAG | 6689 | AQPASQSTTAQ | 11278 | PASQSTT | 0.362362 | 0.055989 |
| SyS606 | 2101 | GCCCAAGTTCAGGTTGGGCATCCTCTTGCACAG | 6690 | AQVQVGHPLAQ | 11279 | VQVGHPL | 0.362247 | -0.16466 |
| SyS607 | 2102 | GCCCAAGACGCCAGTCACACCGGCACCGCACAG | 6691 | AQDASYTGTAQ | 11280 | DASYTGT | 0.361961 | -0.19133 |
| SyS608 | 2103 | GCCCAAGGGATTACTACTGAGGCGGGGCACAG | 6692 | AQGITTEARAQ | 11281 | GITTEAR | 0.361378 | -0.11715 |
| SyS609 | 2104 | GCCCAATCTATGCCTCAGCATGCTATTGCACAG | 6693 | AQSMPQHAIAQ | 11282 | SMPQHAI | 0.361137 | -0.01957 |
| SyS610 | 2105 | GCCCAACTCCAAAGCGCCCTCCAAAACGCACAG | 6694 | AQLQSALQNAQ | 11283 | LQSALQN | 0.361126 | -0.20951 |
| SyS611 | 2106 | GCCCAAAAAGCAGCGACAGCACCAGCGCACAG | 6695 | AQKSSDSTSAQ | 11284 | KSSDSTS | 0.360758 | 0.203964 |
| GS300 | 2107 | GCCCAAAAAAGCCCGGCGCCTCGCACAG | 6696 | AQKSPAGALAQ | 11285 | KSPAGAL | 0.360597 | -0.10382 |
| SyS613 | 2108 | GCCCAAACCGAAATGAGCCTCACCAGCGCACAG | 6697 | AQTEMSLTSAQ | 11286 | TEMSLTS | 0.360316 | -0.1489 |
| SyS614 | 2109 | GCCCAATTGAATAGTGAGACTTTCTGCACAG | 6698 | AQLNSETFPAQ | 11287 | LNSETFP | 0.360064 | -0.18405 |
| SyS615 | 2110 | GCCCAAGCGCCCTCAGCCAACAATACGCACAG | 6699 | AQSALSQQYAQ | 11288 | SALSQQY | 0.359961 | -0.08871 |
| GP99 | 2111 | GCCCAACGTTCGGTGGCTAATGTGCCGGCACAG | 6700 | AQRSVANVPAQ | 11289 | RSVANVP | 0.359888 | 0.151036 |
| SyS616 | 2112 | GCCCAAAGCAGCGGCGGCGCCACCCTCCAAGCACAG | 6701 | AQSSGATLQAQ | 11290 | SSGATLQ | 0.359857 | 0.069108 |
| SyS617 | 2113 | GCCCAACTCAACGGCGGCGGGCGCCAGCGCACAG | 6702 | AQLNGGAASAQ | 11291 | LNGGAAS | 0.359832 | -0.13192 |
| SyS619 | 2114 | GCCCAAAGCCACCAACACCACCCCACCGCACAG | 6703 | AQSHQTTPTAQ | 11292 | SHQTTPT | 0.359233 | -0.10135 |
| GS301 | 2115 | GCCCAATATGAGAATAGTAGTTTGGCACAG | 6704 | AQYENSSSLAQ | 11293 | YENSSSL | 0.359035 | -0.14003 |
| SyS620 | 2116 | GCCCAAATTCAGACTTCTGCTCATACTGCACAG | 6705 | AQIQTSAHTAQ | 11294 | IQTSAHT | 0.358854 | 0.06834 |
| SyS621 | 2117 | GCCCAAAGAGAAATCCAAAAAATGAGCGCACAG | 6706 | AQREIQKMSAQ | 11295 | REIQKMS | 0.358714 | -0.09495 |
| SyS622 | 2118 | GCCCAAAGCGCCGGCATGATCAGCCACGCACAG | 6707 | AQSAGMISHAQ | 11296 | SAGMISH | 0.358383 | 0.117139 |
| SyS623 | 2119 | GCCCAAATGAGAAGCACCGACAGCGAAGCACAG | 6708 | AQMRSTDSEAQ | 11297 | MRSTDSE | 0.358219 | 0.15208 |
| SyS624 | 2120 | GCCCAAAGCCACCCCCAAGGCGACAGCGCACAG | 6709 | AQSHPQGDSAQ | 11298 | SHPQGDS | 0.358104 | -0.12208 |
| SyS625 | 2121 | GCCCAACTCATCGACACCAAAATCAGCGCACAG | 6710 | AQLIDTKISAQ | 11299 | LIDTKIS | 0.358044 | 0.03053 |

FIG. 33 (Continued)

| | | | | | | | | |
|---|---|---|---|---|---|---|---|---|
| SyS626 | 2122 | GCCCAAACCCACCTCAAAGACCTCCTGCACAG | 6711 | AQTHLKDLLAQ | 11300 | THLKDLL | 0.357945 | 0.035942 |
| GS302 | 2123 | GCCCAAGGTACTTCGAGTGTGCTGATTGCACAG | 6712 | AQGTSSVLIAQ | 11301 | GTSSVLI | 0.357908 | 0.009233 |
| SyS627 | 2124 | GCCCAACCTTTGGTTACGAATGAGCCTGCACAG | 6713 | AQPLVTNEPAQ | 11302 | PLVTNEP | 0.357827 | -0.06917 |
| GS303 | 2125 | GCCCAAAGAGACCTCAGCCACAACAGCGCACAG | 6714 | AQRDLSHNSAQ | 11303 | RDLSHNS | 0.357777 | -0.14151 |
| SyS628 | 2126 | GCCCAATATGATAATGAGCATAGGCGGCACAG | 6715 | AQYDNEHRPAQ | 11304 | YDNEHRP | 0.3577 | 0.184576 |
| SyP39 | 2127 | GCCCAAGTTGGGAGTCATACTATGACGGCACAG | 6716 | AQVGSHTMTAQ | 11305 | VGSHTMT | 0.357557 | -0.04335 |
| SyS629 | 2128 | GCCCAAGGGCATACGAGTGTGTCTTGGCACAG | 6717 | AQGHTSVSLAQ | 11306 | GHTSVSL | 0.357531 | -0.06038 |
| SyS630 | 2129 | GCCCAACTCGACCTCAAAAACCAAAGAGCACAG | 6718 | AQLDLKNQRAQ | 11307 | LDLKNQR | 0.357396 | 0.14998 |
| SyS631 | 2130 | GCCCAACCGTCGCCAAAATCACCAGCGCACAG | 6719 | AQPVAKITSAQ | 11308 | PVAKITS | 0.357222 | -0.08463 |
| GS305 | 2131 | GCCCAACTTGAGAATGGGAAGCCTAAGGCACAG | 6720 | AQLENGKPKAQ | 11309 | LENGKPK | 0.356969 | -0.1617 |
| GS306 | 2132 | GCCCAAGACCTCGCCAGAGCCACCCTCGCACAG | 6721 | AQDLARATLAQ | 11310 | DLARATL | 0.356925 | -0.11281 |
| GS307 | 2133 | GCCCAAAAGGTTCGTGATGATAAGCCTGCACAG | 6722 | AQKVRDDKPAQ | 11311 | KVRDDKP | 0.356843 | 0.02987 |
| SS50 | 2134 | GCCCAACACAACGTCGCCATCACCCCGCACAG | 6723 | AQHNVAITPAQ | 11312 | HNVAITP | 0.356745 | -0.25276 |
| GS308 | 2135 | GCCCAAACTTCAACGCCACCTACGCCGCACAG | 6724 | AQTFNATYAAQ | 11313 | TFNATYA | 0.35665 | -0.07129 |
| SyS632 | 2136 | GCCCAAGGCAGCCAAGGCACCATCAGAGCACAG | 6725 | AQGSQGTIRAQ | 11314 | GSQGTIR | 0.356647 | 0.346418 |
| GS309 | 2137 | GCCCAAAGCCTCGGCCACGACGGCCAGAGCACAG | 6726 | AQSLGHDARAQ | 11315 | SLGHDAR | 0.356616 | -0.07956 |
| SyS633 | 2138 | GCCCAACGTAGTGGGCCGGATTCTTCTGCACAG | 6727 | AQRSGPDSSAQ | 11316 | RSGPDSS | 0.356605 | 0.13964 |
| SyS634 | 2139 | GCCCAAGCTATGAATCTTCAGAATTTGGCACAG | 6728 | AQAMNLQNLAQ | 11317 | AMNLQNL | 0.355956 | -0.06641 |
| SyP40 | 2140 | GCCCAACTTCGGGCTGGTCCGGGTGTGGCACAG | 6729 | AQLRAGPGVAQ | 11318 | LRAGPGV | 0.355879 | -0.04263 |
| SyS636 | 2141 | GCCCAAACCGTCATGAGCAGCAGCAGCGCACAG | 6730 | AQTVMSSSSAQ | 11319 | TVMSSSS | 0.355682 | 0.155451 |
| GS313 | 2142 | GCCCAACACATACTTCTCCTGTGGGTTATGCACAG | 6731 | AQHTSPVGYAQ | 11320 | HTSPVGY | 0.355451 | -0.07506 |
| SyP41 | 2143 | GCCCAATGGACTTCTCAGGCTACGGCGGCACAG | 6732 | AQWTSQATAAQ | 11321 | WTSQATA | 0.355301 | -0.03985 |
| SyS637 | 2144 | GCCCAAACGATGAATTCTGTTCCTCGTGCACAG | 6733 | AQTMNSVPRAQ | 11322 | TMNSVPR | 0.355114 | -0.10975 |
| GS315 | 2145 | GCCCAAGTCAACGGCGGCATGGTCAACGCACAG | 6734 | AQVNGGMVNAQ | 11323 | VNGGMVN | 0.3551 | -0.17381 |
| GS316 | 2146 | GCCCAAACTAATGCTAGGATGAATACTGCACAG | 6735 | AQTNARMNTAQ | 11324 | TNARMNT | 0.354728 | -0.01679 |
| SyS638 | 2147 | GCCCAAATCAGCGGCAACATGCACAGCGCACAG | 6736 | AQISGNMHSAQ | 11325 | ISGNMHS | 0.354683 | 0.134397 |
| GS317 | 2148 | GCCCAAAGCGTCGGCGGCGCCAGCTTCGCACAG | 6737 | AQSVGGASFAQ | 11326 | SVGGASF | 0.354664 | -0.04069 |
| GS318 | 2149 | GCCCAAACCAGCGAAAGCCCTACAAAGCACAG | 6738 | AQTSESPYKAQ | 11327 | TSESPYK | 0.354593 | -0.18278 |
| SyS639 | 2150 | GCCCAAGGTCATTTTGGTACTATGTCGGCACAG | 6739 | AQGHFGTMSAQ | 11328 | GHFGTMS | 0.354408 | -0.06031 |
| SyS640 | 2151 | GCCCAACTTACGACTAGTGGTCTGAAGGCACAG | 6740 | AQLTTSGLKAQ | 11329 | LTTSGLK | 0.354396 | 0.01345 |
| GS319 | 2152 | GCCCAAAGGATTAATTCGTCTACGTATGCACAG | 6741 | AQRINSSTYAQ | 11330 | RINSSTY | 0.354303 | -0.18727 |
| GP100 | 2153 | GCCCAACTGACTGGTAGTTCGTTGACTGCACAG | 6742 | AQLTGSSLTAQ | 11331 | LTGSSLT | 0.354102 | -0.07405 |

FIG. 33 (Continued)

| | | | | | | | | |
|---|---|---|---|---|---|---|---|---|
| SyS641 | 2154 | GCCCAACCGATTCGGGTACTATTTATGCACAG | 6743 | AQPIRGTIYAQ | 11332 | PIRGTIY | 0.354066 | -0.08153 |
| GS320 | 2155 | GCCCAAACCACCAGCAACACACCCAGCACAG | 6744 | AQTTSNNTHAQ | 11333 | TTSNNTH | 0.354066 | 0.118932 |
| SyS642 | 2156 | GCCCAACAGGTGACTACTAATTTGGATGCACAG | 6745 | AQQVTTNLDAQ | 11334 | QVTTNLD | 0.353947 | -0.09555 |
| SyS643 | 2157 | GCCCAAGCTTTGGATTCTAGTGAGCCGGCACAG | 6746 | AQALDSSEPAQ | 11335 | ALDSSEP | 0.353947 | -0.1889 |
| SyS644 | 2158 | GCCCAATACCCCAAAAACGTCGCCTGGGCACAG | 6747 | AQYPKNVAWAQ | 11336 | YPKNVAW | 0.353947 | -0.20588 |
| SyS645 | 2159 | GCCCAATCTACTACTGGGCGGAATCTGGCACAG | 6748 | AQSTTGRNLAQ | 11337 | STTGRNL | 0.353947 | -0.21436 |
| SyS646 | 2160 | GCCCAAACGAAGCTTATGCAGTCTAATGCACAG | 6749 | AQTKLMQSNAQ | 11338 | TKLMQSN | 0.353941 | 0.01478 |
| SyS647 | 2161 | GCCCAAAACAGCTACGGCGACGCCGCCGCACAG | 6750 | AQNSYGDAAAQ | 11339 | NSYGDAA | 0.3539 | -0.07546 |
| SyS648 | 2162 | GCCCAAGAGCATACGGGTGCGCCTGTCGCACAG | 6751 | AQEHTGAPAAQ | 11340 | EHTGAPA | 0.353742 | -0.18861 |
| SyS649 | 2163 | GCCCAACTGCGGACTGAGACGGCGAATGCACAG | 6752 | AQLRTETANAQ | 11341 | LRTETAN | 0.353402 | -0.03968 |
| SyS650 | 2164 | GCCCAAGTCCTGACGTCAACACCCTCGCACAG | 6753 | AQVLDVNTLAQ | 11342 | VLDVNTL | 0.353275 | -0.15041 |
| SyS651 | 2165 | GCCCAAGACAGAGAGGCAACGACAAACTCGCACAG | 6754 | AQDRGNDKLAQ | 11343 | DRGNDKL | 0.353216 | 0.297443 |
| GS321 | 2166 | GCCCAAAGCTTCACCAACAGCACCCAGCACAG | 6755 | AQSFTNSTHAQ | 11344 | SFTNSTH | 0.352987 | 0.109223 |
| SyS652 | 2167 | GCCCAACTGCGCCCACAGCAGCCTCAGCGCACAG | 6756 | AQLAHSSLSAQ | 11345 | LAHSSLS | 0.352724 | -0.00659 |
| GS323 | 2168 | GCCCAAAGACTCGTCGACCCCATCCCCGCACAG | 6757 | AQRLVDPIPAQ | 11346 | RLVDPIP | 0.352703 | -0.09391 |
| SyS653 | 2169 | GCCCAATGGGGCGACAAAGAAACCTTCGCACAG | 6758 | AQWGDKETFAQ | 11347 | WGDKETF | 0.352651 | -0.15617 |
| SyS654 | 2170 | GCCCAAAGAGAGACGACAACCTCAGCACCGCACAG | 6759 | AQRDDNLSTAQ | 11348 | RDDNLST | 0.352538 | -0.05395 |
| SyS655 | 2171 | GCCCAATCTAAGCAGTTGATTGATACTGCACAG | 6760 | AQSKQLIDTAQ | 11349 | SKQLIDT | 0.352442 | -0.22803 |
| GS325 | 2172 | GCCCAATTTCAGAATCAGACTGTTGGTGCACAG | 6761 | AQFQNQTVGAQ | 11350 | FQNQTVG | 0.352245 | -0.04999 |
| SyS656 | 2173 | GCCCAAGTCTTCAGCAGCGACAGCCTCGCACAG | 6762 | AQVFSSDSLAQ | 11351 | VFSSDSL | 0.352214 | 0.031487 |
| SyS657 | 2174 | GCCCAATATGCGCAGCAGTTGCCTGTGGCACAG | 6763 | AQYAQQLPVAQ | 11352 | YAQQLPV | 0.352069 | -0.06517 |
| SyS658 | 2175 | GCCCAAATTGTGACTGGTACGCAGGCACAG | 6764 | AQIVTGTTQAQ | 11353 | IVTGTTQ | 0.351501 | -0.17505 |
| SyS659 | 2176 | GCCCAAAGCAAGATCACCGAAAGCAACGCACAG | 6765 | AQSKITESNAQ | 11354 | SKITESN | 0.351451 | 0.084909 |
| SyS660 | 2177 | GCCCAAATTGCTGGGCAGGTGGGGGCACAG | 6766 | AQIAGQVGAAQ | 11355 | IAGQVGA | 0.351384 | 0.33939 |
| SyS661 | 2178 | GCCCAAGGTTATAGTCAGACGCCTCATGCACAG | 6767 | AQGYSQTPHAQ | 11356 | GYSQTPH | 0.351298 | 0.03403 |
| GS326 | 2179 | GCCCAAGGTTTGGCGTTGCGTCCTGATGCACAG | 6768 | AQGLALRPDAQ | 11357 | GLALRPD | 0.35125 | -0.09087 |
| SyS662 | 2180 | GCCCAAAAACGCCGTCAGCAACAACACCGCACAG | 6769 | AQNAVSNNTAQ | 11358 | NAVSNNT | 0.351208 | 0.221429 |
| SyS663 | 2181 | GCCCAAAACCAAAGCACCCTCCCCACGCACAG | 6770 | AQNQSTLPTAQ | 11359 | NQSTLPT | 0.351121 | 0.2934 |
| GS328 | 2182 | GCCCAAACCAGCATCCCCGACAAACCCGCACAG | 6771 | AQTSIPDKPAQ | 11360 | TSIPDKP | 0.351033 | -0.02153 |
| SyS664 | 2183 | GCCCAAGGCAGCACCGCCAGCCTCGCACAG | 6772 | AQGSSTASLAQ | 11361 | GSSTASL | 0.350993 | 0.260874 |
| GS329 | 2184 | GCCCAAAGAATCATCGGCACCGCCACCGCACAG | 6773 | AQRIIGTATAQ | 11362 | RIIGTAT | 0.350979 | -0.11461 |
| GP101 | 2185 | GCCCAAAGTTTGAATGGGGGTCGGACGGCACAG | 6774 | AQSLNGGRTAQ | 11363 | SLNGGRT | 0.35082 | 0.208517 |

FIG. 33 (Continued)

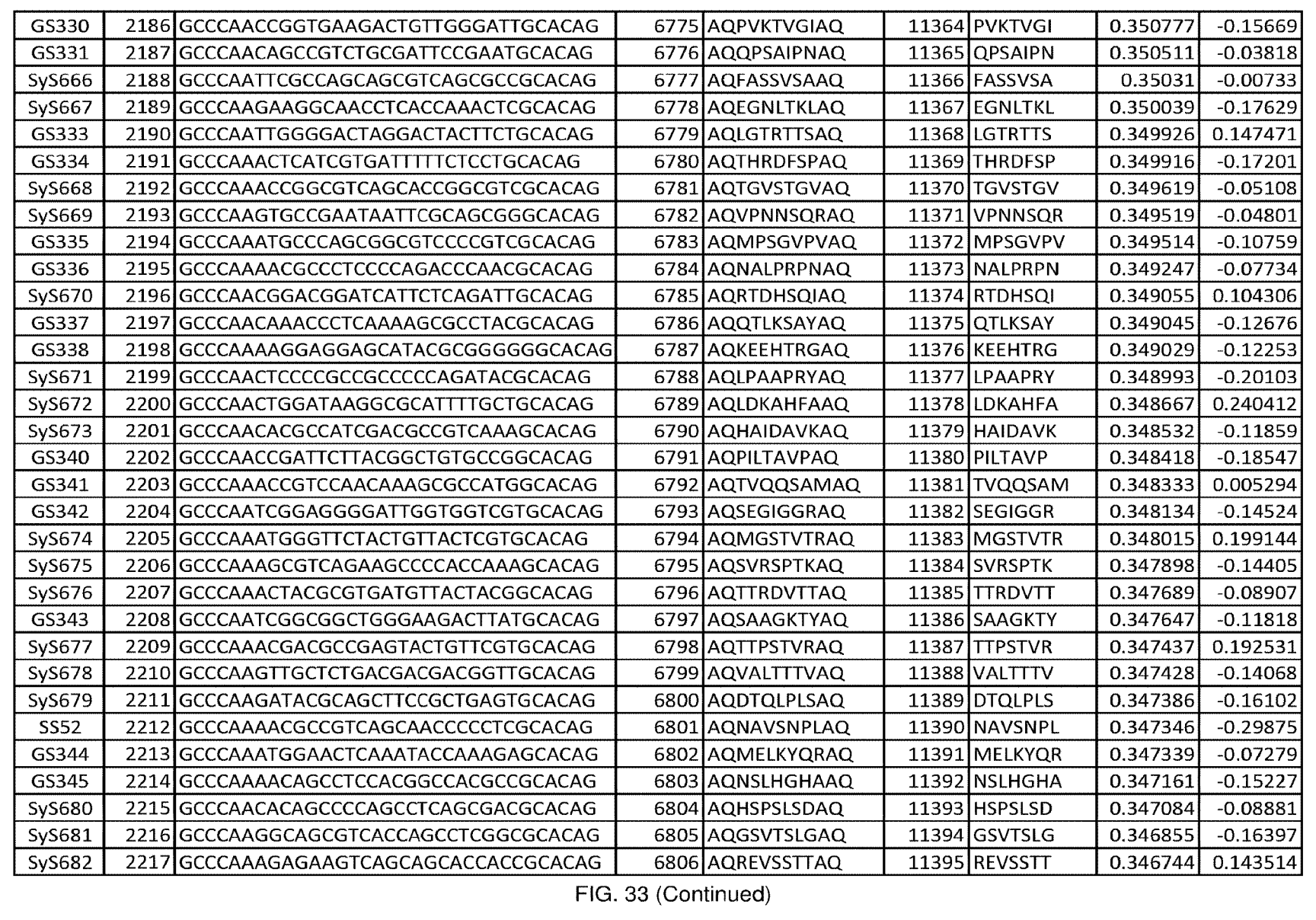

| | | | | | | | | |
|---|---|---|---|---|---|---|---|---|
| GS330 | 2186 | GCCCAACCGGTGAAGACTGTTGGGATTGCACAG | 6775 | AQPVKTVGIAQ | 11364 | PVKTVGI | 0.350777 | -0.15669 |
| GS331 | 2187 | GCCCAACAGCCGTCTGCGATTCCGAATGCACAG | 6776 | AQQPSAIPNAQ | 11365 | QPSAIPN | 0.350511 | -0.03818 |
| SyS666 | 2188 | GCCCAATTCGCCAGCAGCGTCAGCGCCGCACAG | 6777 | AQFASSVSAAQ | 11366 | FASSVSA | 0.35031 | -0.00733 |
| SyS667 | 2189 | GCCCAAGAAGGCAACCTCACCAAACTCGCACAG | 6778 | AQEGNLTKLAQ | 11367 | EGNLTKL | 0.350039 | -0.17629 |
| GS333 | 2190 | GCCCAATTGGGGACTAGGACTACTTCTGCACAG | 6779 | AQLGTRTTSAQ | 11368 | LGTRTTS | 0.349926 | 0.147471 |
| GS334 | 2191 | GCCCAAACTCATCGTGATTTTTCTCCTGCACAG | 6780 | AQTHRDFSPAQ | 11369 | THRDFSP | 0.349916 | -0.17201 |
| SyS668 | 2192 | GCCCAAACCGGCGTCAGCACCGGCGTCGCACAG | 6781 | AQTGVSTGVAQ | 11370 | TGVSTGV | 0.349619 | -0.05108 |
| SyS669 | 2193 | GCCCAAGTGCCGAATAATTCGCAGCGGGCACAG | 6782 | AQVPNNSQRAQ | 11371 | VPNNSQR | 0.349519 | -0.04801 |
| GS335 | 2194 | GCCCAAATGCCAGCGGCGGTCCCGTCGCACAG | 6783 | AQMPSGVPVAQ | 11372 | MPSGVPV | 0.349514 | -0.10759 |
| GS336 | 2195 | GCCCAAAACGCCCTCCCCAGACCCAACGCACAG | 6784 | AQNALPRPNAQ | 11373 | NALPRPN | 0.349247 | -0.07734 |
| SyS670 | 2196 | GCCCAACGGACGGATCATTCTCAGATTGCACAG | 6785 | AQRTDHSQIAQ | 11374 | RTDHSQI | 0.349055 | 0.104306 |
| GS337 | 2197 | GCCCAACAAACCCTCAAAAGGCCTACGCACAG | 6786 | AQQTLKSAYAQ | 11375 | QTLKSAY | 0.349045 | -0.12676 |
| GS338 | 2198 | GCCCAAAAGGAGGAGCATACGCGGGGGGCACAG | 6787 | AQKEEHTRGAQ | 11376 | KEEHTRG | 0.349029 | -0.12253 |
| SyS671 | 2199 | GCCCAACTCCCCGCCGCCCCAGATACGCACAG | 6788 | AQLPAAPRYAQ | 11377 | LPAAPRY | 0.348993 | -0.20103 |
| SyS672 | 2200 | GCCCAACTGGATAAGGCGCATTTTGCTGCACAG | 6789 | AQLDKAHFAAQ | 11378 | LDKAHFA | 0.348667 | 0.240412 |
| SyS673 | 2201 | GCCCAACACGCCATCGACGCCGTCAAAGCACAG | 6790 | AQHAIDAVKAQ | 11379 | HAIDAVK | 0.348532 | -0.11859 |
| GS340 | 2202 | GCCCAACCGATTCTTACGGCTGTGCCGGCACAG | 6791 | AQPILTAVPAQ | 11380 | PILTAVP | 0.348418 | -0.18547 |
| GS341 | 2203 | GCCCAAACGTCCAACAAAGCGCCATGGCACAG | 6792 | AQTVQQSAMAQ | 11381 | TVQQSAM | 0.348333 | 0.005294 |
| GS342 | 2204 | GCCCAATCGGAGGGGATTGGTGGTCGTGCACAG | 6793 | AQSEGIGGRAQ | 11382 | SEGIGGR | 0.348134 | -0.14524 |
| SyS674 | 2205 | GCCCAAATGGGTTCTACTGTTACTCGTGCACAG | 6794 | AQMGSTVTRAQ | 11383 | MGSTVTR | 0.348015 | 0.199144 |
| SyS675 | 2206 | GCCCAAAGCGTCAGAAGCCCACCAAAGCACAG | 6795 | AQSVRSPTKAQ | 11384 | SVRSPTK | 0.347898 | -0.14405 |
| SyS676 | 2207 | GCCCAAACTACGCGTGATGTTACTACGGCACAG | 6796 | AQTTRDVTTAQ | 11385 | TTRDVTT | 0.347689 | -0.08907 |
| GS343 | 2208 | GCCCAATCGGCGGCTGGGAAGACTTATGCACAG | 6797 | AQSAAGKTYAQ | 11386 | SAAGKTY | 0.347647 | -0.11818 |
| SyS677 | 2209 | GCCCAAACGACGCCGAGTACTGTTCGTGCACAG | 6798 | AQTTPSTVRAQ | 11387 | TTPSTVR | 0.347437 | 0.192531 |
| SyS678 | 2210 | GCCCAAGTTGCTCTGACGACGACGGTTGCACAG | 6799 | AQVALTTTVAQ | 11388 | VALTTTV | 0.347428 | -0.14068 |
| SyS679 | 2211 | GCCCAAGATACGCAGCTTCCGCTGAGTGCACAG | 6800 | AQDTQLPLSAQ | 11389 | DTQLPLS | 0.347386 | -0.16102 |
| SS52 | 2212 | GCCCAAAACGCCGTCAGCAACCCCTCGCACAG | 6801 | AQNAVSNPLAQ | 11390 | NAVSNPL | 0.347346 | -0.29875 |
| GS344 | 2213 | GCCCAAATGGAACTCAAATACCAAAGAGCACAG | 6802 | AQMELKYQRAQ | 11391 | MELKYQR | 0.347339 | -0.07279 |
| GS345 | 2214 | GCCCAAAACAGCCTCCACGGCCACGCGCACAG | 6803 | AQNSLHGHAAQ | 11392 | NSLHGHA | 0.347161 | -0.15227 |
| SyS680 | 2215 | GCCCAACACAGCCCCAGCCTCAGCGACGCACAG | 6804 | AQHSPSLSDAQ | 11393 | HSPSLSD | 0.347084 | -0.08881 |
| SyS681 | 2216 | GCCCAAGGCAGCGTCACCAGCCTCGGGCGCACAG | 6805 | AQGSVTSLGAQ | 11394 | GSVTSLG | 0.346855 | -0.16397 |
| SyS682 | 2217 | GCCCAAAGAGAAGAGTCAGCAGCACCACCGCACAG | 6806 | AQREVSSTTAQ | 11395 | REVSSTT | 0.346744 | 0.143514 |

FIG. 33 (Continued)

| | | | | | | | | |
|---|---|---|---|---|---|---|---|---|
| GS346 | 2218 | GCCCAAGGTAAGGCGACGCTTGATACTGCACAG | 6807 | AQGKATLDTAQ | 11396 | GKATLDT | 0.346704 | -0.12044 |
| GS347 | 2219 | GCCCAACTTAATCCTCCTTTGAATAAATGCACAG | 6808 | AQINPPLNNAQ | 11397 | LNPPLNN | 0.346683 | -0.15676 |
| SyS683 | 2220 | GCCCAAACTTCTGGGCATTCGCCGTCGGCACAG | 6809 | AQTSGHSPSAQ | 11398 | TSGHSPS | 0.346676 | 0.010364 |
| SyS684 | 2221 | GCCCAAGACGTCACCGCCACCGCCCCCGCACAG | 6810 | AQDVTATAPAQ | 11399 | DVTATAP | 0.346433 | -0.18648 |
| GS349 | 2222 | GCCCAACACCAAAAACACCGGCAGCGTCGCACAG | 6811 | AQHQNTGSVAQ | 11400 | HQNTGSV | 0.346357 | -0.01619 |
| SyS686 | 2223 | GCCCAAGATCTTACGCATACTTTGATGCACAG | 6812 | AQDLTHTFDAQ | 11401 | DLTHTFD | 0.34605 | -0.19496 |
| GS350 | 2224 | GCCCAATACCTCCCAACAAAGAAAGAGCACAG | 6813 | AQYLPNKERAQ | 11402 | YLPNKER | 0.345987 | -0.05272 |
| SyS687 | 2225 | GCCCAAGTGGATGGTACGTATACGGTGGCACAG | 6814 | AQVDGTYTVAQ | 11403 | VDGTYTV | 0.345915 | -0.0622 |
| SyS688 | 2226 | GCCCAATACCTCACCAGCGGCGGGCTACGCACAG | 6815 | AQYLTSGGYAQ | 11404 | YLTSGGY | 0.345752 | -0.13798 |
| SyS689 | 2227 | GCCCAAGCCAGCCTCGTCGTCGCGCGCACAG | 6816 | AQASLVVVAAQ | 11405 | ASLVVVA | 0.3457 | -0.17072 |
| SyS690 | 2228 | GCCCAATTTGATGCTAATTGAAGATTGCACAG | 6817 | AQFDANSKIAQ | 11406 | FDANSKI | 0.345431 | -0.14647 |
| SyS691 | 2229 | GCCCAATACCTCACCGAAAGCCCCGGCGCACAG | 6818 | AQYLTESPGAQ | 11407 | YLTESPG | 0.345425 | -0.15781 |
| GS351 | 2230 | GCCCAAAGAAACGCCAGCCTCGACCCGCACAG | 6819 | AQRNASLDPAQ | 11408 | RNASLDP | 0.345339 | -0.0446 |
| GP103 | 2231 | GCCCAAGCGGGGAGTCCTGCGTGCGGGTGCACAG | 6820 | AQAGSPRAGAQ | 11409 | AGSPRAG | 0.345002 | -0.07336 |
| SyS692 | 2232 | GCCCAAAGAGTCGAAAAACTCACCCCGCACAG | 6821 | AQRVEKLTPAQ | 11410 | RVEKLTP | 0.344773 | -0.07567 |
| SyS693 | 2233 | GCCCAAAGAACCACCGGCGACAACACCGCACAG | 6822 | AQRTTGDNTAQ | 11411 | RTTGDNT | 0.344747 | 0.190402 |
| SyS694 | 2234 | GCCCAACCCGCCGCCACCAGCGGCTTCGCACAG | 6823 | AQPAATSGFAQ | 11412 | PAATSGF | 0.344706 | -0.16344 |
| SyS695 | 2235 | GCCCAAATTCTTACGATTCATACGCATGCACAG | 6824 | AQILTIHTHAQ | 11413 | ILTIHTH | 0.344626 | -0.22042 |
| GS354 | 2236 | GCCCAAATCAACATCAGCAGCGTCGCACAG | 6825 | AQINISSHVAQ | 11414 | INISSHV | 0.34453 | -0.03881 |
| GS355 | 2237 | GCCCAACCCAGCGGCGCAGCGCCAGAAGCGCACAG | 6826 | AQPSGSARSAQ | 11415 | PSGSARS | 0.344116 | -0.15192 |
| SyS696 | 2238 | GCCCAAAGTACGATGCCGACTAGGCTGGCACAG | 6827 | AQSTMPTRLAQ | 11416 | STMPTRL | 0.344089 | -0.10729 |
| SyS697 | 2239 | GCCCAACTCTACGCCGGCGTGGGGCGTCGCACAG | 6828 | AQLYASAGVAQ | 11417 | LYASAGV | 0.34374 | -0.13192 |
| GP104 | 2240 | GCCCAATTGGTTCAGACGGGCTGCTGGCACAG | 6829 | AQLVQTGLLAQ | 11418 | LVQTGLL | 0.343691 | -0.07266 |
| GS357 | 2241 | GCCCAAGTCAGCCTCAACAGAACCGAAGCACAG | 6830 | AQVSLNRTEAQ | 11419 | VSLNRTE | 0.343359 | -0.01647 |
| SyP42 | 2242 | GCCCAAGGTGGGAGGAGGAGTTCTTTGGCACAG | 6831 | AQGGRESSLAQ | 11420 | GGRESSL | 0.343358 | -0.04339 |
| GS358 | 2243 | GCCCAAGTGGAGAGAGGATGCCGAGGATGGCACAG | 6832 | AQVERMPRMAQ | 11421 | VERMPRM | 0.343043 | -0.03534 |
| SyS699 | 2244 | GCCCAACCCAAATCGGCATCCCGACGCACAG | 6833 | AQPQIGIPDAQ | 11422 | PQIGIPD | 0.342946 | -0.05619 |
| GS359 | 2245 | GCCCAAGCTACGGTGAAGTCGAGTACTGCACAG | 6834 | AQATVKSSTAQ | 11423 | ATVKSST | 0.342874 | 0.027178 |
| SyS700 | 2246 | GCCCAAGGCGGCAACGTCCAAGCCATCGCACAG | 6835 | AQGGNVQAIAQ | 11424 | GGNVQAI | 0.342847 | -0.0119 |
| SyS701 | 2247 | GCCCAAACTATTGTTAATGTTACTAGTGCACAG | 6836 | AQTIVNVTSAQ | 11425 | TIVNVTS | 0.342809 | -0.19739 |
| SyS702 | 2248 | GCCCAAGGGCGACCCCGCCCAAAGCAGCGCACAG | 6837 | AQGDPAQSSAQ | 11426 | GDPAQSS | 0.342651 | -0.10889 |
| SyS703 | 2249 | GCCCAAACTAAGAATACTGATTTTCAGGCACAG | 6838 | AQTKNTDFQAQ | 11427 | TKNTDFQ | 0.34251 | -0.02105 |

FIG. 33 (Continued)

| | | | | | | | | |
|---|---|---|---|---|---|---|---|---|
| GS361 | 2250 | GCCCAAAGACACACCGACGCCGTCATCGCACAG | 6839 | AQRHTDAVIAQ | 11428 | RHTDAVI | 0.342481 | -0.12298 |
| SyS704 | 2251 | GCCCAAAGCGGTCCACACCGCCGTCAGAGCACAG | 6840 | AQSVHTAVRAQ | 11429 | SVHTAVR | 0.342291 | -0.02887 |
| SyS705 | 2252 | GCCCAAATCACCAGCCTCATGAGCGGCGGCACAG | 6841 | AQITSLMSGAQ | 11430 | ITSLMSG | 0.342264 | -0.11737 |
| SyS706 | 2253 | GCCCAAGACCACCAACCAAATCAGCCTCGCACAG | 6842 | AQDHNQISLAQ | 11431 | DHNQISL | 0.341991 | -0.16587 |
| GS362 | 2254 | GCCCAACAAGGCCAAAGCGCCCTCAAAGCACAG | 6843 | AQQGQSALKAQ | 11432 | QGQSALK | 0.341744 | 0.009075 |
| TS146 | 2255 | GCCCAAAACAACGCCACCAGATACACCGCACAG | 6844 | AQNNATRYTAQ | 11433 | NNATRYT | 0.34159 | 0.011557 |
| SyS707 | 2256 | GCCCAATCGCGTAATACGACTTCGTGGGCACAG | 6845 | AQSRNTTSWAQ | 11434 | SRNTTSW | 0.341535 | -0.21436 |
| GS364 | 2257 | GCCCAACCTAGTAATTCGAAGCTGATTGCACAG | 6846 | AQPSNSKLIAQ | 11435 | PSNSKLI | 0.341264 | -0.05716 |
| SyS709 | 2258 | GCCCAAAAAACCGTCAGCCTCAACGACGCACAG | 6847 | AQKTVSLNDAQ | 11436 | KTVSLND | 0.341072 | 0.177223 |
| SyS710 | 2259 | GCCCAAACCCCCTCCCAGAGTCAGCGCACAG | 6848 | AQTPLPRVSAQ | 11437 | TPLPRVS | 0.340871 | -0.18284 |
| GS365 | 2260 | GCCCAACAGACTATTGCGAGTGCTTTGGCACAG | 6849 | AQQTIASALAQ | 11438 | QTIASAL | 0.340714 | -0.14779 |
| GS366 | 2261 | GCCCAACCTATTATGAAGACGACGGTTGCACAG | 6850 | AQPIMKTTVAQ | 11439 | PIMKTTV | 0.340641 | -0.111 |
| SyS711 | 2262 | GCCCAAAGTGCGGTTATTCAGGGGCATGCACAG | 6851 | AQSAVIQGHAQ | 11440 | SAVIQGH | 0.340621 | -0.08096 |
| SyS712 | 2263 | GCCCAACCGCTGTATGGTACGATGTCTGCACAG | 6852 | AQPLYGTMSAQ | 11441 | PLYGTMS | 0.34044 | -0.21325 |
| TS147 | 2264 | GCCCAAGCGAATCGGACTAAGGATTATGCACAG | 6853 | AQANRTKDYAQ | 11442 | ANRTKDY | 0.34043 | 0.212101 |
| SyS713 | 2265 | GCCCAAGTTATTCCGCAGACGGAGAGGGCACAG | 6854 | AQVIPQTERAQ | 11443 | VIPQTER | 0.34041 | -0.15132 |
| SS53 | 2266 | GCCCAAATCGTCAACGGGCCACATCAGAGCACAG | 6855 | AQIVNGHIRAQ | 11444 | IVNGHIR | 0.340404 | -0.39357 |
| SyS714 | 2267 | GCCCAAAGCAGACCCAACGAAACCACCGCACAG | 6856 | AQSRPNETTAQ | 11445 | SRPNETT | 0.340281 | 0.437826 |
| SyS716 | 2268 | GCCCAAGGGTATACTCCGGTTTCGAGGGCACAG | 6857 | AQGYTPVSRAQ | 11446 | GYTPVSR | 0.34003 | -0.22803 |
| SyS717 | 2269 | GCCCAACCTCTGCAGAGGACTATTGGGGCACAG | 6858 | AQPLQRTIGAQ | 11447 | PLQRTIG | 0.340023 | -0.17557 |
| GS367 | 2270 | GCCCAAAGCACCGGCAGCCCACCATCGCACAG | 6859 | AQSTGSPTIAQ | 11448 | STGSPTI | 0.339967 | -0.092 |
| SyS718 | 2271 | GCCCAAAGTACTATGACGGGGCTGATTGCACAG | 6860 | AQSTMTGLIAQ | 11449 | STMTGLI | 0.339737 | -0.05431 |
| GS368 | 2272 | GCCCAAATCCACGCCGTCGGCGCCGAAGCACAG | 6861 | AQIHAVGAEAQ | 11450 | IHAVGAE | 0.33972 | -0.18099 |
| SyS719 | 2273 | GCCCAAACCGCCAAGTCAGCGAACTCGCACAG | 6862 | AQTANVSELAQ | 11451 | TANVSEL | 0.33963 | -0.05039 |
| SyS720 | 2274 | GCCCAAAAACAAAAGGACATGCCCACGCACAG | 6863 | AQNKSDMPHAQ | 11452 | NKSDMPH | 0.339521 | 0.149221 |
| SyS721 | 2275 | GCCCAAAGCAACTACAACACCACGACGCACAG | 6864 | AQSNYNTHDAQ | 11453 | SNYNTHD | 0.339506 | 0.012789 |
| SyS722 | 2276 | GCCCAACCGAGTGTTACTCATCCGGCACAG | 6865 | AQPSVTHHPAQ | 11454 | PSVTHHP | 0.339089 | 0.133746 |
| GS369 | 2277 | GCCCAAAATTTGAGTCTTAAGCCGCTGGCACAG | 6866 | AQNLSLKPLAQ | 11455 | NLSLKPL | 0.338682 | -0.1774 |
| TS148 | 2278 | GCCCAACTTTATTCGAATAAGAGTAATGCACAG | 6867 | AQLYSNKSNAQ | 11456 | LYSNKSN | 0.338445 | -0.09092 |
| SyS725 | 2279 | GCCCAAGATAATGGTCTGGTTCATAGGGCACAG | 6868 | AQDNGLVHRAQ | 11457 | DNGLVHR | 0.337855 | -0.05918 |
| SyS726 | 2280 | GCCCAAATGGGCACCCTCACCATCAGCGCACAG | 6869 | AQMGTLTISAQ | 11458 | MGTLTIS | 0.337855 | -0.20103 |
| GS370 | 2281 | GCCCAAACTTTTCAGTCTGATGAGAGGCACAG | 6870 | AQTFQSDERAQ | 11459 | TFQSDER | 0.337719 | -0.16573 |

FIG. 33 (Continued)

| | | | | | | | |
|---|---|---|---|---|---|---|---|
| GS371 | 2282 | GCCCAAATCGTCACCGGCGCCTACAGAGAGCACAG | 6871 | AQIVTGAYRAQ | 11460 | IVTGAYR | 0.337298 | -0.16814 |
| SyS727 | 2283 | GCCCAAACCGTCGTCAACCCCAGCAGCGCACAG | 6872 | AQTVVNPSSAQ | 11461 | TVVNPSS | 0.337204 | 0.129144 |
| GP105 | 2284 | GCCCAAGATAATAATGTTAGGCATACGGGCACAG | 6873 | AQDNNVRHTAQ | 11462 | DNNVRHT | 0.33706 | 0.231989 |
| GS373 | 2285 | GCCCAAGATCGTTCGCAGAATTCGTTGGCACAG | 6874 | AQDRSQNSLAQ | 11463 | DRSQNSL | 0.337028 | 0.002952 |
| SyS728 | 2286 | GCCCAACATCCTCGTGCCGGCGTCTGCACAG | 6875 | AQHPPVPASAQ | 11464 | HPPVPAS | 0.336942 | 0.072962 |
| SyS729 | 2287 | GCCCAAAAATACATCACCCCCAGCAGCGCACAG | 6876 | AQKYITPSSAQ | 11465 | KYITPSS | 0.336738 | -0.12344 |
| GS374 | 2288 | GCCCAAGTGCCGGATAAGCAGGCGATGGCACAG | 6877 | AQVPDKQAMAQ | 11466 | VPDKQAM | 0.336567 | -0.02576 |
| SyS730 | 2289 | GCCCAAGTTATTGCGAAGACTGAGTATGCACAG | 6878 | AQVIAKTEYAQ | 11467 | VIAKTEY | 0.33656 | -0.04584 |
| SyS731 | 2290 | GCCCAAGGGGGCAGGCGGAGGGGCGGGGCACAG | 6879 | AQGGQAEARAQ | 11468 | GGQAEAR | 0.336557 | -0.04446 |
| SyS732 | 2291 | GCCCAACAACCCGTCCTCAACCAACCCGCACAG | 6880 | AQQPVLNQPAQ | 11469 | QPVLNQP | 0.336549 | 0.089177 |
| GS375 | 2292 | GCCCAAAATAATACTAATGAGAATCTTGCACAG | 6881 | AQNNTNENLAQ | 11470 | NNTNENL | 0.336205 | -0.15048 |
| SyS733 | 2293 | GCCCAACTAATCTGTCTCGTGTCGTCGGCACAG | 6882 | AQTNLSLSSAQ | 11471 | TNLSLSS | 0.336067 | 0.24816 |
| SyS734 | 2294 | GCCCAAGGTCAGTCGAGTGATGAGCGGGCACAG | 6883 | AQGQSSDERAQ | 11472 | GQSSDER | 0.336014 | 0.211316 |
| GS376 | 2295 | GCCCAAACCCACGCACCACCTTCGCCGCACAG | 6884 | AQTHATTFAAQ | 11473 | THATTFA | 0.335849 | -0.02171 |
| SyS736 | 2296 | GCCCAACCAGCCAACAAGACAGAAGCGGCACAG | 6885 | AQTSQQDRSAQ | 11474 | TSQQDRS | 0.335683 | -0.02651 |
| GS377 | 2297 | GCCCAAGCGTTGTTGCATCGTGAGGCGGCACAG | 6886 | AQALLHREAAQ | 11475 | ALLHREA | 0.335641 | -0.13881 |
| SyS737 | 2298 | GCCCAAAATCGAGTGTTACTGCTCTTGCACAG | 6887 | AQNPSVTALAQ | 11476 | NPSVTAL | 0.335537 | -0.07068 |
| SyS738 | 2299 | GCCCAAGTCGCCAACCTCAACAGCAGAGCACAG | 6888 | AQVANLNSRAQ | 11477 | VANLNSR | 0.335302 | -0.03973 |
| SyS739 | 2300 | GCCCAAACCATGCTCCTCGAACCCAAAGCACAG | 6889 | AQTMLLEPKAQ | 11478 | TMLLEPK | 0.335297 | -0.20955 |
| SyS740 | 2301 | GCCCAAAATGTTAGGCCTTGACTTATGCACAG | 6890 | AQNVRPSTYAQ | 11479 | NVRPSTY | 0.335144 | -0.11737 |
| GS379 | 2302 | GCCCAAGTGATTCATATTACGAATACGGCACAG | 6891 | AQVIHITNTAQ | 11480 | VIHITNT | 0.334532 | -0.12797 |
| SyS741 | 2303 | GCCCAAAGCAAGCAACCCCAGCCTCCTCACCGCACAG | 6892 | AQSNPSLLTAQ | 11481 | SNPSLLT | 0.334488 | -0.16466 |
| SyS742 | 2304 | GCCCAATATCAGGATAATGCTAGGCTTGCACAG | 6893 | AQYQDNARLAQ | 11482 | YQDNARL | 0.33435 | -0.22434 |
| SyS743 | 2305 | GCCCAAATCCAAGGCCTCACCCAGCACGCACAG | 6894 | AQIQGLTSHAQ | 11483 | IQGLTSH | 0.334337 | 0.418222 |
| GP106 | 2306 | GCCCAAACTTATAATCAGGGTAAGCAGGCACAG | 6895 | AQTYNQGKQAQ | 11484 | TYNQGKQ | 0.334287 | -0.07398 |
| GS380 | 2307 | GCCCAAGCTCCTACGGGGATGAAGCATGCACAG | 6896 | AQAPTGMKHAQ | 11485 | APTGMKH | 0.334244 | -0.16753 |
| SyS745 | 2308 | GCCCAAATGAGTGGTGAGCTTATTCGTGCACAG | 6897 | AQMSGELIRAQ | 11486 | MSGELIR | 0.333966 | -0.05676 |
| GS381 | 2309 | GCCCAAAGACTCAACACCAGCCACCTCGCACAG | 6898 | AQRLNTSHLAQ | 11487 | RLNTSHL | 0.33391 | 0.026856 |
| SyS746 | 2310 | GCCCAAGCGACGGCTCTGGGGGTGCACAG | 6899 | AQATALAAGAQ | 11488 | ATALAAG | 0.333841 | -0.19618 |
| SyS747 | 2311 | GCCCAACCTATTTCGGGGCTTAAGTCGGCACAG | 6900 | AQPISGLKSAQ | 11489 | PISGLKS | 0.333712 | -0.18245 |
| SyS748 | 2312 | GCCCAAGAGAGCGTACTTTAATCCGGCTGCACAG | 6901 | AQERTFNPAAQ | 11490 | ERTFNPA | 0.333392 | -0.01544 |
| SyS749 | 2313 | GCCCAAATGAGTAATATTTCTAGTGTGTGGCACAG | 6902 | AQMSNISSVAQ | 11491 | MSNISSV | 0.333354 | 0.062249 |

FIG. 33 (Continued)

| | | | | | | | |
|---|---|---|---|---|---|---|---|
| GS382 | 2314 | GCCCAAAGAGAGACGCCAGACTCAGCCCGCACAG | 6903 | AQRDARLSPAQ | 11492 | RDARLSP | 0.332845 | -0.01943 |
| SyS750 | 2315 | GCCCAAGACCACTACGTCAACACCAGAGCACAG | 6904 | AQDHYVNTRAQ | 11493 | DHYVNTR | 0.332785 | -0.19723 |
| SyS752 | 2316 | GCCCAACCTGGGACTGCTGCTGTCGTCTGGCACAG | 6905 | AQPGTAVRLAQ | 11494 | PGTAVRL | 0.332711 | -0.18163 |
| SyS753 | 2317 | GCCCAAGACAAAGGCACCCTCAGCGAAGCACAG | 6906 | AQDKGTLSEAQ | 11495 | DKGTLSE | 0.332541 | -0.08949 |
| GS383 | 2318 | GCCCAATCGATTCCTAGGACGGATAATGCACAG | 6907 | AQSIPRTDNAQ | 11496 | SIPRTDN | 0.332462 | -0.00974 |
| SyS754 | 2319 | GCCCAAGAGAGCCGGTTCTTCATACTGTTGCACAG | 6908 | AQEPVLHTVAQ | 11497 | EPVLHTV | 0.332214 | -0.19739 |
| GS385 | 2320 | GCCCAAGACAGAGCCATCCTCAACAGCGCACAG | 6909 | AQDRAILNSAQ | 11498 | DRAILNS | 0.332175 | -0.04121 |
| SyS755 | 2321 | GCCCAAGAAATCGGCAGCCTCAGACAAGCACAG | 6910 | AQEIGSLRQAQ | 11499 | EIGSLRQ | 0.332133 | -0.16273 |
| SyS756 | 2322 | GCCCAAGCCTTCGTCGGCGGCCACCCCGCACAG | 6911 | AQAFVGATPAQ | 11500 | AFVGATP | 0.332091 | -0.0026 |
| GS386 | 2323 | GCCCAATTCGTCCAAAACAAAGAGACGCCGCACAG | 6912 | AQFVQNKDAAQ | 11501 | FVQNKDA | 0.332078 | -0.07421 |
| SyS758 | 2324 | GCCCAAAGGGATAAAGGCGGGCCTACGGCACAG | 6913 | AQRDKAGPTAQ | 11502 | RDKAGPT | 0.331877 | 0.088605 |
| GS387 | 2325 | GCCCAACTCCTCCCCACCGCCCACAACGCACAG | 6914 | AQLLPTAHNAQ | 11503 | LLPTAHN | 0.331739 | 0.074733 |
| SyS759 | 2326 | GCCCAACCCAACGGCATCACCAGCACCGCACAG | 6915 | AQPNGITSTAQ | 11504 | PNGITST | 0.330938 | -0.07827 |
| GP108 | 2327 | GCCCAATCGGGTGTGACGAAGGGTAGTGCACAG | 6916 | AQSGVTKGSAQ | 11505 | SGVTKGS | 0.330938 | -0.07433 |
| SyS760 | 2328 | GCCCAAATGAACAGCACCATCAGCCACGCACAG | 6917 | AQMNSTISHAQ | 11506 | MNSTISH | 0.330866 | 0.28997 |
| GS389 | 2329 | GCCCAATACAAAAGCGACGTCGGCAGCGCACAG | 6918 | AQYKSDVGSAQ | 11507 | YKSDVGS | 0.330858 | -0.10092 |
| GS390 | 2330 | GCCCAACCGGTGACGCGTGTTAATCTTGCACAG | 6919 | AQPVTRVNLAQ | 11508 | PVTRVNL | 0.330856 | -0.18099 |
| SyS761 | 2331 | GCCCAAAGAAACGTCGCCACGGCCTCGCACAG | 6920 | AQRNVADGLAQ | 11509 | RNVADGL | 0.330693 | 0.111344 |
| GS391 | 2332 | GCCCAAGCTTCGGCTACTTCGATTACTGCACAG | 6921 | AQASATSITAQ | 11510 | ASATSIT | 0.330598 | -0.15766 |
| SyS762 | 2333 | GCCCAAAGCGGCACCGCCAGCAACGTCGCACAG | 6922 | AQSGTASNVAQ | 11511 | SGTASNV | 0.330558 | -0.00713 |
| SyS763 | 2334 | GCCCAACGGCAGGATCTTGGTAGTACTGCACAG | 6923 | AQRQDLGSTAQ | 11512 | RQDLGST | 0.330378 | 0.022044 |
| SyS764 | 2335 | GCCCAAGACAGCGCCCTCATCAGCAAAGCACAG | 6924 | AQDSALISKAQ | 11513 | DSALISK | 0.330309 | -0.10674 |
| SyS765 | 2336 | GCCCAAAACAACGGCCTCAACAGCGCCGCACAG | 6925 | AQNNGLNSAAQ | 11514 | NNGLNSA | 0.329752 | 0.087826 |
| SyS766 | 2337 | GCCCAAGCTGCGAGTGAGCGTCGGATGGCACAG | 6926 | AQAASERRMAQ | 11515 | AASERRM | 0.32966 | -0.15374 |
| GS393 | 2338 | GCCCAACGTCATTCTGCTGTGTGCCTGAGGCACAG | 6927 | AQRHSAVPEAQ | 11516 | RHSAVPE | 0.329584 | -0.11663 |
| GS394 | 2339 | GCCCAATATCAGGATACGAAGGGGCAGGCACAG | 6928 | AQYQDTKGQAQ | 11517 | YQDTKGQ | 0.329332 | -0.01392 |
| SyS767 | 2340 | GCCCAAAAGACTGGGTCGCTGCCTGTGGCACAG | 6929 | AQKTGSLPVAQ | 11518 | KTGSLPV | 0.329312 | -0.0962 |
| SyS768 | 2341 | GCCCAAATTGCGCGGAGTGTGTCTATGGCACAG | 6930 | AQIARSVSMAQ | 11519 | IARSVSM | 0.32924 | 0.053318 |
| SyS769 | 2342 | GCCCAACCCAGCAGCAAACTCCCCTCGCACAG | 6931 | AQPSSKLPLAQ | 11520 | PSSKLPL | 0.329108 | -0.01365 |
| SyS770 | 2343 | GCCCAAATCAACGACCAAAGAATCAGCGCACAG | 6932 | AQINDQRISAQ | 11521 | INDQRIS | 0.328822 | -0.05944 |
| GS396 | 2344 | GCCCAAGGTATTTCTGAGAAGACTTCTGCACAG | 6933 | AQGISEKTSAQ | 11522 | GISEKTS | 0.328727 | -0.03473 |
| GS397 | 2345 | GCCCAAACTAGTGCTTATACTTCGGTGGCACAG | 6934 | AQTSAYTSVAQ | 11523 | TSAYTSV | 0.328529 | -0.09069 |

FIG. 33 (Continued)

| | | | | | | | | |
|---|---|---|---|---|---|---|---|---|
| SyS771 | 2346 | GCCCAAGGCACCCTCCACAGCAGCGCCGCACAG | 6935 | AQGTLHSSAAQ | 11524 | GTLHSSA | 0.328517 | 0.041441 |
| SyS772 | 2347 | GCCCAAGCCCCCAGAGACGCCGCAGCGCACAG | 6936 | AQAPRDAASAQ | 11525 | APRDAAS | 0.328496 | -0.12465 |
| GS398 | 2348 | GCCCAAAATAATACTGCTATGAGTCTTGCACAG | 6937 | AQNNTAMSLAQ | 11526 | NNTAMSL | 0.328406 | -0.11076 |
| SyS774 | 2349 | GCCCAAATCCTCAGAGTCGCCGACGCCGCACAG | 6938 | AQILRVADAAQ | 11527 | ILRVADA | 0.328209 | 0.007753 |
| SyS775 | 2350 | GCCCAAGCCAGCGTCGCCGGCGGCCAGCGCACAG | 6939 | AQASVAGASAQ | 11528 | ASVAGAS | 0.328202 | -0.18527 |
| SyS776 | 2351 | GCCCAAAGGCGTCCTCAACGGCCAGCAAAGCACAG | 6940 | AQSVLNGSKAQ | 11529 | SVLNGSK | 0.328132 | 0.135186 |
| SyS777 | 2352 | GCCCAAATTTATCAGACGGCTTCTGCGGGCACAG | 6941 | AQIYQTASAAQ | 11530 | IYQTASA | 0.328046 | 0.09508 |
| SyS778 | 2353 | GCCCAAACCAGCGAAAGAACCCAATTCGCACAG | 6942 | AQTSERTQFAQ | 11531 | TSERTQF | 0.327984 | 0.021394 |
| SyS780 | 2354 | GCCCAAAGCACCGTCGCCCTCACCAGCGCACAG | 6943 | AQSTVALTSAQ | 11532 | STVALTS | 0.327951 | 0.008571 |
| SyP45 | 2355 | GCCCAAGGGAATACGGTGATTAATGCGGCACAG | 6944 | AQGNTVINAAQ | 11533 | GNTVINA | 0.32791 | -0.03915 |
| SyS781 | 2356 | GCCCAACCCCTCGGCAGCATCGTCACCGCACAG | 6945 | AQPLGSIVTAQ | 11534 | PLGSIVT | 0.327886 | -0.17799 |
| GS399 | 2357 | GCCCAACTCAGAATGAGCGACAGCTTCGCACAG | 6946 | AQLRMSDSFAQ | 11535 | LRMSDSF | 0.327847 | -0.16304 |
| GS400 | 2358 | GCCCAAACCAGCGAAAGCGGCACCCTCGCACAG | 6947 | AQTSESGTLAQ | 11536 | TSESGTL | 0.327847 | -0.16304 |
| SyS782 | 2359 | GCCCAAGAGGCGACGCCGGCCTGTTCGGGCACAG | 6948 | AQEATRPVRAQ | 11537 | EATRPVR | 0.327835 | -0.14041 |
| SyS783 | 2360 | GCCCAAAATAAGCAGTTTTTGGCTGATGCACAG | 6949 | AQNKQFLADAQ | 11538 | NKQFLAD | 0.327749 | -0.0825 |
| SyS784 | 2361 | GCCCAACTCACCATCAGAGACAACGTCGCACAG | 6950 | AQLTIRDNVAQ | 11539 | LTIRDNV | 0.327594 | -0.05797 |
| SyS785 | 2362 | GCCCAAGTTGGGTCTGGGCTTGCTAAGGCACAG | 6951 | AQVGSGLAKAQ | 11540 | VGSGLAK | 0.327594 | -0.13314 |
| GS401 | 2363 | GCCCAACAAAACGCCACCAACCTCATGGCACAG | 6952 | AQQNATNLMAQ | 11541 | QNATNLM | 0.327526 | -0.04297 |
| GS402 | 2364 | GCCCAATCTATGTATGCTGGGCATGAGGCACAG | 6953 | AQSMYAGHEAQ | 11542 | SMYAGHE | 0.327425 | -0.18637 |
| SyS786 | 2365 | GCCCAAATGGTCAACAGCGAAAAAGCCGCACAG | 6954 | AQMVNSEKAAQ | 11543 | MVNSEKA | 0.327321 | 0.005673 |
| GP109 | 2366 | GCCCAACGTATGAGTATGCGGTCTGATGCACAG | 6955 | AQRMSMRSDAQ | 11544 | RMSMRSD | 0.327321 | -0.07169 |
| SyS787 | 2367 | GCCCAAGCAGCAGCGGCCTCAACAAAGCACAG | 6956 | AQSSSGLNKAQ | 11545 | SSSGLNK | 0.327268 | 0.120372 |
| SyS788 | 2368 | GCCCAACAAAGCAGCGTCCTCACCCCGCACAG | 6957 | AQQSSVLTPAQ | 11546 | QSSVLTP | 0.327119 | 0.083873 |
| SyS790 | 2369 | GCCCAAACTCCTAATTTGGAGACTAGTGCACAG | 6958 | AQTPNLETSAQ | 11547 | TPNLETS | 0.326877 | -0.12871 |
| GS406 | 2370 | GCCCAAATGCGTGGTACTCTTTCGATGGCACAG | 6959 | AQMRGTLSMAQ | 11548 | MRGTLSM | 0.326812 | -0.15383 |
| SyS791 | 2371 | GCCCAAGATCATGGTGCTAGTCTTCCTGCACAG | 6960 | AQDHGASLPAQ | 11549 | DHGASLP | 0.326678 | -0.18648 |
| SyS792 | 2372 | GCCCAATCTCATTTGGCGACGCCGAAGGCACAG | 6961 | AQSHLATPKAQ | 11550 | SHLATPK | 0.326626 | -0.14162 |
| SyS793 | 2373 | GCCCAAATCTGATGCGTCGCCGCATCGGCAGGCACAG | 6962 | AQSDASHRQAQ | 11551 | SDASHRQ | 0.326591 | -0.09677 |
| SyS794 | 2374 | GCCCAAACCGGCACCGAAAGACTCAGCGCACAG | 6963 | AQTGTERLSAQ | 11552 | TGTERLS | 0.326591 | -0.09677 |
| SyS795 | 2375 | GCCCAAGCCGTCGGCCACGTCGGCCCCGCACAG | 6964 | AQAVGHVGPAQ | 11553 | AVGHVGP | 0.326533 | -0.06025 |
| SyS796 | 2376 | GCCCAACAACAAGCCAACAGGGCGTCAAAGCACAG | 6965 | AQQSQQGVKAQ | 11554 | QSQQGVK | 0.326127 | 0.155451 |
| SyS798 | 2377 | GCCCAAAATCTTACGATTAGTAATCGGGCACAG | 6966 | AQNLTISNRAQ | 11555 | NLTISNR | 0.325983 | -0.18861 |

FIG. 33 (Continued)

| | | | | | | | | |
|---|---|---|---|---|---|---|---|---|
| SyS799 | 2378 | GCCCAAGTCAGCAGCGGGCTACGAAACCGCACAG | 6967 | AQVSSGYETAQ | 11556 | VSSGYET | 0.325948 | -0.01693 |
| SyS800 | 2379 | GCCCAATCGATTTCTCCTCGTACGGCACAG | 6968 | AQSISPPRTAQ | 11557 | SISPPRT | 0.325816 | -0.0841 |
| SyS801 | 2380 | GCCCAACCCTACAACCAAAGCCCAGCGCACAG | 6969 | AQPYNQSPSAQ | 11558 | PYNQSPS | 0.325728 | -0.10729 |
| GS411 | 2381 | GCCCAAACGATGTCGTATAATACTAATGCACAG | 6970 | AQTMSYNTNAQ | 11559 | TMSYNTN | 0.325719 | -0.16035 |
| GS412 | 2382 | GCCCAAGGCGCCTACACACCGTCAGCGCACAG | 6971 | AQGAYNTVSAQ | 11560 | GAYNTVS | 0.32537 | -0.10423 |
| GS413 | 2383 | GCCCAATCGAAGGTTACGCCTCCTCTGGCACAG | 6972 | AQSKVTPPLAQ | 11561 | SKVTPPL | 0.325307 | -0.111 |
| SyS803 | 2384 | GCCCAAAGATTCAGAGAAAACGACCACGCACAG | 6973 | AQRFRENDHAQ | 11562 | RFRENDH | 0.325231 | 0.023208 |
| SyS804 | 2385 | GCCCAATTGGATACTGGGCAGCCGACGGCACAG | 6974 | AQLDTGQPTAQ | 11563 | LDTGQPT | 0.325094 | -0.12829 |
| GS414 | 2386 | GCCCAACTTCGTCGACTCGCGAGAATGCACAG | 6975 | AQLPSTPQNAQ | 11564 | LPSTPQN | 0.325044 | -0.06588 |
| SyS805 | 2387 | GCCCAAACCCTCAGCTACGTCACCAGCGCACAG | 6976 | AQTLSYVTSAQ | 11565 | TLSYVTS | 0.324951 | -0.18042 |
| SyS806 | 2388 | GCCCAAAGCACCACCGTCCTCCCGTCGCACAG | 6977 | AQSTTVLPVAQ | 11566 | STTVLPV | 0.324892 | -0.0659 |
| SyS807 | 2389 | GCCCAAATGACGCATACGCTTTGAGTGCACAG | 6978 | AQMTHTLLSAQ | 11567 | MTHTLLS | 0.324713 | -0.08142 |
| GS415 | 2390 | GCCCAAAGCACCTACAACAAAACCTTCGCACAG | 6979 | AQSTYNKTFAQ | 11568 | STYNKTF | 0.324696 | -0.13571 |
| GS416 | 2391 | GCCCAAGCGGACGTCGAGTCATACGCTGGCACAG | 6980 | AQATSSHTLAQ | 11569 | ATSSHTL | 0.324696 | -0.13571 |
| SyS808 | 2392 | GCCCAAAGACTCAACGGCACCGAACCCGCACAG | 6981 | AQRLNGTEPAQ | 11570 | RLNGTEP | 0.32462 | 0.318751 |
| SS55 | 2393 | GCCCAACAACAGCCAACACCCCACCAAAGCACAG | 6982 | AQQANTPTKAQ | 11571 | QANTPTK | 0.324608 | -0.31402 |
| SyS809 | 2394 | GCCCAAAGCGCCGTCATCAACAGCAGCGCACAG | 6983 | AQSAVINSSAQ | 11572 | SAVINSS | 0.324458 | 0.174798 |
| SyS810 | 2395 | GCCCAAAACCACGGCAACGAAGTCAAAGCACAG | 6984 | AQNHGNEVKAQ | 11573 | NHGNEVK | 0.324286 | 0.277768 |
| GS417 | 2396 | GCCCAAAAGCATCTGTCGCATGATCCGGCACAG | 6985 | AQKHLSHDPAQ | 11574 | KHLSHDP | 0.324246 | -0.0337 |
| GP110 | 2397 | GCCCAATTGGGGTCGGGTAGGATGGCTGCACAG | 6986 | AQLGSGRMAAQ | 11575 | LGSGRMA | 0.324054 | 0.229744 |
| GS418 | 2398 | GCCCAAAGCAACCAAATCACCATCGTCGCACAG | 6987 | AQSNQITIVAQ | 11576 | SNQITIV | 0.324029 | -0.0065 |
| SyS811 | 2399 | GCCCAAGGTGGTAGGGGTGTGGGTATGGCACAG | 6988 | AQGGRGVGMAQ | 11577 | GGRGVGM | 0.323942 | -0.12991 |
| SyS812 | 2400 | GCCCAATTCGTCACCGAAAGCAAAAGCGCACAG | 6989 | AQFVTESKSAQ | 11578 | FVTESKS | 0.323852 | -0.0172 |
| SyS813 | 2401 | GCCCAAAACAGCGTCCACAACGACCTCGCACAG | 6990 | AQNSVHNDLAQ | 11579 | NSVHNDL | 0.323841 | -0.12222 |
| SyS814 | 2402 | GCCCAAAGCCCCCAACAAAGCAGATACGCACAG | 6991 | AQSPQQSRYAQ | 11580 | SPQQSRY | 0.323644 | -0.10768 |
| SyS815 | 2403 | GCCCAAACTCAGCCTAATCATGATTCTGCACAG | 6992 | AQTQPNHDSAQ | 11581 | TQPNHDS | 0.323393 | -0.13686 |
| SyS816 | 2404 | GCCCAAACGAGGCTGAATGAGGTGACTGCACAG | 6993 | AQTRLNEVTAQ | 11582 | TRLNEVT | 0.323308 | 0.334916 |
| GP111 | 2405 | GCCCAAACGGCGCAGCGTACTAATGTTGCACAG | 6994 | AQTAQRTNVAQ | 11583 | TAQRTNV | 0.323198 | -0.07405 |
| GS419 | 2406 | GCCCAACCCGGCAGAAGCCCCACCACCGCACAG | 6995 | AQPGRSPTTAQ | 11584 | PGRSPTT | 0.322786 | 0.116763 |
| SyS817 | 2407 | GCCCAAGCCTACAGCGTCGTCGAGAGGCGCACAG | 6996 | AQAYSVVRGAQ | 11585 | AYSVVRG | 0.322605 | -0.20462 |
| SyS819 | 2408 | GCCCAAGTTGGTCCGGTGCTTTCTAGGGCACAG | 6997 | AQVGPVLSRAQ | 11586 | VGPVLSR | 0.322462 | -0.09823 |
| GS420 | 2409 | GCCCAAACCAAAATGGGCACCCCAACGCACAG | 6998 | AQTKMGTPNAQ | 11587 | TKMGTPN | 0.322339 | -0.18099 |

FIG. 33 (Continued)

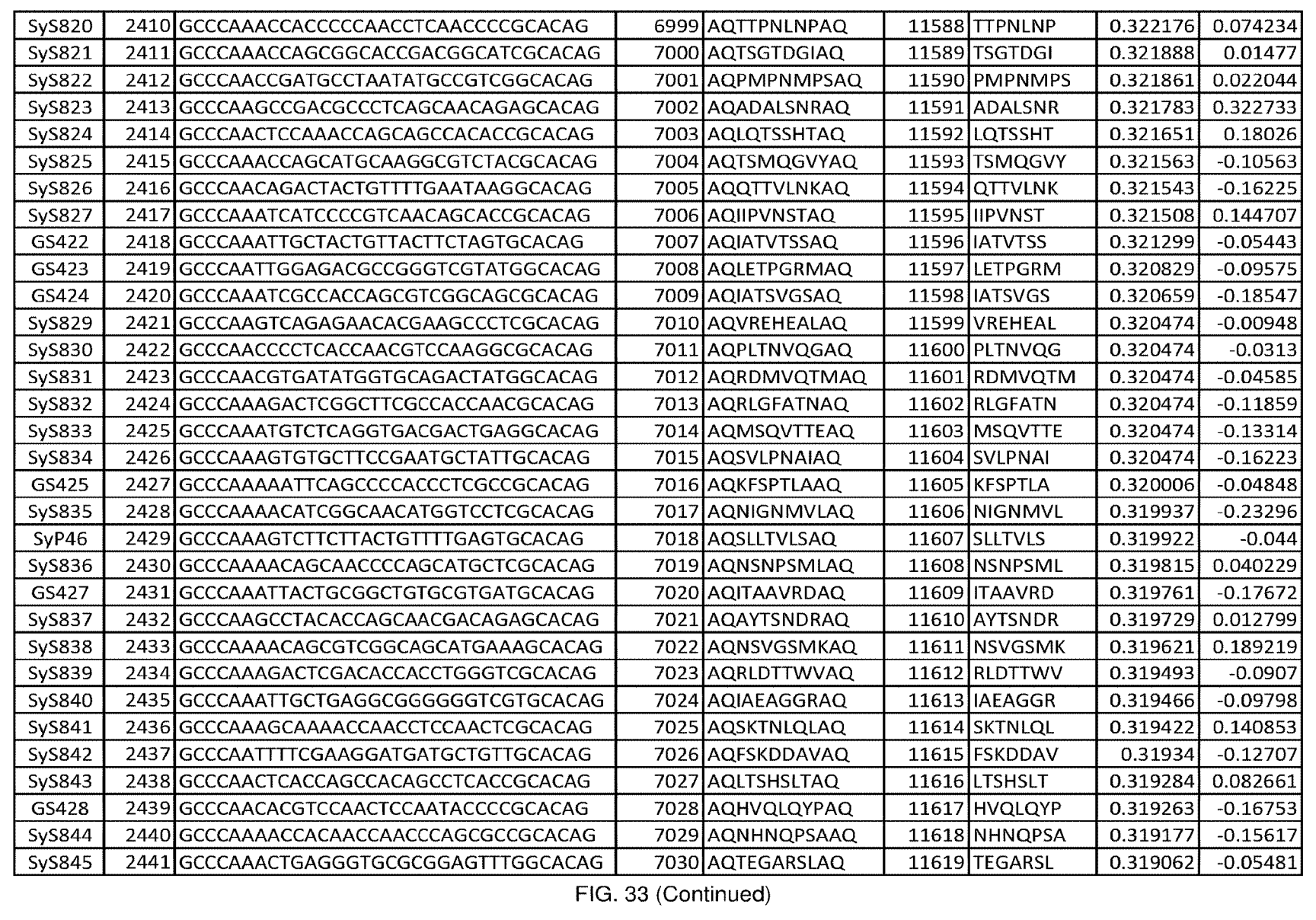

| | | | | | | | | |
|---|---|---|---|---|---|---|---|---|
| SyS820 | 2410 | GCCCAAACCACCCCCAACCTCAACCCGCACAG | 6999 | AQTTPNLNPAQ | 11588 | TTPNLNP | 0.322176 | 0.074234 |
| SyS821 | 2411 | GCCCAAACCAGCGGCACCGACGGCATCGCACAG | 7000 | AQTSGTDGIAQ | 11589 | TSGTDGI | 0.321888 | 0.01477 |
| SyS822 | 2412 | GCCCAACCGATGCCTAATATGCCGTCGGCACAG | 7001 | AQPMPNMPSAQ | 11590 | PMPNMPS | 0.321861 | 0.022044 |
| SyS823 | 2413 | GCCCAAGCCGACGCCCTCAGCAACAGAGCACAG | 7002 | AQADALSNRAQ | 11591 | ADALSNR | 0.321783 | 0.322733 |
| SyS824 | 2414 | GCCCAACTCCAAACCAGCAGCCACACCGCACAG | 7003 | AQLQTSSHTAQ | 11592 | LQTSSHT | 0.321651 | 0.18026 |
| SyS825 | 2415 | GCCCAAACCAGCATGCAAGGCGTCTACGCACAG | 7004 | AQTSMQGVYAQ | 11593 | TSMQGVY | 0.321563 | -0.10563 |
| SyS826 | 2416 | GCCCAACAGACTACTGTTTGAATAAGGCACAG | 7005 | AQQTTVLNKAQ | 11594 | QTTVLNK | 0.321543 | -0.16225 |
| SyS827 | 2417 | GCCCAAATCATCCCGTCAACAGCACCGCACAG | 7006 | AQIIPVNSTAQ | 11595 | IIPVNST | 0.321508 | 0.144707 |
| GS422 | 2418 | GCCCAAATTGCTACTGTTACTTCTAGTGCACAG | 7007 | AQIATVTSSAQ | 11596 | IATVTSS | 0.321299 | -0.05443 |
| GS423 | 2419 | GCCCAATTGGAGACGCCGGGTCGTATGGCACAG | 7008 | AQLETPGRMAQ | 11597 | LETPGRM | 0.320829 | -0.09575 |
| GS424 | 2420 | GCCCAAATCGCCACCAGCGTCGGCAGCGCACAG | 7009 | AQIATSVGSAQ | 11598 | IATSVGS | 0.320659 | -0.18547 |
| SyS829 | 2421 | GCCCAAGTCAGAGAACACGAAGCCCTCGCACAG | 7010 | AQVREHEALAQ | 11599 | VREHEAL | 0.320474 | -0.00948 |
| SyS830 | 2422 | GCCCAACCCCTCACCAACGTCCAAGGGCACAG | 7011 | AQPLTNVQGAQ | 11600 | PLTNVQG | 0.320474 | -0.0313 |
| SyS831 | 2423 | GCCCAACGTGATATGGTGCAGACTATGGCACAG | 7012 | AQRDMVQTMAQ | 11601 | RDMVQTM | 0.320474 | -0.04585 |
| SyS832 | 2424 | GCCCAAAGACTCGGCTTCGCCACCAACGCACAG | 7013 | AQRLGFATNAQ | 11602 | RLGFATN | 0.320474 | -0.11859 |
| SyS833 | 2425 | GCCCAAATGTCTCAGGTGACGACTGAGGCACAG | 7014 | AQMSQVTTEAQ | 11603 | MSQVTTE | 0.320474 | -0.13314 |
| SyS834 | 2426 | GCCCAAAGTGTGCTTCCGAATGCTATTGCACAG | 7015 | AQSVLPNAIAQ | 11604 | SVLPNAI | 0.320474 | -0.16223 |
| GS425 | 2427 | GCCCAAAAAATTCAGCCCACCCTCGCCGCACAG | 7016 | AQKFSPTLAAQ | 11605 | KFSPTLA | 0.320006 | -0.04848 |
| SyS835 | 2428 | GCCCAAAACATCGGCAACATGGTCCTCGCACAG | 7017 | AQNIGNMVLAQ | 11606 | NIGNMVL | 0.319937 | -0.23296 |
| SyP46 | 2429 | GCCCAAAGTCTCTTACTGTTTGAGTGCACAG | 7018 | AQSLLTVLSAQ | 11607 | SLLTVLS | 0.319922 | -0.044 |
| SyS836 | 2430 | GCCCAAAACAGCAACCCCAGCATGCTCGCACAG | 7019 | AQNSNPSMLAQ | 11608 | NSNPSML | 0.319815 | 0.040229 |
| GS427 | 2431 | GCCCAAATTACTGCGGCGTGTGCGTGATGCACAG | 7020 | AQITAAVRDAQ | 11609 | ITAAVRD | 0.319761 | -0.17672 |
| SyS837 | 2432 | GCCCAAGCCTACACCAGCAACGACAGAGCACAG | 7021 | AQAYTSNDRAQ | 11610 | AYTSNDR | 0.319729 | 0.012799 |
| SyS838 | 2433 | GCCCAAAACAGCGTCGGCAGCATGAAAGCACAG | 7022 | AQNSVGSMKAQ | 11611 | NSVGSMK | 0.319621 | 0.189219 |
| SyS839 | 2434 | GCCCAAAGACTCGACACCACCTGGGTCGCACAG | 7023 | AQRLDTTWVAQ | 11612 | RLDTTWV | 0.319493 | -0.0907 |
| SyS840 | 2435 | GCCCAAATTGCTGAGGCGGCGGGGGGTCGTGCACAG | 7024 | AQIAEAGGRAQ | 11613 | IAEAGGR | 0.319466 | -0.09798 |
| SyS841 | 2436 | GCCCAAAGCAAAACCAACCTCCAACTCGCACAG | 7025 | AQSKTNLQLAQ | 11614 | SKTNLQL | 0.319422 | 0.140853 |
| SyS842 | 2437 | GCCCAATTTTCGAAGGATGATGCTGTTGCACAG | 7026 | AQFSKDDAVAQ | 11615 | FSKDDAV | 0.31934 | -0.12707 |
| SyS843 | 2438 | GCCCAACTCACCAGCCACCAGAGCCTCACCGCACAG | 7027 | AQLTSHSLTAQ | 11616 | LTSHSLT | 0.319284 | 0.082661 |
| GS428 | 2439 | GCCCAACACGTCCAACTCCAATACCCCGCACAG | 7028 | AQHVQLQYPAQ | 11617 | HVQLQYP | 0.319263 | -0.16753 |
| SyS844 | 2440 | GCCCAAAACCACAACCACCAACCCAGCGCCGCACAG | 7029 | AQNHNQPSAAQ | 11618 | NHNQPSA | 0.319177 | -0.15617 |
| SyS845 | 2441 | GCCCAAACTGAGGGTGCGCGGAGTTTGGCACAG | 7030 | AQTEGARSLAQ | 11619 | TEGARSL | 0.319062 | -0.05481 |

FIG. 33 (Continued)

| ID | No. | Sequence | No. | Peptide | No. | Peptide | Value 1 | Value 2 |
|---|---|---|---|---|---|---|---|---|
| SyS846 | 2442 | GCCCAAAACCAAAGGCGACAGCAAAGTCGCACAG | 7031 | AQNQSDSKVAQ | 11620 | NQSDSKV | 0.319021 | 0.002646 |
| SyS847 | 2443 | GCCCAAGTGAGTCTTCCGCTGGCTCCGGCACAG | 7032 | AQVSLPLAPAQ | 11621 | VSLPLAP | 0.319021 | -0.17799 |
| GS429 | 2444 | GCCCAAAACAACAACCAACCTCAGCAGAGCACAG | 7033 | AQNNTNLSRAQ | 11622 | NNTNLSR | 0.318597 | 0.099602 |
| GP113 | 2445 | GCCCAATATTCGAATAGTAATAATCATGCACAG | 7034 | AQYSNSNNHAQ | 11623 | YSNSNNH | 0.31847 | -0.07259 |
| SyS848 | 2446 | GCCCAAGGCCTCGAAACCAGACTCCACGCACAG | 7035 | AQGLETRLHAQ | 11624 | GLETRLH | 0.318311 | -0.01832 |
| SyS849 | 2447 | GCCCAACTGACTACTACTGAGTCTAAGGCACAG | 7036 | AQLTTTESKAQ | 11625 | LTTTESK | 0.318126 | -0.13556 |
| SyS850 | 2448 | GCCCAAATGGGCGCCAGAATGCCCCTCGCACAG | 7037 | AQMGARMPLAQ | 11626 | MGARMPL | 0.317628 | 0.100846 |
| SyS851 | 2449 | GCCCAAAGTCATGATCATATGCTTATTGCACAG | 7038 | AQSHDHMLIAQ | 11627 | SHDHMLI | 0.317559 | -0.1792 |
| SyS852 | 2450 | GCCCAACGTACTGAGGGTTCGGATAATGCACAG | 7039 | AQRTEGSDNAQ | 11628 | RTEGSDN | 0.317519 | -0.08748 |
| SyS853 | 2451 | GCCCAAAATTTTCAGCGTGATGGGCCGGCACAG | 7040 | AQNFQRDGPAQ | 11629 | NFQRDGP | 0.317429 | -0.00904 |
| SyS854 | 2452 | GCCCAACTTTCGAATATTAATCCGCATGCACAG | 7041 | AQLSNINPHAQ | 11630 | LSNINPH | 0.317372 | -0.0216 |
| SyS855 | 2453 | GCCCAAAGCAGCAACCACCAGCAGAGCACAG | 7042 | AQSSNHTSRAQ | 11631 | SSNHTSR | 0.317335 | 0.288709 |
| SyS856 | 2454 | GCCCAAATGCACGTCAACGCCAGCCCGCACAG | 7043 | AQMHVNASPAQ | 11632 | MHVNASP | 0.317257 | 0.128729 |
| SyS857 | 2455 | GCCCAATGGGATTCGTTGGCTGCGCGGCACAG | 7044 | AQWDSLAAPAQ | 11633 | WDSLAAP | 0.317054 | -0.1295 |
| SyS858 | 2456 | GCCCAACTGGATGGTGCGCATAATGCGGCACAG | 7045 | AQLDGAHNAAQ | 11634 | LDGAHNA | 0.316943 | -0.13677 |
| GS436 | 2457 | GCCCAATCGATTAGGAGTCCGCCTCCTGCACAG | 7046 | AQSIRSPPPAQ | 11635 | SIRSPPP | 0.31688 | -0.15407 |
| GS437 | 2458 | GCCCAAAATGGGACGCTGAAGGGGTTGGCACAG | 7047 | AQNGTLKGLAQ | 11636 | NGTLKGL | 0.316732 | -0.08754 |
| SyS859 | 2459 | GCCCAATTTTATCAGGAGCAGTCTTTGGCACAG | 7048 | AQFYQEQSLAQ | 11637 | FYQEQSL | 0.316697 | -0.15132 |
| SyS860 | 2460 | GCCCAATACGACCAAAAAAGCCTCGCCGCACAG | 7049 | AQYDQKSLAAQ | 11638 | YDQKSLA | 0.316591 | -0.02956 |
| GP114 | 2461 | GCCCAACTGTCGACGAATCGTACTTTTGCACAG | 7050 | AQLSTNRTFAQ | 11639 | LSTNRTF | 0.31655 | -0.07398 |
| GS439 | 2462 | GCCCAAAAACAAACCAAGACAGCAGCGCACAG | 7051 | AQKQTQDSSAQ | 11640 | KQTQDSS | 0.316176 | -0.04007 |
| GS440 | 2463 | GCCCAATATGAGCGGGGGCCTCAGATGGCACAG | 7052 | AQYERGPQMAQ | 11641 | YERGPQM | 0.315854 | -0.17291 |
| SyS862 | 2464 | GCCCAAACCCACGCCAACAGCGTCAGAGCACAG | 7053 | AQTHANSVRAQ | 11642 | THANSVR | 0.315781 | -0.07488 |
| GS441 | 2465 | GCCCAAAGTATGAATACTAATGCTTCTGCACAG | 7054 | AQSMNTNASAQ | 11643 | SMNTNAS | 0.315733 | -0.12336 |
| SyS863 | 2466 | GCCCAACTTGATAATGAGAAGGGAGGGCACAG | 7055 | AQLDNEKGRAQ | 11644 | LDNEKGR | 0.315543 | 0.058188 |
| GS442 | 2467 | GCCCAACTCGGCCAACTCCTCCAAAGCGCACAG | 7056 | AQLGQLLQSAQ | 11645 | LGQLLQS | 0.315509 | -0.16214 |
| SyS864 | 2468 | GCCCAAATGCGGATGCCTGTTAATATGGCACAG | 7057 | AQMRMPVNMMAQ | 11646 | MRMPVNM | 0.315482 | -0.20224 |
| GS443 | 2469 | GCCCAAGGCACCAGCAACCTCCCCAGCGCACAG | 7058 | AQGTSNLPSAQ | 11647 | GTSNLPS | 0.314909 | -0.13702 |
| GS444 | 2470 | GCCCAAGAGGGGGAGATGAAGTCTCCGGCACAG | 7059 | AQEGEMKSPAQ | 11648 | EGEMKSP | 0.31482 | -0.1646 |
| SyS865 | 2471 | GCCCAACAGCTGGGGCATGATAATCGGGCACAG | 7060 | AQQLGHDNRAQ | 11649 | QLGHDNR | 0.314814 | -0.11961 |
| SyS866 | 2472 | GCCCAACTGGATGATTCTGCGGGGAGGGCACAG | 7061 | AQLDDSAGRAQ | 11650 | LDDSAGR | 0.314701 | -0.11941 |
| SyS867 | 2473 | GCCCAAAACTGGTGCTGGTAATGGGCGGGCACAG | 7062 | AQTGAGNGRAQ | 11651 | TGAGNGR | 0.314656 | -0.01667 |

FIG. 33 (Continued)

| | | | | | | | | |
|---|---|---|---|---|---|---|---|---|
| SyS868 | GCCCAAAAACACCGGCGGCCGCCATGATGGCACAG | 2474 | AQNTGAAMMAQ | 7063 | NTGAAMM | 11652 | 0.314631 | 0.055763 |
| GS446 | GCCCAAATGGGGGCGGAATACGTCTGTTGCACAG | 2475 | AQMGANTSVAQ | 7064 | MGANTSV | 11653 | 0.314385 | -0.08188 |
| SyS869 | GCCCAACCCAGCACCCACGGCGGCAGCGCACAG | 2476 | AQPSTHGGSAQ | 7065 | PSTHGGS | 11654 | 0.314357 | -0.1889 |
| SyS870 | GCCCAAATGCCTCAGTCGCAGCCGAATGCACAG | 2477 | AQMPQSQPNAQ | 7066 | MPQSQPN | 11655 | 0.31424 | 0.015982 |
| SyS871 | GCCCAATCTACTCAGGCTAGGCGACGGCACAG | 2478 | AQSTQARLTAQ | 7067 | STQARLT | 11656 | 0.314143 | -0.15374 |
| SyS872 | GCCCAAAGCGAATACCTCCTCAACCCCGCACAG | 2479 | AQSEYLLNPAQ | 7068 | SEYLLNP | 11657 | 0.314087 | -0.19618 |
| SyS873 | GCCCAAACTACTGGTCCTGGGCTGAATGCACAG | 2480 | AQTTGPGLNAQ | 7069 | TTGPGLN | 11658 | 0.314048 | 0.103567 |
| GS449 | GCCCAACCTGGGAGTTCTGGTGTCTTATGCACAG | 2481 | AQPGSSVSYAQ | 7070 | PGSSVSY | 11659 | 0.313645 | -0.14868 |
| GS450 | GCCCAATATTTTGGGTCGGCGCAGGAGGCACAG | 2482 | AQYFGSAQEAQ | 7071 | YFGSAQE | 11660 | 0.313586 | -0.17958 |
| GS451 | GCCCAAGCCGTCATCAACAACGCCACCGCACAG | 2483 | AQAVINNATAQ | 7072 | AVINNAT | 11661 | 0.313428 | -0.0842 |
| SyS874 | GCCCAAGTCGCCATGCAAGACAAAAAAGCACAG | 2484 | AQVAMQDKKAQ | 7073 | VAMQDKK | 11662 | 0.313354 | -0.14041 |
| SyS875 | GCCCAAGCGGATAATATGAATATTAAGGCACAG | 2485 | AQADNMNIKAQ | 7074 | ADNMNIK | 11663 | 0.313295 | -0.07009 |
| GP115 | GCCCAAGGCGGGGACGACTGATTCTGCACAG | 2486 | AQGRATTDSAQ | 7075 | GRATTDS | 11664 | 0.313279 | -0.07065 |
| SyS876 | GCCCAAATGAACCTCCACCTCAAAGGGCACAG | 2487 | AQMNLHLKGAQ | 7076 | MNLHLKG | 11665 | 0.313136 | 0.083677 |
| TS152 | GCCCAATCGAATCAGATTCGTGATTCGGCACAG | 2488 | AQSNQIRDSAQ | 7077 | SNQIRDS | 11666 | 0.313116 | -0.32301 |
| SyS877 | GCCCAAGTTAATGGTCAGAGTACGCCTGCACAG | 2489 | AQVNGQSTPAQ | 7078 | VNGQSTP | 11667 | 0.313037 | -0.00962 |
| SyS878 | GCCCAAATTCTTCCTCAGTTGAATTCGGCACAG | 2490 | AQILPQLNSAQ | 7079 | ILPQLNS | 11668 | 0.312954 | -0.03559 |
| SyS879 | GCCCAAGTCCAAGACAGCCTCCACTTCGCACAG | 2491 | AQVQDSLHFAQ | 7080 | VQDSLHF | 11669 | 0.312874 | 0.083873 |
| SyS880 | GCCCAAGACGTCAGCAACAGAAACAACGCACAG | 2492 | AQDVSNRNNAQ | 7081 | DVSNRNN | 11670 | 0.312493 | -0.15411 |
| GP116 | GCCCAAGATGCTAGTCATGGTTCTAGTGCACAG | 2493 | AQDASHGSSAQ | 7082 | DASHGSS | 11671 | 0.312276 | -0.07391 |
| SyS881 | GCCCAACGGGCGAGTGCTCATCCGCGGCACAG | 2494 | AQRASAHPPAQ | 7083 | RASAHPP | 11672 | 0.312043 | -0.11646 |
| SyS882 | GCCCAACCCAGCCCTCGAGCGCGACGCACAG | 2495 | AQPSLRALDAQ | 7084 | PSLRALD | 11673 | 0.311957 | -0.17678 |
| SyS883 | GCCCAAGATAAGACGCCTCCGGTTGCTGCACAG | 2496 | AQDKTPPVAAQ | 7085 | DKTPPVA | 11674 | 0.311957 | -0.17678 |
| SyS884 | GCCCAACTTAATGATGTTACGACTAGGGCACAG | 2497 | AQLNDVTTRAQ | 7086 | LNDVTTR | 11675 | 0.311619 | -0.20586 |
| SyS885 | GCCCAAGGCGCCAGCAACGCCCAAGCCGCACAG | 2498 | AQGASNAQAAQ | 7087 | GASNAQA | 11676 | 0.311537 | 0.290108 |
| SyS886 | GCCCAAAATGGGTCGCGGGATGCGTTGGCACAG | 2499 | AQNGSRDALAQ | 7088 | NGSRDAL | 11677 | 0.311371 | 0.125773 |
| GS452 | GCCCAATACGGCGTCGAAAGAATGAGCGCACAG | 2500 | AQYGVERMSAQ | 7089 | YGVERMS | 11678 | 0.311356 | -0.04604 |
| GS453 | GCCCAAGCCAAAGTGCCAGCAGCTTCGCACAG | 2501 | AQAKVASSFAQ | 7090 | AKVASSF | 11679 | 0.311335 | -0.04098 |
| SyS887 | GCCCAACATAAGCAGATTCTGTTGGATGCACAG | 2502 | AQHKQILLDAQ | 7091 | HKQILLD | 11680 | 0.311304 | -0.10069 |
| SyS888 | GCCCAAGACAGAGAATCGACAGAATCGCACAG | 2503 | AQDRANDRIAQ | 7092 | DRANDRI | 11681 | 0.311232 | 0.08751 |
| GS454 | GCCCAAAAAATGAGCACCACCATGCTCGCACAG | 2504 | AQKMSTTMLAQ | 7093 | KMSTTML | 11682 | 0.31117 | -0.1003 |
| SyS889 | GCCCAAGGCGGCGAAAACGCGTCATCGCACAG | 2505 | AQGGENGVIAQ | 7094 | GGENGVI | 11683 | 0.310602 | -0.15011 |

FIG. 33 (Continued)

| | | | | | | | | |
|---|---|---|---|---|---|---|---|---|
| SyS890 | 2506 | GCCCAAGTTACGCGAGACTCTGATTTCGGCACAG | 7095 | AQVTQTLISAQ | 11684 | VTQTLIS | 0.310505 | -0.17799 |
| SyS891 | 2507 | GCCCAACTGTATACTAAGGCTCTGATTGCACAG | 7096 | AQLYTKALIAQ | 11685 | LYTKALI | 0.310465 | -0.10161 |
| GS455 | 2508 | GCCCAAACCCTCCCGGCCACAACAGAGCACAG | 7097 | AQTLPGHNRAQ | 11686 | TLPGHNR | 0.310262 | -0.1756 |
| SyS892 | 2509 | GCCCAAGTAAGTCTGGGCTTGTGGGTGCACAG | 7098 | AQSKSGLVGAQ | 11687 | SKSGLVG | 0.310236 | 0.168736 |
| GS456 | 2510 | GCCCAACTTACTTTGAAGGATACTAGTGCACAG | 7099 | AQLTLKDTSAQ | 11688 | LTLKDTS | 0.310122 | -0.18278 |
| SyS893 | 2511 | GCCCAATGGAACGGCACCGGCGTCAGCGCACAG | 7100 | AQWNGTGVSAQ | 11689 | WNGTGVS | 0.310096 | -0.0119 |
| SS58 | 2512 | GCCCAACTCGTCCAAAACAACACCATGGCACAG | 7101 | AQLVQNNTMAQ | 11690 | LVQNNTM | 0.310057 | -0.30263 |
| SyS894 | 2513 | GCCCAACTCGCCGACAGAGGCAGCGCCGCACAG | 7102 | AQIADRGSAAQ | 11691 | IADRGSA | 0.310018 | -0.08828 |
| GS459 | 2514 | GCCCAATTGGCTTCGACGGGTGCGAATGCACAG | 7103 | AQLASTGANAQ | 11692 | LASTGAN | 0.309525 | -0.13094 |
| GS460 | 2515 | GCCCAACTTGGGCGGAATGATACTCTTGCACAG | 7104 | AQLGRNDTLAQ | 11693 | LGRNDTL | 0.3095 | -0.05896 |
| GS461 | 2516 | GCCCAAGAAGCACCAACGGCGAAGCCGCACAG | 7105 | AQRSTNGEAAQ | 11694 | RSTNGEA | 0.309188 | -0.01679 |
| GS462 | 2517 | GCCCAAGGCGGCCACCTACCAAAGAACCGCACAG | 7106 | AQGATYQRTAQ | 11695 | GATYQRT | 0.309152 | -0.12526 |
| SyS895 | 2518 | GCCCAAGGCAAAAGCCAACTCCTCATGGCACAG | 7107 | AQGKSQLLMAQ | 11696 | GKSQLLM | 0.309137 | -0.07057 |
| SyS896 | 2519 | GCCCAAAATACTGCTACGTTTTCTTCGGGCACAG | 7108 | AQNTATFSSAQ | 11697 | NTATFSS | 0.309129 | -0.04787 |
| GS463 | 2520 | GCCCAATATTCGACGACGATTTCTCCGGCACAG | 7109 | AQYSTTISPAQ | 11698 | YSTTISP | 0.30904 | -0.07316 |
| SyS897 | 2521 | GCCCAACCCAGACACAGCGTCCAAGACGCACAG | 7110 | AQPRHSVQDAQ | 11699 | PRHSVQD | 0.308961 | -0.20314 |
| GP117 | 2522 | GCCCAAAATAATAATACGAAGATGAATGCACAG | 7111 | AQNNNTKMNAQ | 11700 | NNNTKMN | 0.30893 | -0.03193 |
| GS464 | 2523 | GCCCAACTCACCGGCCACCACACCAAAGCACAG | 7112 | AQLTGHHTKAQ | 11701 | LTGHHTK | 0.308925 | -0.15855 |
| SyS899 | 2524 | GCCCAAAACGTCAGCAGCGGCCAAAGAGCACAG | 7113 | AQNVSSGQRAQ | 11702 | NVSSGQR | 0.308694 | 0.425634 |
| SS60 | 2525 | GCCCAAAGCCTCCAAGACGCCAGACTCGCACAG | 7114 | AQSLQDARLAQ | 11703 | SLQDARL | 0.308634 | -0.29859 |
| SyS900 | 2526 | GCCCAACTTAATAGGGATGGGTCGGTGGCACAG | 7115 | AQLNRDGSVAQ | 11704 | LNRDGSV | 0.308572 | -0.18648 |
| SyS901 | 2527 | GCCCAAAACAGCAACCGGAAAAACAGCACCGCACAG | 7116 | AQNSTENSTAQ | 11705 | NSTENST | 0.308538 | -0.07217 |
| SyS903 | 2528 | GCCCAAAGCCTCGTCGCCCAACCGTCGCACAG | 7117 | AQSLVAQPVAQ | 11706 | SLVAQPV | 0.308428 | -0.08008 |
| SyS904 | 2529 | GCCCAACATGCTGCTACGGTGAGTCATGCACAG | 7118 | AQHAATVSHAQ | 11707 | HAATVSH | 0.308062 | 0.032955 |
| SyS905 | 2530 | GCCCAAAATGTGTCTGTGTGCGGTTTGGCACAG | 7119 | AQNVSGARLAQ | 11708 | NVSGARL | 0.308062 | -0.04948 |
| GS466 | 2531 | GCCCAAAGAGCCGACAAAATTCGACTACGCACAG | 7120 | AQRADKFDYAQ | 11709 | RADKFDY | 0.308023 | -0.02692 |
| SyS906 | 2532 | GCCCAAAGCCAACCCGACGTCACCTACGCACAG | 7121 | AQSQPDVTYAQ | 11710 | SQPDVTY | 0.307992 | -0.127 |
| SyS907 | 2533 | GCCCAAGTTCTTACTCAGCAGACTCATGCACAG | 7122 | AQVLTQQTHAQ | 11711 | VLTQQTH | 0.307679 | 0.0148 |
| SyS908 | 2534 | GCCCAAACCGACAACAGCACCACCAGAGCACAG | 7123 | AQTDNSTTRAQ | 11712 | TDNSTTR | 0.307679 | 0.131421 |
| SyS909 | 2535 | GCCCAATATAATACTCGGTATGATGCTGCACAG | 7124 | AQYNTRYDAAQ | 11713 | YNTRYDA | 0.307506 | -0.20103 |
| SyS910 | 2536 | GCCCAAAGCGGCCAACGACGCCAGAGTCGCACAG | 7125 | AQSANDARVAQ | 11714 | SANDARV | 0.307448 | -0.03147 |
| SyS911 | 2537 | GCCCAAATCCTCACCCCCGACCTCAGAGCACAG | 7126 | AQILTPDLRAQ | 11715 | ILTPDLR | 0.307422 | -0.08464 |

FIG. 33 (Continued)

| | | | | | | | | |
|---|---|---|---|---|---|---|---|---|
| SyS912 | 2538 | GCCCAACCTAATGTGGGTGCGAGTTCGGCACAG | 7127 | AQPNVGASSAQ | 11716 | PNVGASS | 0.307375 | -0.17136 |
| SyS914 | 2539 | GCCCAACTCAGCGCCAGCCACCATCGCACAG | 7128 | AQLSASHTIAQ | 11717 | LSASHTI | 0.307038 | -0.14672 |
| SS61 | 2540 | GCCCAACCAAAGTCCTCATCGAAAAAGCACAG | 7129 | AQTKVLIEKAQ | 11718 | TKVLIEK | 0.306967 | -0.36752 |
| SyS915 | 2541 | GCCCAAATGAATACTCTTATTCCTGCGGCACAG | 7130 | AQMNTLIPAAQ | 11719 | MNTLIPA | 0.306966 | -0.05601 |
| SyS916 | 2542 | GCCCAATCTTCGAATGTGTGACTACTGCACAG | 7131 | AQSSNVVTTAQ | 11720 | SSNVVTT | 0.306697 | 0.098037 |
| SyS917 | 2543 | GCCCAAATGAACGTCAGACCCACCACCGCACAG | 7132 | AQMNVRPTTAQ | 11721 | MNVRPTT | 0.306682 | 0.085085 |
| SyS918 | 2544 | GCCCAAGATACTGGTCTTAATAATAGGGCACAG | 7133 | AQDTGLNNRAQ | 11722 | DTGLNNR | 0.306651 | 0.011783 |
| GS467 | 2545 | GCCCAAACCCTCAACAGAGACCACATGGCACAG | 7134 | AQTLNRDHMAQ | 11723 | TLNRDHM | 0.306373 | -0.09048 |
| GS469 | 2546 | GCCCAACTCCTCAGCCACCACAGCGCGCACAG | 7135 | AQLLLSHHAAQ | 11724 | LLLSHHA | 0.306247 | -0.18099 |
| SyS919 | 2547 | GCCCAAAACCCGCCATGGCCACCTTCGCACAG | 7136 | AQNPAMATFAQ | 11725 | NPAMATF | 0.305992 | -0.14768 |
| GS470 | 2548 | GCCCAAATTTCTCAGCGGATTTATGCGGCACAG | 7137 | AQISQRIYAAQ | 11726 | ISQRIYA | 0.30595 | -0.16528 |
| SyS920 | 2549 | GCCCAAACGACTGGGGTTGCTGGTAGTGCACAG | 7138 | AQTTGVAGSAQ | 11727 | TTGVAGS | 0.305896 | 0.05663 |
| SyS921 | 2550 | GCCCAATTTGGGACGTTTCCGACGCCTGCACAG | 7139 | AQFGTFPTPAQ | 11728 | FGTFPTP | 0.305776 | -0.10477 |
| SS62 | 2551 | GCCCAAAGAGGAGGCAGCGACTTCGACAGCGCACAG | 7140 | AQRGSDFDSAQ | 11729 | RGSDFDS | 0.305764 | -0.33979 |
| GS472 | 2552 | GCCCAAAGCAAAGCCAGCCTCGACAGCGCACAG | 7141 | AQSKASLDSAQ | 11730 | SKASLDS | 0.305689 | -0.08038 |
| GS473 | 2553 | GCCCAACTTCTTAATAGTCATTCTGCTGCACAG | 7142 | AQLLNSHSAAQ | 11731 | LLNSHSA | 0.305635 | 0.015974 |
| GS474 | 2554 | GCCCAAGCTAGTATTCATAAGGATATTGCACAG | 7143 | AQASIHKDIAQ | 11732 | ASIHKDI | 0.305534 | -0.1269 |
| GS475 | 2555 | GCCCAAAGCGACCCGGCAAATTCATGGCACAG | 7144 | AQSDPGKFMAQ | 11733 | SDPGKFM | 0.305528 | -0.10472 |
| SyS922 | 2556 | GCCCAAGGCACCAGCAGCGCCCAAAGAGCACAG | 7145 | AQGTSSAQRAQ | 11734 | GTSSAQR | 0.305492 | -0.05312 |
| SyS923 | 2557 | GCCCAAAGTACGAAATAGTAAGCTGGAGGCACAG | 7146 | AQSTNSKLEAQ | 11735 | STNSKLE | 0.305492 | -0.15496 |
| SyS924 | 2558 | GCCCAAAAATTTGCAGACTGTTCCGAATGCACAG | 7147 | AQNLQTVPNAQ | 11736 | NLQTVPN | 0.305492 | -0.15496 |
| GS476 | 2559 | GCCCAAGTCGTCACCCACCTCAACGCCGCACAG | 7148 | AQVVTHLNAAQ | 11737 | VVTHLNA | 0.305419 | -0.13612 |
| SyS925 | 2560 | GCCCAACTCAGCACCAGCAACAACTTCGCACAG | 7149 | AQLSTSNNFAQ | 11738 | LSTSNNF | 0.305414 | 0.115059 |
| SyS926 | 2561 | GCCCAAAACAACAGCGGCCACATCAGCGCACAG | 7150 | AQNNSGHISAQ | 11739 | NNSGHIS | 0.305094 | -0.09434 |
| SyS927 | 2562 | GCCCAAGCTACCAAGTCAACAGCGACGCACAG | 7151 | AQAYQVNSDAQ | 11740 | AYQVNSD | 0.305066 | 0.03955 |
| SyS928 | 2563 | GCCCAACAGCAGAATTATTTGAATCATGCACAG | 7152 | AQQQNYLNHAQ | 11741 | QQNYLNH | 0.304957 | -0.16223 |
| GS477 | 2564 | GCCCAATTTGCGACTACGAATACTGGGGCACAG | 7153 | AQFATTNTGAQ | 11742 | FATTNTG | 0.304891 | 0.033545 |
| GS478 | 2565 | GCCCAACTTGCGAATAAGATTGCGAATGCACAG | 7154 | AQLANKIANAQ | 11743 | LANKIAN | 0.304879 | -0.01499 |
| GS479 | 2566 | GCCCAACAAAGCTTCCAAAGAGAAGTCGCACAG | 7155 | AQQSFQREVAQ | 11744 | QSFQREV | 0.304879 | -0.14689 |
| SyS930 | 2567 | GCCCAACTGCATATTTCGGAGCCGAGGGCACAG | 7156 | AQLHISEPRAQ | 11745 | LHISEPR | 0.30455 | -0.13556 |
| GS481 | 2568 | GCCCAACGTGTGGGTGAGCGGGAGCAGGCACAG | 7157 | AQRVGEREQAQ | 11746 | RVGEREQ | 0.304522 | -0.17829 |
| SyS931 | 2569 | GCCCAAGGTTAATATTATTCAGGCGTCGGCACAG | 7158 | AQVNIIQASAQ | 11747 | VNIIQAS | 0.304499 | -0.05678 |

FIG. 33 (Continued)

| | | | | | | | | |
|---|---|---|---|---|---|---|---|---|
| SyS932 | 2570 | GCCCAAGGCGGTCGGCCTCCACAACAAAGCACAG | 7159 | AQGVGLHNKAQ | 11748 | GVGLHNK | 0.304499 | -0.10606 |
| SyS933 | 2571 | GCCCAAAATAATCCTGCGGATTCCGATTGCACAG | 7160 | AQNNPAIPIAQ | 11749 | NNPAIPI | 0.30426 | -0.01336 |
| GP118 | 2572 | GCCCAACGGCTGTCGAGTCAGGCTGTGGCACAG | 7161 | AQRLSSQAVAQ | 11750 | RLSSQAV | 0.304245 | -0.07356 |
| SyS934 | 2573 | GCCCAACACAGCAACGAACTCAGACCGCACAG | 7162 | AQHSNELRPAQ | 11751 | HSNELRP | 0.304109 | 0.131628 |
| SyS935 | 2574 | GCCCAAAGCTCGGCCCACCAACGCACAG | 7163 | AQSLGPTTNAQ | 11752 | SLGPTTN | 0.304096 | -0.09555 |
| TS154 | 2575 | GCCCAAGGTAATCAGACGAATCGTTCGGCACAG | 7164 | AQGNQTNRSAQ | 11753 | GNQTNRS | 0.303952 | -0.06046 |
| SyS936 | 2576 | GCCCAAAGTAATCCGGTGGGTAATCCGGCACAG | 7165 | AQSNPVGNPAQ | 11754 | SNPVGNP | 0.303849 | 0.006491 |
| SyS937 | 2577 | GCCCAACAAGTCCCCCCCCTCGTCCCGCACAG | 7166 | AQQVPPLVPAQ | 11755 | QVPPLVP | 0.303762 | -0.17678 |
| SyS939 | 2578 | GCCCAACTCAGCACCCCCACCCCAAGCACAG | 7167 | AQLSTPPTQAQ | 11756 | LSTPPTQ | 0.303367 | 0.011133 |
| SyS940 | 2579 | GCCCAAGTGGGTACGGAGCCGCTTTCTGCACAG | 7168 | AQVGTEPLSAQ | 11757 | VGTEPLS | 0.303367 | -0.21072 |
| GS483 | 2580 | GCCCAAAGACCGGACGCCACCAGCCACGCACAG | 7169 | AQRPDATSHAQ | 11758 | RPDATSH | 0.303361 | -0.12139 |
| GS485 | 2581 | GCCCAAGTTGAGAAGCAGATGCTTAATGCACAG | 7170 | AQVEKQMLNAQ | 11759 | VEKQMLN | 0.303278 | -0.10651 |
| SyS941 | 2582 | GCCCAATTCAAAAGCGCCAAGCACCGCACAG | 7171 | AQFKSAQATAQ | 11760 | FKSAQAT | 0.303093 | -0.09677 |
| SyS942 | 2583 | GCCCAATGGGCTTTGTCTACGGATGGGCACAG | 7172 | AQWALSTDGAQ | 11761 | WALSTDG | 0.302822 | -0.19969 |
| SyS943 | 2584 | GCCCAACTTGCTGGTCTGGCTACTAATGCACAG | 7173 | AQLAGLATNAQ | 11762 | LAGLATN | 0.302566 | -0.04978 |
| SyS944 | 2585 | GCCCAAACCCTCACCGCGCACCCCGCACAG | 7174 | AQTLTAGTPAQ | 11763 | TLTAGTP | 0.302458 | 0.051682 |
| GS486 | 2586 | GCCCAAATCCCCGTCACCAGCAGAATGGCACAG | 7175 | AQIPVTSRMAQ | 11764 | IPVTSRM | 0.302322 | -0.15669 |
| SyS945 | 2587 | GCCCAAGGAGGACGGATTATCCTAGGTCTGCACAG | 7176 | AQGTDYPRSAQ | 11765 | GTDYPRS | 0.302309 | -0.17799 |
| SyS946 | 2588 | GCCCAAGTTACGGAGCATAGTAAGTTGGCACAG | 7177 | AQVTEHSKLAQ | 11766 | VTEHSKL | 0.302301 | -0.1054 |
| GS487 | 2589 | GCCCAAAACATGAGCATGCCCGTCAAAGCACAG | 7178 | AQNMSMPVKAQ | 11767 | NMSMPVK | 0.302291 | -0.06614 |
| SyS947 | 2590 | GCCCAAAGCGTCGGCGTCGGCATGAGCGCACAG | 7179 | AQSVGVGMSAQ | 11768 | SVGVGMS | 0.302147 | -0.04842 |
| SyS948 | 2591 | GCCCAACCCAGAACGACAACGAAGGCGCACAG | 7180 | AQPRTDNEGAQ | 11769 | PRTDNEG | 0.302129 | -0.11889 |
| SyS949 | 2592 | GCCCAATTCAGCAACCCCGACAGAACCGCACAG | 7181 | AQFSNPDRTAQ | 11770 | FSNPDRT | 0.302103 | -0.03523 |
| SyS950 | 2593 | GCCCAAATGCACCTCGTCCCACCACCGCACAG | 7182 | AQMHLVPTTAQ | 11771 | MHLVPTT | 0.302085 | -0.09798 |
| SyS951 | 2594 | GCCCAAAATGCTCCTCCGGTTTCTTCTGCACAG | 7183 | AQNAPPVSSAQ | 11772 | NAPPVSS | 0.301938 | 0.008708 |
| SyS952 | 2595 | GCCCAATCGAATTTGCCTACTTTGGCGGCACAG | 7184 | AQSNLPTLAAQ | 11773 | SNLPTLA | 0.301914 | 0.035379 |
| GS490 | 2596 | GCCCAAATCATGCAAGGCATGACCACCGCACAG | 7185 | AQIMQGMTTAQ | 11774 | IMQGMTT | 0.301878 | -0.14272 |
| SyS953 | 2597 | GCCCAAAGTCGTGAGACGACGAGTCCTGCACAG | 7186 | AQSRETTSPAQ | 11775 | SRETTSP | 0.30158 | 0.041441 |
| SyS954 | 2598 | GCCCAAAACCCACCAGCTTCAGCACCGCACAG | 7187 | AQNPTSFSTAQ | 11776 | NPTSFST | 0.30158 | -0.17193 |
| SyS955 | 2599 | GCCCAAAATTTGCAGCATGGTTCGACTGCACAG | 7188 | AQNLQHGSTAQ | 11777 | NLQHGST | 0.301496 | 0.225756 |
| GS491 | 2600 | GCCCAAAATTTCATTCTGGTCATACGGCACAG | 7189 | AQNFHSGHTAQ | 11778 | NFHSGHT | 0.301283 | -0.13881 |
| GS492 | 2601 | GCCCAAACTGAGAGTGTGTATGCGGAGGGCACAG | 7190 | AQTESVYARAQ | 11779 | TESVYAR | 0.301236 | -0.15383 |

FIG. 33 (Continued)

| | | | | | | | | |
|---|---|---|---|---|---|---|---|---|
| GS493 | 2602 | GCCCAAACTAAGTCTGAGATTCCTAATGCACAG | 7191 | AQTKSEIPNAQ | 11780 | TKSEIPN | 0.301236 | -0.15383 |
| SyS956 | 2603 | GCCCAAACCAGCCTCGCCGACATGAGAGCACAG | 7192 | AQTSLADMRAQ | 11781 | TSLADMR | 0.301192 | -0.01918 |
| GS494 | 2604 | GCCCAAAGACTCAAAGCGACATCACCGCACAG | 7193 | AQRLKADITAQ | 11782 | RLKADIT | 0.301085 | -0.08801 |
| SyS957 | 2605 | GCCCAACTGAATATGAATGTTCTGGCTGCACAG | 7194 | AQLNMNVLAAQ | 11783 | LNMNVLA | 0.301014 | -0.03968 |
| GS495 | 2606 | GCCCAAAGCCTCAGACCCATCAGCGTCGCACAG | 7195 | AQSLRPISVAQ | 11784 | SLRPISV | 0.301004 | -0.15945 |
| SyS958 | 2607 | GCCCAACTCAGCGTCCAACTCGTCGAAGCACAG | 7196 | AQLSVQLVEAQ | 11785 | LSVQLVE | 0.300849 | -0.14056 |
| SyS959 | 2608 | GCCCAAAGTTTGAGGGTGTTCTTCCGGCACAG | 7197 | AQSFEGVLPAQ | 11786 | SFEGVLP | 0.300847 | -0.1792 |
| GS496 | 2609 | GCCCAAATCATCGTCGGCCTCCAACCCGCACAG | 7198 | AQIIVGLQPAQ | 11787 | IIVGLQP | 0.3008 | -0.11578 |
| GS497 | 2610 | GCCCAAGTCAGCAGCTACGAAAGACTCGCACAG | 7199 | AQVSSYERLAQ | 11788 | VSSYERL | 0.300709 | -0.12053 |
| SyS960 | 2611 | GCCCAAAGAACCAACGACGCCATCGTCGCACAG | 7200 | AQRTNDAIVAQ | 11789 | RTNDAIV | 0.300688 | 0.340159 |
| GS498 | 2612 | GCCCAATTCAGCGAACACAGAGAACTCGCACAG | 7201 | AQFSEHRELAQ | 11790 | FSEHREL | 0.300668 | -0.16304 |
| GS499 | 2613 | GCCCAAAAAGAAGCCACCGCCAACACCGCACAG | 7202 | AQKEATANTAQ | 11791 | KEATANT | 0.300598 | -0.06336 |
| SyS962 | 2614 | GCCCAACTCAGAGCCAGCAGCATCACCGTCGCACAG | 7203 | AQLRASITVAQ | 11792 | LRASITV | 0.300214 | 0.025681 |
| SyS963 | 2615 | GCCCAATGGTTGGGTATTACTGAGGCGGCACAG | 7204 | AQWLGITEAAQ | 11793 | WLGITEA | 0.300198 | -0.07373 |
| SyS964 | 2616 | GCCCAAGCAGCCAAAAGCCGCGAAGCACAG | 7205 | AQSSQKAAEAQ | 11794 | SSQKAAE | 0.300091 | -0.02263 |
| GS501 | 2617 | GCCCAAGGGTCGACTCCTGGTCTTGCTGCACAG | 7206 | AQGSTPGLAAQ | 11795 | GSTPGLA | 0.299731 | -0.12625 |
| SyS965 | 2618 | GCCCAAAAGGGGAATGCTAATGATCTTGCACAG | 7207 | AQKGNANDLAQ | 11796 | KGNANDL | 0.299619 | -0.12733 |
| SyS966 | 2619 | GCCCAAACCAGCGCCCCCCTCAAACTCGCACAG | 7208 | AQTSAPLKLAQ | 11797 | TSAPLKL | 0.299556 | -0.03494 |
| SyS967 | 2620 | GCCCAACCTGTGCAGACGAATGGGCATGCACAG | 7209 | AQPVQTNGHAQ | 11798 | PVQTNGH | 0.299313 | -0.06587 |
| SyS968 | 2621 | GCCCAAAGGCCGGCTGTGGATTCGGCTGCACAG | 7210 | AQRPAVDSAAQ | 11799 | RPAVDSA | 0.299287 | -0.04179 |
| SyS969 | 2622 | GCCCAAACCACCCTCAGCCAAAACAGAGCACAG | 7211 | AQTTLSQNRAQ | 11800 | TTLSQNR | 0.299223 | -0.05801 |
| SyS970 | 2623 | GCCCAAGTCATGACCGTCGCAGCCTCGCACAG | 7212 | AQVMTVGSLAQ | 11801 | VMTVGSL | 0.299001 | -0.07033 |
| SyS971 | 2624 | GCCCAAGCCCTCAACAAAGAAAACTGGGCACAG | 7213 | AQALNKENWAQ | 11802 | ALNKENW | 0.298989 | -0.20709 |
| SyS973 | 2625 | GCCCAACATCATCATTTGACGGGGAATGCACAG | 7214 | AQHHHLTGNAQ | 11803 | HHHLTGN | 0.298821 | -0.17259 |
| GS502 | 2626 | GCCCAAGGGATGCGGACTGTGAATATTGCACAG | 7215 | AQGMRTVNIAQ | 11804 | GMRTVNI | 0.298627 | -0.18099 |
| GS503 | 2627 | GCCCAAACTCTGAATAGTTCGGTGGCTGCACAG | 7216 | AQTLNSSVAAQ | 11805 | TLNSSVA | 0.298611 | -0.08717 |
| GS504 | 2628 | GCCCAATCTGCTTCGACGATTCTTGTTGCACAG | 7217 | AQSASTILVAQ | 11806 | SASTILV | 0.298566 | -0.16753 |
| GP119 | 2629 | GCCCAAGAGAGATGATTAGGCCTCGTGCGGCACAG | 7218 | AQEMIRPRAAQ | 11807 | EMIRPRA | 0.298415 | 0.162495 |
| SyS974 | 2630 | GCCCAAATGTCGGCGGCGAGTTATAAGGCACAG | 7219 | AQMSAASYKAQ | 11808 | MSAASYK | 0.298381 | -0.14302 |
| SyS975 | 2631 | GCCCAACATTTTACGACTGGGTCTGTTGCACAG | 7220 | AQHFTTGSVAQ | 11809 | HFTTGSV | 0.298366 | -0.02828 |
| GS505 | 2632 | GCCCAAGCTTCTCATACTATTGGGCTTGCACAG | 7221 | AQASHTIGLAQ | 11810 | ASHTIGL | 0.298317 | -0.10725 |
| GS506 | 2633 | GCCCAAAGTCGGGAGCATCAGCTGTATGCACAG | 7222 | AQSREHQLYAQ | 11811 | SREHQLY | 0.298183 | -0.11266 |

FIG. 33 (Continued)

| | | | | | | | | |
|---|---|---|---|---|---|---|---|---|
| GS507 | 2634 | GCCCAAGCTGGTACGACGGGCTCCGCTTGCACAG | 7223 | AQAGTTAPLAQ | 11812 | AGTTAPL | 0.298135 | -0.06321 |
| GS508 | 2635 | GCCCAAGGCAAAGTCAGCGGCGGCCATGGCACAG | 7224 | AQGKVSGAMAQ | 11813 | GKVSGAM | 0.298131 | -0.11524 |
| GS509 | 2636 | GCCCAAAAACTCAGCGGCGGCATGAGCGTCGCACAG | 7225 | AQKLSGMSVAQ | 11814 | KLSGMSV | 0.297895 | -0.15574 |
| GS510 | 2637 | GCCCAAGTCCTCCCCAAAGACGACGCCGCACAG | 7226 | AQVLPKDDAAQ | 11815 | VLPKDDA | 0.297661 | -0.1747 |
| SyS976 | 2638 | GCCCAACTCGCCGGCATCCTCACCACGCACAG | 7227 | AQLAGILTTAQ | 11816 | LAGILTT | 0.297605 | -0.0739 |
| SyS977 | 2639 | GCCCAAGTCGTCCCGGCCCAAACCGCACAG | 7228 | AQVVPGAQTAQ | 11817 | VVPGAQT | 0.297436 | -0.06047 |
| SyS978 | 2640 | GCCCAAGGTCAGCATTCTTATGCGCATGCACAG | 7229 | AQGQHSYAHAQ | 11818 | GQHSYAH | 0.297408 | -0.07737 |
| SyS979 | 2641 | GCCCAACATCATCTGAGTACGTCGATTGCACAG | 7230 | AQHHLSTSIAQ | 11819 | HHLSTSI | 0.297404 | -0.03102 |
| SyS980 | 2642 | GCCCAAACCCTCATCCCCCAACCCGCACAG | 7231 | AQTLIPPNPAQ | 11820 | TLIPPNP | 0.297351 | -0.14283 |
| GS511 | 2643 | GCCCAAGAGATGCATAATCCTAGGGCGGCACAG | 7232 | AQEMHNPRAAQ | 11821 | EMHNPRA | 0.297287 | -0.11417 |
| SyS982 | 2644 | GCCCAAATCGAAAACCCCCCAGAGGCGGCACAG | 7233 | AQIENPPRGAQ | 11822 | IENPPRG | 0.297181 | -0.0878 |
| SyS983 | 2645 | GCCCAAGGCCAATTCAGCGACGCCAGAGCACAG | 7234 | AQGQFSDARAQ | 11823 | GQFSDAR | 0.297111 | 0.032689 |
| SyS984 | 2646 | GCCCAAGCCGAAGCCAGCGCCAGCAGAGCACAG | 7235 | AQAEASASRAQ | 11824 | AEASASR | 0.297046 | -0.07131 |
| SyS985 | 2647 | GCCCAACTTGTTAAGGGGGATGCGAGGGCACAG | 7236 | AQLVKGDARAQ | 11825 | LVKGDAR | 0.29699 | 0.026608 |
| GS512 | 2648 | GCCCAACAGGGTCATACGCATGGGAATGCACAG | 7237 | AQQGHTHGNAQ | 11826 | QGHTHGN | 0.296975 | -0.12903 |
| SyS513 | 2649 | GCCCAACAGAAGCCTACGTCTACTTTGCACAG | 7238 | AQQKPTSTFAQ | 11827 | QKPTSTF | 0.296937 | -0.15288 |
| GS514 | 2650 | GCCCAAAAGCTTGCTGCTTGGGTGCTGCACAG | 7239 | AQKLAALGAAQ | 11828 | KLAALGA | 0.296882 | -0.17672 |
| SyS986 | 2651 | GCCCAATCGTCTGTGGATCAGATGAAGGCACAG | 7240 | AQSSVDQMKAQ | 11829 | SSVDQMK | 0.296846 | -0.08602 |
| SyS987 | 2652 | GCCCAAGGCATCGTCACCGCCCCCTCGCACAG | 7241 | AQGIVTAPLAQ | 11830 | GIVTAPL | 0.296762 | -0.16951 |
| GS515 | 2653 | GCCCAACTTTTGAAGATGCCTTCTCCTGCACAG | 7242 | AQLLKMPSPAQ | 11831 | LLKMPSP | 0.296723 | -0.12298 |
| SyS988 | 2654 | GCCCAAAATGTTGCTCATACGGTCGTGCACAG | 7243 | AQNVAHTVRAQ | 11832 | NVAHTVR | 0.2967 | -0.06524 |
| SyS989 | 2655 | GCCCAACTGATGAGTAACGAATGTGAGTGCACAG | 7244 | AQLMSTNVSAQ | 11833 | LMSTNVS | 0.29667 | 0.039016 |
| SyS990 | 2656 | GCCCAACTGTCTAATAATAATGCGCTTGCACAG | 7245 | AQLSNNNALAQ | 11834 | LSNNNAL | 0.296455 | -0.22803 |
| SyS991 | 2657 | GCCCAACTCCTCATCGGCCCCACGGGCACAG | 7246 | AQLLIGPTGAQ | 11835 | LLIGPTG | 0.296321 | -0.11131 |
| SyS517 | 2658 | GCCCAAGTCAGAAACACCATGATCAGCGCACAG | 7247 | AQVRNTMISAQ | 11836 | VRNTMIS | 0.296311 | -0.17201 |
| GS518 | 2659 | GCCCAAGGCGCCACCGGCCACCTCACCGCACAG | 7248 | AQGATGHLTAQ | 11837 | GATGHLT | 0.296311 | -0.17201 |
| GS519 | 2660 | GCCCAAATGACCGTCGGCAACCTCGGCGCACAG | 7249 | AQMTVGNLGAQ | 11838 | MTVGNLG | 0.29631 | -0.06764 |
| SyS992 | 2661 | GCCCAAAGTAATGGTCTGAATGGTTTGGCACAG | 7250 | AQSNGLNGLAQ | 11839 | SNGLNGL | 0.296065 | -0.23419 |
| SyS994 | 2662 | GCCCAACGAAGGGAATGAGAGAATGAGAGTCGTGCACAG | 7251 | AQRNENESRAQ | 11840 | RNENESR | 0.295831 | -0.08635 |
| SyP47 | 2663 | GCCCAAGGGAATGCTCGGGATGCGAGTGCACAG | 7252 | AQGNARDASAQ | 11841 | GNARDAS | 0.295799 | -0.04389 |
| SyS995 | 2664 | GCCCAAATCAGCAAACTCCTCTCCAGCGCACAG | 7253 | AQISKLLLSAQ | 11842 | ISKLLLS | 0.295612 | -0.10947 |
| GS520 | 2665 | GCCCAAAACGACACCACCAACATGAGCGCACAG | 7254 | AQNDTTNMSAQ | 11843 | NDTTNMS | 0.295587 | -0.16718 |

FIG. 33 (Continued)

| | | | | | | | | |
|---|---|---|---|---|---|---|---|---|
| SyS996 | 2666 | GCCCAAGGCCTCGAAGCCAACAAAAGGCACAG | 7255 | AQGLEANKSAQ | 11844 | GLEANKS | 0.295578 | 0.033862 |
| SyS998 | 2667 | GCCCAACATTATAGTACTGTTGGGGTGGCACAG | 7256 | AQHYSTVGVAQ | 11845 | HYSTVGV | 0.295419 | -0.19011 |
| SyS999 | 2668 | GCCCAACCTACGATTTCGGTTCTGCCTGCACAG | 7257 | AQPTISVLPAQ | 11846 | PTISVLP | 0.295257 | -0.21694 |
| SyS1000 | 2669 | GCCCAAGTCCAAACCATCGGCCACGAAGCACAG | 7258 | AQVQTIGHEAQ | 11847 | VQTIGHE | 0.295085 | -0.16397 |
| SyS1001 | 2670 | GCCCAAAAACCGAAACCGCAGCGACGGCACAG | 7259 | AQKPETASDAQ | 11848 | KPETASD | 0.294946 | -0.1036 |
| SS64 | 2671 | GCCCAAACCAACACCCCACCAGAGAGCACAG | 7260 | AQTNTPTSRAQ | 11849 | TNTPTSR | 0.294926 | -0.28124 |
| SyS1002 | 2672 | GCCCAAAGTTGACGCTTAGTTCGCATGCACAG | 7261 | AQSLTLSSHAQ | 11850 | SLTLSSH | 0.294898 | -0.14526 |
| GP120 | 2673 | GCCCAACATTATCATAGTATTCAGGCTGCACAG | 7262 | AQHYHSIQAAQ | 11851 | HYHSIQA | 0.294855 | -0.07232 |
| SyS1003 | 2674 | GCCCAATACCACGGCGAAAACGAAAGAGCACAG | 7263 | AQYHGENERAQ | 11852 | YHGENER | 0.294846 | -0.08758 |
| GS522 | 2675 | GCCCAACTGCCTCATACTGCGCCGTGTGGCACAG | 7264 | AQLPHTARVAQ | 11853 | LPHTARV | 0.294761 | -0.14958 |
| SyS1004 | 2676 | GCCCAAACCAGAGAAGGCAGCACCGGCGCACAG | 7265 | AQTREGSTGAQ | 11854 | TREGSTG | 0.294636 | -0.02281 |
| GS525 | 2677 | GCCCAAGTTGATCGTAGGGCGATGCTTGCACAG | 7266 | AQVDRRAMLAQ | 11855 | VDRRAML | 0.294282 | -0.08 |
| SyS1005 | 2678 | GCCCAAACCAGCGTCAGCGCCGTCATGGCACAG | 7267 | AQTSVSAVMAQ | 11856 | TSVSAVM | 0.29428 | -0.21679 |
| SyS1006 | 2679 | GCCCAAAGCCAAAAACTCACCGAAAAAGCACAG | 7268 | AQSQKLTEKAQ | 11857 | SQKLTEK | 0.294248 | -0.04613 |
| SyS1007 | 2680 | GCCCAAAGACTCCCCAGCCTCAGCGTCGCACAG | 7269 | AQRLPSLSVAQ | 11858 | RLPSLSV | 0.294218 | -0.049 |
| SyS1008 | 2681 | GCCCAAAGTGTTAGTGAGGGTAGTAGGGCACAG | 7270 | AQSVSEGSRAQ | 11859 | SVSEGSR | 0.294121 | -0.18245 |
| SyS1009 | 2682 | GCCCAAAGCATCCCCAGCGTCAGCGCCGCACAG | 7271 | AQSIPSVSAAQ | 11860 | SIPSVSA | 0.294121 | -0.13314 |
| GS526 | 2683 | GCCCAAACTACTAATAATGTAAGAGTGCACAG | 7272 | AQTTNNAKSAQ | 11861 | TTNNAKS | 0.294054 | -0.13141 |
| SyS1010 | 2684 | GCCCAAGGCGAGTGGGGAGGCTTCGACTGCACAG | 7273 | AQASGEASTAQ | 11862 | ASGEAST | 0.293904 | -0.11222 |
| SyS1011 | 2685 | GCCCAAGATAATAATTCGAGTATTGCTGCACAG | 7274 | AQDNNSSIAAQ | 11863 | DNNSSIA | 0.293817 | -0.21202 |
| SyS1012 | 2686 | GCCCAAGTCCACGACAACAGCAAACTCGCACAG | 7275 | AQVHDNSKLAQ | 11864 | VHDNSKL | 0.293384 | -0.0119 |
| SyS1013 | 2687 | GCCCAATCTACTTTGGCGGGTTCGGAGGCACAG | 7276 | AQSTLAGSEAQ | 11865 | STLAGSE | 0.293384 | -0.18527 |
| SyS1014 | 2688 | GCCCAACCTGAGAAGAGTCATTCGTCGGCACAG | 7277 | AQPEKSHSSAQ | 11866 | PEKSHSS | 0.293335 | 0.032955 |
| GS529 | 2689 | GCCCAACAAATGCTCAGAGCCAGCGTCGCACAG | 7278 | AQQMLRASVAQ | 11867 | QMLRASV | 0.293248 | -0.17022 |
| SyS1015 | 2690 | GCCCAAGCCCTCAGCAACAACATCACCGCACAG | 7279 | AQALSNNITAQ | 11868 | ALSNNIT | 0.293202 | 0.023276 |
| SyS1016 | 2691 | GCCCAAAGTTTGGCGAATCAGTTGCCTGCACAG | 7280 | AQSLANQLPAQ | 11869 | SLANQLP | 0.29314 | -0.10658 |
| SyS1017 | 2692 | GCCCAAGAACAAAGCAGACTCCAAACCGCACAG | 7281 | AQEQSRLQTAQ | 11870 | EQSRLQT | 0.292969 | 0.059223 |
| SyS1018 | 2693 | GCCCAAAATTTGTCTCAGAATGTTATGGCACAG | 7282 | AQNLSQNVMAQ | 11871 | NLSQNVM | 0.292952 | -0.04783 |
| SyS1019 | 2694 | GCCCAAAGCCACAAAACTCAGCAGCAGCGGCACAG | 7283 | AQSHKLSSSAQ | 11872 | SHKLSSS | 0.29295 | 0.045078 |
| GP122 | 2695 | GCCCAACCTACTAATACTAAGACGGGCGGCACAG | 7284 | AQPTNTKTAAQ | 11873 | PTNTKTA | 0.292879 | -0.0737 |
| GS530 | 2696 | GCCCAAATGAATCCGGCTACTGTGGCTGCACAG | 7285 | AQMNPATVAAQ | 11874 | MNPATVA | 0.29272 | -0.03446 |
| SyS1021 | 2697 | GCCCAAAAGATTGAGCGTACGAATTTTGCACAG | 7286 | AQKIERTNFAQ | 11875 | KIERTNF | 0.292715 | -0.1986 |

FIG. 33 (Continued)

| | | | | | | | | |
|---|---|---|---|---|---|---|---|---|
| GS532 | 2698 | GCCCAAACTAGTCCTACGTATAAGTTGGCACAG | 7287 | AQTSPTYKLAQ | 11876 | TSPTYKL | 0.292683 | -0.16394 |
| SyS1022 | 2699 | GCCCAAAGGAGTGATCATATTGATTATGCACAG | 7288 | AQRSDHIDYAQ | 11877 | RSDHIDY | 0.292545 | -0.17314 |
| GS533 | 2700 | GCCCAAACTCTTGGTCTGAATACTAATGCACAG | 7289 | AQTLGLNTNAQ | 11878 | TLGLNTN | 0.29252 | -0.08599 |
| GS534 | 2701 | GCCCAACCCCTCAGCAACCACGGCACCGCACAG | 7290 | AQPLSNHGTAQ | 11879 | PLSNHGT | 0.292259 | -0.14779 |
| SyS1023 | 2702 | GCCCAAGCCGTCAGCAGACTCCCATGGCACAG | 7291 | AQAVSRLPMAQ | 11880 | AVSRLPM | 0.292237 | -0.0617 |
| SyS1024 | 2703 | GCCCAACTCCTCACCGAAAGCAAAATGGCACAG | 7292 | AQLLTESKMAQ | 11881 | LLTESKM | 0.292116 | -0.05872 |
| GS535 | 2704 | GCCCAACATATGAGGACGGATACTGCTGCACAG | 7293 | AQHMRTDTAAQ | 11882 | HMRTDTA | 0.292093 | 0.026545 |
| SS65 | 2705 | GCCCAAAGTCTTACGGTTAATGCGGCTGCACAG | 7294 | AQSLTVNAAAQ | 11883 | SLTVNAA | 0.292051 | -0.35371 |
| SyS1025 | 2706 | GCCCAAAACCCAACGGCGTCACCGTCGCACAG | 7295 | AQNPNGVTVAQ | 11884 | NPNGVTV | 0.292021 | 0.126305 |
| GS536 | 2707 | GCCCAAACTACTAAGTTGCCGACTCTTGCACAG | 7296 | AQTTKLPTLAQ | 11885 | TTKLPTL | 0.291897 | -0.16241 |
| GS537 | 2708 | GCCCAAAATTCTACGTCGAAGCAGCTGGCACAG | 7297 | AQNSTSKQLAQ | 11886 | NSTSKQL | 0.291795 | -0.10165 |
| SyS1026 | 2709 | GCCCAAACTTTGGGGTCGTCTAATACTGCACAG | 7298 | AQTLGSSNTAQ | 11887 | TLGSSNT | 0.29177 | 0.260145 |
| SyS1027 | 2710 | GCCCAACGCGTGCGACTGATCCGCAGGCACAG | 7299 | AQPRATDPQAQ | 11888 | PRATDPQ | 0.291721 | -0.15534 |
| SyS1028 | 2711 | GCCCAAAGCTCCTCAACAAACCACCGCACAG | 7300 | AQSLLNKTTAQ | 11889 | SLLNKTT | 0.291681 | -0.03372 |
| SyS1029 | 2712 | GCCCAACAAAAAGCGACGGCAGCCCCGCACAG | 7301 | AQQKSDGSPAQ | 11890 | QKSDGSP | 0.291669 | -0.06584 |
| SyS1030 | 2713 | GCCCAAACCGTCAGCGGCTTCACCAAAGCACAG | 7302 | AQTVSGFTKAQ | 11891 | TVSGFTK | 0.291528 | -0.16386 |
| SyS1031 | 2714 | GCCCAAACCGTCCTCGTCAAAGCACCGCACAG | 7303 | AQTVLVKSTAQ | 11892 | TVLVKST | 0.291496 | -0.03529 |
| SyS1032 | 2715 | GCCCAAGGGGCTCATATTTCTAATCCTGCACAG | 7304 | AQGAHISNPAQ | 11893 | GAHISNP | 0.291472 | -0.05008 |
| SyS1033 | 2716 | GCCCAAGAACCCAGCATCCCCAGACCCGCACAG | 7305 | AQEPSIPRPAQ | 11894 | EPSIPRP | 0.291443 | -0.01064 |
| GS538 | 2717 | GCCCAAGGCACCGTCCAAGCCAGACAAGCACAG | 7306 | AQGTVQARQAQ | 11895 | GTVQARQ | 0.291432 | -0.12617 |
| GS539 | 2718 | GCCCAAAATAATCATCATAATTATGTGGATGCACAG | 7307 | AQNNHNYVDAQ | 11896 | NNHNYVD | 0.291265 | -0.18099 |
| SyS1034 | 2719 | GCCCAAAGGACGGCGAGTGTTAGTTTGGCACAG | 7308 | AQRTASVSLAQ | 11897 | RTASVSL | 0.291215 | -0.02711 |
| SyS1035 | 2720 | GCCCAAATCAGCATGGACAACCACAGAGCACAG | 7309 | AQISMDNHRAQ | 11898 | ISMDNHR | 0.291187 | -0.14425 |
| GS540 | 2721 | GCCCAAAGTGATGGGCATAATCATTCTGCACAG | 7310 | AQSDGHNHSAQ | 11899 | SDGHNHS | 0.291146 | -0.15288 |
| SyS1036 | 2722 | GCCCAAAGCGCCGGCATCGGCGGCATCGGCACAG | 7311 | AQSAGSGIGAQ | 11900 | SAGSGIG | 0.290985 | -0.22527 |
| GS541 | 2723 | GCCCAAAAAGCCACCCTCAGCGAAAAAGCACAG | 7312 | AQKATLSEKAQ | 11901 | KATLSEK | 0.290766 | -0.1747 |
| GS542 | 2724 | GCCCAAATCCACGCGCGGCGGCCAAAGAGCACAG | 7313 | AQIHAGGQRAQ | 11902 | IHAGGQR | 0.290742 | -0.07711 |
| SyS1038 | 2725 | GCCCAACTGACTCCTAGTAGTGCGAATGCACAG | 7314 | AQLTPSSANAQ | 11903 | LTPSSAN | 0.290681 | -0.11131 |
| GS543 | 2726 | GCCCAAGACGGCAAAGCTACAACCACGCACAG | 7315 | AQDGKAYNHAQ | 11904 | DGKAYNH | 0.290644 | -0.08049 |
| GS544 | 2727 | GCCCAATGGTCGGCGCAGACGATGAATGCACAG | 7316 | AQWSAQTMNAQ | 11905 | WSAQTMN | 0.290564 | -0.15855 |
| TS155 | 2728 | GCCCAAAATAGTACGCGGATTATTGTTGCACAG | 7317 | AQNSTRIIVAQ | 11906 | NSTRIIV | 0.290552 | -0.32039 |
| GS545 | 2729 | GCCCAAAAAACAGCAGCATGCTCCTCGCACAG | 7318 | AQKNSSMLLAQ | 11907 | KNSSMLL | 0.290508 | -0.18457 |

FIG. 33 (Continued)

| | | | | | | | |
|---|---|---|---|---|---|---|---|
| GS546 | 2730 | GCCCAAAGACAAGTCAGCGGCACCAGCGCACAG | 7319 | AQRQVSGTSAQ | 11908 | RQVSGTS | 0.290227 | -0.07752 |
| SyS1039 | 2731 | GCCCAACCGTCACCGGCAACAGCGACGCACAG | 7320 | AQPVTGNSDAQ | 11909 | PVTGNSD | 0.290223 | -0.13048 |
| GS548 | 2732 | GCCCAAATGTACCCCGACAGACACAGCGCACAG | 7321 | AQMYPDRHSAQ | 11910 | MYPDRHS | 0.29019 | -0.15227 |
| SyS1040 | 2733 | GCCCAAACCTACCAAATCGGCGCCGTCGCACAG | 7322 | AQTYQIGAVAQ | 11911 | TYQIGAV | 0.29007 | -0.19723 |
| GS549 | 2734 | GCCCAAAAAACCGGCAGCCTCAGCGCCGCACAG | 7323 | AQKTGSLSAAQ | 11912 | KTGSLSA | 0.289983 | -0.06165 |
| SyS1041 | 2735 | GCCCAAATCATCCCGCGCAGCAGCCCCGCACAG | 7324 | AQIIPASSPAQ | 11913 | IIPASSP | 0.289839 | 0.121455 |
| GS550 | 2736 | GCCCAAGACAACCAAGGCACCAAACACGCACAG | 7325 | AQDNQGTKHAQ | 11914 | DNQGTKH | 0.289725 | -0.03079 |
| GS551 | 2737 | GCCCAAAGCTACAAAGAAAGCCCCAGCGCACAG | 7326 | AQSYKESPSAQ | 11915 | SYKESPS | 0.28952 | -0.05844 |
| SyS1042 | 2738 | GCCCAAGCCATCATCAGCAACAGAGAGCACAG | 7327 | AQAIISNNRAQ | 11916 | AIISNNR | 0.289509 | -0.09122 |
| SyS1043 | 2739 | GCCCAAACGACCAAATCAGAACCTACGCACAG | 7328 | AQTDQIRTYAQ | 11917 | TDQIRTY | 0.289464 | -0.12291 |
| SyS1044 | 2740 | GCCCAACACAGCGCCACCAACATCGACGCACAG | 7329 | AQHSATNIDAQ | 11918 | HSATNID | 0.289436 | -0.08891 |
| SyS1045 | 2741 | GCCCAAGGCACCGTCAACATCAGCGCCGCACAG | 7330 | AQGTVNISAAQ | 11919 | GTVNISA | 0.2894 | -0.13798 |
| SyS1046 | 2742 | GCCCAAGCTGTTGTTCCGGCTATGCAGGCACAG | 7331 | AQAVVPAMQAQ | 11920 | AVVPAMQ | 0.2894 | -0.23255 |
| SyS1047 | 2743 | GCCCAAATCCCCAGAAGCGACCCCAGCGCACAG | 7332 | AQIPRSDPSAQ | 11921 | IPRSDPS | 0.289334 | 0.133056 |
| GS553 | 2744 | GCCCAAACTAAGTATACGTTGCAGAGTGCACAG | 7333 | AQTKYTLQSAQ | 11922 | TKYTLQS | 0.28888 | -0.06245 |
| SyS1050 | 2745 | GCCCAATCTCTGCGTGAGACGAGTATTGCACAG | 7334 | AQSLRETSIAQ | 11923 | SLRETSI | 0.288816 | -0.08828 |
| SyS1051 | 2746 | GCCCAAGAGGGTGATAATAAGCGGTTGGCACAG | 7335 | AQEGDNKRLAQ | 11924 | EGDNKRL | 0.288603 | -0.16397 |
| SyS1052 | 2747 | GCCCAAATCGTCAGCAGCACCAGCAGCGCACAG | 7336 | AQIVSSTSSAQ | 11925 | IVSSTSS | 0.28856 | 0.01345 |
| GS554 | 2748 | GCCCAATTGGTGAATTCTGGGGCGCATGCACAG | 7337 | AQLVNSGAHAQ | 11926 | LVNSGAH | 0.288432 | -0.09841 |
| SyS1053 | 2749 | GCCCAACGTACGTCGGATAATCAGACGGGCACAG | 7338 | AQRTSDNQTAQ | 11927 | RTSDNQT | 0.288338 | 0.057271 |
| GS555 | 2750 | GCCCAACCGACGGCAAAAGCCTCGCCGCACAG | 7339 | AQPDGKSLAAQ | 11928 | PDGKSLA | 0.288271 | -0.11074 |
| SyS1054 | 2751 | GCCCAACACACAAAAACATGCTGAAACGCACAG | 7340 | AQHKNMLETAQ | 11929 | HKNMLET | 0.288245 | -0.17678 |
| GS556 | 2752 | GCCCAACTCAGCCCGGCGTCACCGCGCACAG | 7341 | AQLSPGVTAAQ | 11930 | LSPGVTA | 0.288083 | -0.08353 |
| TS156 | 2753 | GCCCAAACCAACCACACCAGAAACACCGCACAG | 7342 | AQTNHTRNTAQ | 11931 | TNHTRNT | 0.288053 | 0.024621 |
| SyS1055 | 2754 | GCCCAACTCGGCGACAGCGAAAGAAACGCACAG | 7343 | AQLGDSERNAQ | 11932 | LGDSERN | 0.288003 | -0.13314 |
| SyS1056 | 2755 | GCCCAACTCCTCAAAATCGAACAAATGGCACAG | 7344 | AQLLKIEQMAQ | 11933 | LLKIEQM | 0.288003 | -0.17072 |
| GS557 | 2756 | GCCCAAAGCCACCTCAAAGAACACCCCGCACAG | 7345 | AQSHLKEHPAQ | 11934 | SHLKEHP | 0.287866 | -0.03141 |
| SS68 | 2757 | GCCCAACCCATCGACAACAGACAATACGCACAG | 7346 | AQPIDNRQYAQ | 11935 | PIDNRQY | 0.287402 | -0.31048 |
| SyS1058 | 2758 | GCCCAAGATATGCATTCGGGGGTGAAGGCACAG | 7347 | AQDMHSGVKAQ | 11936 | DMHSGVK | 0.287371 | -0.10493 |
| SyS1059 | 2759 | GCCCAACCTTCGTCGCCTATTCCGAATGCACAG | 7348 | AQPSSPIPNAQ | 11937 | PSSPIPN | 0.287367 | -0.19353 |
| SyS1061 | 2760 | GCCCAACTCAGCAGCACCCTCGACGACGCACAG | 7349 | AQLSSTLDDAQ | 11938 | LSSTLDD | 0.287224 | -0.19011 |
| SyS1062 | 2761 | GCCCAACCCAACACCGCCCACAGCAGCGCACAG | 7350 | AQPNTAHSSAQ | 11939 | PNTAHSS | 0.287109 | -0.03284 |

FIG. 33 (Continued)

| | | | | | | | | |
|---|---|---|---|---|---|---|---|---|
| SyS1063 | 2762 | GCCCAAGCCACCAGAGTCGACGTCATCGCACAG | 7351 | AQATRVDVIAQ | 11940 | ATRVDVI | 0.28708 | 0.115394 |
| GS558 | 2763 | GCCCAAAGCACCAACGTCACCACCGTCGCACAG | 7352 | AQSTNVTTVAQ | 11941 | STNVTTV | 0.287059 | -0.10292 |
| SyS1064 | 2764 | GCCCAATATGGTAATAATAGTTTAGTGCACAG | 7353 | AQYGNNSFSAQ | 11942 | YGNNSFS | 0.28698 | 0.020733 |
| SyS1065 | 2765 | GCCCAACCCACCGCCAAACCCATGTACGCACAG | 7354 | AQPTAKPMYAQ | 11943 | PTAKPMY | 0.28686 | -0.0907 |
| SyS1066 | 2766 | GCCCAACTCCCAACCTCCCACCATGCACAG | 7355 | AQLPNLPTIAQ | 11944 | LPNLPTI | 0.286792 | -0.17799 |
| GS560 | 2767 | GCCCAAACTAGGTTGCCGAATATTAGTGCACAG | 7356 | AQTRLPNISAQ | 11945 | TRLPNIS | 0.286766 | -0.17022 |
| GS561 | 2768 | GCCCAACATAAGCATTCTACGCAGGGTGCACAG | 7357 | AQHKHSTQGAQ | 11946 | HKHSTQG | 0.286766 | -0.17022 |
| GS562 | 2769 | GCCCAAAATGGTACGAATGGTTTTACTGCACAG | 7358 | AQNGTNGFTAQ | 11947 | NGTNGFT | 0.286695 | -0.06992 |
| SyS1067 | 2770 | GCCCAAAGCACCGACGCCATCAGATTCGCACAG | 7359 | AQSTDAIRFAQ | 11948 | STDAIRF | 0.286524 | -0.12222 |
| GS563 | 2771 | GCCCAACTGGTTCGTGATCATACGGCGGCACAG | 7360 | AQLVRDHTAAQ | 11949 | LVRDHTA | 0.286491 | -0.11663 |
| SyS1069 | 2772 | GCCCAAATCAGCCTCGGCTACAGCAAAGCACAG | 7361 | AQISLGYSKAQ | 11950 | ISLGYSK | 0.286475 | -0.21557 |
| SyS1070 | 2773 | GCCCAACTTTTTGGTTCTTCGCATACGGCACAG | 7362 | AQLFGSSHTAQ | 11951 | LFGSSHT | 0.286475 | -0.21557 |
| SyS1071 | 2774 | GCCCAAAGCACCATCACCCCAGACTCGCACAG | 7363 | AQSTITPRLAQ | 11952 | STITPRL | 0.286416 | -0.16587 |
| SyS1072 | 2775 | GCCCAACAACAGATTACTAATGGGCTGCGTGCACAG | 7364 | AQQITNGLRAQ | 11953 | QITNGLR | 0.286347 | -0.11252 |
| SyS1073 | 2776 | GCCCAAACGACCGGAGTATAATATTCGTGCACAG | 7365 | AQTTEYNIRAQ | 11954 | TTEYNIR | 0.286245 | -0.1101 |
| SyS1074 | 2777 | GCCCAAACCGACCTCGGCAGAGGCACCGCACAG | 7366 | AQTDLGRGTAQ | 11955 | TDLGRGT | 0.286128 | 0.04021 |
| GS564 | 2778 | GCCCAAGAAAGAAGCCCCACCATCCTCGCACAG | 7367 | AQERSPTILAQ | 11956 | ERSPTIL | 0.286103 | -0.17195 |
| SyS1075 | 2779 | GCCCAACATGGGGATTCTGCGAGGACTGCACAG | 7368 | AQHGDSARTAQ | 11957 | HGDSART | 0.286062 | 0.001434 |
| SyS1077 | 2780 | GCCCCAATTGAGTGTGCCTAATCAGCAGGCACAG | 7369 | AQLSVPNQQAQ | 11958 | LSVPNQQ | 0.285811 | 0.019619 |
| SyS1078 | 2781 | GCCCAAAGCGACGGCCCCGTCCCAGAGCACAG | 7370 | AQSDGPVPRAQ | 11959 | SDGPVPR | 0.285737 | -0.10136 |
| GS565 | 2782 | GCCCAAAATATGAATCATATTGCTTCTGCACAG | 7371 | AQNMNHIASAQ | 11960 | NMNHIAS | 0.28572 | -0.04994 |
| SyS1079 | 2783 | GCCCAAGTCCCAACAGCCCCAAAGAGCACAG | 7372 | AQVPNSPQRAQ | 11961 | VPNSPQR | 0.285696 | -0.06754 |
| SS70 | 2784 | GCCCAAGACAGAATGGCCAGCAGCAGAGCACAG | 7373 | AQDRMASSRAQ | 11962 | DRMASSR | 0.285607 | -0.34425 |
| SyS1080 | 2785 | GCCCAATTGCTGTCGAATTGCAGTCAGGCACAG | 7374 | AQLLSNSSQAQ | 11963 | LLSNSSQ | 0.285424 | 0.07245 |
| GS567 | 2786 | GCCCAAGAGACGCGGGTGTTGAATCATGCACAG | 7375 | AQETAVLNHAQ | 11964 | ETAVLNH | 0.285405 | -0.14868 |
| GS568 | 2787 | GCCCAAGAACAAAGAACCCCAGCCCCGCACAG | 7376 | AQEQRTPSPAQ | 11965 | EQRTPSP | 0.285349 | -0.02041 |
| SyS1081 | 2788 | GCCCAACAACACCTCAACGGCAGCATCGCACAG | 7377 | AQQHLNGSIAQ | 11966 | QHLNGSI | 0.285255 | 0.080069 |
| SyS1082 | 2789 | GCCCAAAGCGTCCTCCAAGTCGAAGGCGCACAG | 7378 | AQSVLQVEGAQ | 11967 | SVLQVEG | 0.285245 | -0.17259 |
| SyS1083 | 2790 | GCCCAATTTCTGTCGGGTACGACTAAGGCACAG | 7379 | AQFLSGTTKAQ | 11968 | FLSGTTK | 0.285183 | -0.17314 |
| SyS1085 | 2791 | GCCCAAGGTAATCCGAATGATCGGCAGGCACAG | 7380 | AQGNPNDRQAQ | 11969 | GNPNDRQ | 0.284868 | 0.038445 |
| SyS1086 | 2792 | GCCCAAACCGACAAAGCCGTCCAAATCGCACAG | 7381 | AQTDKAVQIAQ | 11970 | TDKAVQI | 0.284813 | -0.02105 |
| GS569 | 2793 | GCCCAAGAGAAGTATACGGGTTCGCCTGCACAG | 7382 | AQEKYTGSPAQ | 11971 | EKYTGSP | 0.284752 | -0.08897 |

FIG. 33 (Continued)

| | | | | | | | | |
|---|---|---|---|---|---|---|---|---|
| GS570 | 2794 | GCCCAACTCGCCGGCGAGCAGCAGAAACCTCGCACAG | 7383 | AQLAGSRNLAQ | 11972 | LAGSRNL | 0.284402 | -0.02848 |
| SyS1087 | 2795 | GCCCAAATGATCCCAGCACCAACTTCGCACAG | 7384 | AQMIPSTNFAQ | 11973 | MIPSTNF | 0.28421 | -0.0822 |
| GS572 | 2796 | GCCCAACCTTTGACGGGTTCTAGTGCTGCACAG | 7385 | AQPLTGSSAAQ | 11974 | PLTGSSA | 0.284117 | -0.10557 |
| SyS1088 | 2797 | GCCCAAAGCGTCAGCAACGCCTTCAGCGCACAG | 7386 | AQSVSNAFSAQ | 11975 | SVSNAFS | 0.284101 | -0.196 |
| GS573 | 2798 | GCCCAACAGGGGGGTCAGGCGCTTAGGGCACAG | 7387 | AQQGGQALRAQ | 11976 | QGGQALR | 0.283993 | -0.16337 |
| GS574 | 2799 | GCCCAACACCCCGGCCAAACCCTCAGCGCACAG | 7388 | AQHPGQTLSAQ | 11977 | HPGQTLS | 0.28394 | -0.15586 |
| GS575 | 2800 | GCCCAAAAGGAGTATAATACGTATAGTGCACAG | 7389 | AQKEYNTYSAQ | 11978 | KEYNTYS | 0.283589 | -0.1701 |
| SyS1089 | 2801 | GCCCAAACCCACACGCCCAACCCAGCGCACAG | 7390 | AQTHTAQPSAQ | 11979 | THTAQPS | 0.283513 | -0.14667 |
| SyS1090 | 2802 | GCCCAAATGACGCCGCAGGTTCCTGTGCACAG | 7391 | AQMTPQVPRAQ | 11980 | MTPQVPR | 0.283499 | -0.15617 |
| SyS1091 | 2803 | GCCCAAACTCGGGTTTCTAGTCTTGCGGCACAG | 7392 | AQTRVSSLAAQ | 11981 | TRVSSLA | 0.283423 | -0.15011 |
| SyS1092 | 2804 | GCCCAACACGCGACCTCAAAATCGTCGCACAG | 7393 | AQHADLKIVAQ | 11982 | HADLKIV | 0.283397 | -0.05645 |
| SyS1093 | 2805 | GCCCAAAACAGAAACACCGACACCGTCGCACAG | 7394 | AQNRNTDTVAQ | 11983 | NRNTDTV | 0.283396 | -0.01003 |
| SyS1094 | 2806 | GCCCAAGCCACAAAGACAACCACCTCGCACAG | 7395 | AQAHKDNHLAQ | 11984 | AHKDNHL | 0.283218 | -0.13192 |
| SyS1095 | 2807 | GCCCAATCTGTTCCTGTGCCTGCTGCACAG | 7396 | AQSVPVPAAAQ | 11985 | SVPVPAA | 0.283166 | -0.09997 |
| GS577 | 2808 | GCCCAACAAACCAACAGCGCCCTCATGGCACAG | 7397 | AQQTNSALMAQ | 11986 | QTNSALM | 0.283146 | -0.11549 |
| GS578 | 2809 | GCCCAACTCGGCAGAGACACCGCCTACGCACAG | 7398 | AQLGRDTAYAQ | 11987 | LGRDTAY | 0.283146 | -0.09664 |
| SyP48 | 2810 | GCCCAAAGTTCTGTTGCTCTTGTTGTTGCACAG | 7399 | AQSSVALVVAQ | 11988 | SSVALVV | 0.282934 | -0.04243 |
| GS579 | 2811 | GCCCAAATGAACGCGCCACCCAAGCACAG | 7400 | AQMNAATTQAQ | 11989 | MNAATTQ | 0.282892 | -0.11642 |
| GS581 | 2812 | GCCCAAATGGTTTCTACGGCTAAGGATGCACAG | 7401 | AQMVSTAKDAQ | 11990 | MVSTAKD | 0.282806 | -0.01428 |
| SyS1097 | 2813 | GCCCAACTGGGTCAGATGTATTCTCCGGCACAG | 7402 | AQLGQMYSPAQ | 11991 | LGQMYSP | 0.28245 | -0.19723 |
| GS583 | 2814 | GCCCAAGATTCGAAGGAGAAGCCTAATGCACAG | 7403 | AQDSKEKPNAQ | 11992 | DSKEKPN | 0.282074 | -0.18816 |
| SyS1098 | 2815 | GCCCAAAGCCCCCCGTCCAAGGCCTCGCACAG | 7404 | AQSPPVQGLAQ | 11993 | SPPVQGL | 0.28194 | -0.10889 |
| SyS1099 | 2816 | GCCCAAACTGCGTCGGATCGTTTGCCGGCACAG | 7405 | AQTASDRLPAQ | 11994 | TASDRLP | 0.281925 | -0.04427 |
| SyS1100 | 2817 | GCCCAAATCTACAGCCCCACCGTCGCACAG | 7406 | AQIYSPTTVAQ | 11995 | IYSPTTV | 0.28173 | 0.009655 |
| SyS1101 | 2818 | GCCCAAAGTCAGTCTAAGGAGCTGCGGGCACAG | 7407 | AQSQSKELRAQ | 11996 | SQSKELR | 0.28162 | -0.14795 |
| SyS1102 | 2819 | GCCCAAGGCGCCCTCAACGGCGGCGTCGCACAG | 7408 | AQGALNGGVAQ | 11997 | GALNGGV | 0.28162 | -0.09251 |
| GS585 | 2820 | GCCCAAACTATTATTAATTCGAGTAAGGCACAG | 7409 | AQTIINSSKAQ | 11998 | TIINSSK | 0.281489 | -0.18054 |
| GS586 | 2821 | GCCCAACCTGTGAGTGCTCAGCCTGTTGCACAG | 7410 | AQPVSAQPVAQ | 11999 | PVSAQPV | 0.281416 | -0.16663 |
| SyS1103 | 2822 | GCCCAATCTAATGAGGCGGTGACTAATGCACAG | 7411 | AQSNEAVTNAQ | 12000 | SNEAVTN | 0.281348 | -0.11723 |
| SyS1104 | 2823 | GCCCAAGCGAGTATGCAGATGAATCGTGCACAG | 7412 | AQASMQMNRAQ | 12001 | ASMQMNR | 0.281339 | -0.06586 |
| SyS1105 | 2824 | GCCCAAAGCGTCGGCAAAAGCGAACTCGCACAG | 7413 | AQSVGKSELAQ | 12002 | SVGKSEL | 0.281132 | 0.014504 |
| SyS1106 | 2825 | GCCCAATCTCAGGTTAATCCTTCTAGTGCACAG | 7414 | AQSQVNPSSAQ | 12003 | SQVNPSS | 0.280883 | -0.06161 |

FIG. 33 (Continued)

| | | | | | | | | |
|---|---|---|---|---|---|---|---|---|
| SyS1107 | 2826 | GCCCAAATTACGACTGATCAGCCTTTTGCACAG | 7415 | AQITTDQPFAQ | 12004 | ITTDQPF | 0.280883 | -0.16466 |
| SyS1109 | 2827 | GCCCAAAATAATGGGTCTGGTTCTTATGCACAG | 7416 | AQNNGSGSYAQ | 12005 | NNGSGSY | 0.280653 | -0.22064 |
| GS587 | 2828 | GCCCAAAACCCTCGCCAGAAGCAGCGTCGCACAG | 7417 | AQTLARSSVAQ | 12006 | TLARSSV | 0.280506 | 0.024598 |
| GS588 | 2829 | GCCCAAAACGCCAGCACCATGACCAGAGCACAG | 7418 | AQNASTMTRAQ | 12007 | NASTMTR | 0.280372 | -0.01638 |
| GP124 | 2830 | GCCCAAACGAATCAGGTGAGGTATGTTGCACAG | 7419 | AQTNQVRYVAQ | 12008 | TNQVRYV | 0.280321 | -0.06218 |
| GS589 | 2831 | GCCCAAAGCACCCAAAGCCCAACAGAGCACAG | 7420 | AQSTQSPNRAQ | 12009 | STQSPNR | 0.280294 | -0.0613 |
| GS590 | 2832 | GCCCAAGATACGGGGGCGGAGGGGTTGGCACAG | 7421 | AQDTGARGLAQ | 12010 | DTGARGL | 0.279908 | -0.09508 |
| SyS1110 | 2833 | GCCCAACCTGGTTCTCATGTGGTGGCTGCACAG | 7422 | AQPGSHVVAAQ | 12011 | PGSHVVA | 0.279813 | -0.10701 |
| SyS1112 | 2834 | GCCCAAGCCAACGGCATCGAAACCAAAGCACAG | 7423 | AQANGIETKAQ | 12012 | ANGIETK | 0.279639 | -0.14768 |
| SyS1113 | 2835 | GCCCAAGCGCATGGTCAGGTGCAGGAGGCACAG | 7424 | AQAHGQVQEAQ | 12013 | AHGQVQE | 0.279602 | -0.15374 |
| SyS1114 | 2836 | GCCCAAGCTCTGAGTCATGATCTTTCGGCACAG | 7425 | AQALSHDLSAQ | 12014 | ALSHDLS | 0.279563 | -0.15981 |
| SyS1115 | 2837 | GCCCAACTCGGCAGCAGCCTCACCGCCGCACAG | 7426 | AQLGSSLTAAQ | 12015 | LGSSLTA | 0.279545 | -0.0211 |
| SS74 | 2838 | GCCCAAGGCAACAACACCGCCAAACTCGCACAG | 7427 | AQGNNTAKLAQ | 12016 | GNNTAKL | 0.279413 | -0.32548 |
| SyS1116 | 2839 | GCCCAAAATTATGCTCAGTCGCCTTGCACAG | 7428 | AQNYAQSALAQ | 12017 | NYAQSAL | 0.279327 | -0.19011 |
| GS592 | 2840 | GCCCAAGATTCGCAGAGTAAGACTTTGCACAG | 7429 | AQDSQSKTFAQ | 12018 | DSQSKTF | 0.279314 | -0.15955 |
| TS157 | 2841 | GCCCAAACTAATCATGTTAAGTTTACGGCACAG | 7430 | AQTNHVKFTAQ | 12019 | TNHVKFT | 0.279279 | -0.09196 |
| GS593 | 2842 | GCCCAAAGCACCCCACCCCGGCCTCGCACAG | 7431 | AQSTPTHGLAQ | 12020 | STPTHGL | 0.279226 | -0.09374 |
| SyS1117 | 2843 | GCCCAAAGTGTGGGGTTGACGATGGTGGCACAG | 7432 | AQSVGLTMVAQ | 12021 | SVGLTMV | 0.279206 | -0.20224 |
| SyS1118 | 2844 | GCCCAAATTCCGAAGGGTTCTGGGGCGGCACAG | 7433 | AQIPKGSGAAQ | 12022 | IPKGSGA | 0.279091 | 0.080236 |
| GS594 | 2845 | GCCCAAACGCCCAAGCCAGAGTCCTCGCACAG | 7434 | AQTAQARVLAQ | 12023 | TAQARVL | 0.279047 | -0.1122 |
| GS595 | 2846 | GCCCAATGGCACGCCGGCAGCGTCGGCGCACAG | 7435 | AQWHAGSVGAQ | 12024 | WHAGSVG | 0.279017 | -0.09667 |
| SyS1119 | 2847 | GCCCAATCGCAGTCTCTTTGGTTGAGGCACAG | 7436 | AQSQSLLVEAQ | 12025 | SQSLLVE | 0.278987 | -0.22042 |
| SyS1120 | 2848 | GCCCAAAATAATAGTGGGCTTTGAAGGCACAG | 7437 | AQNNSGPLKAQ | 12026 | NNSGPLK | 0.278922 | -0.21078 |
| SyS1121 | 2849 | GCCCAAAGGGATAATGCTATTGAGCATGCACAG | 7438 | AQRDNAIEHAQ | 12027 | RDNAIEH | 0.278763 | -0.17259 |
| GS597 | 2850 | GCCCAAACTATGTCGAATATTACGAGGCACAG | 7439 | AQTMSNITRAQ | 12028 | TMSNITR | 0.278669 | 0.034782 |
| SyS1122 | 2851 | GCCCAACTCAGCACCCTCAGCCAAATGGCACAG | 7440 | AQLSTLSQMAQ | 12029 | LSTLSQM | 0.278541 | -0.0734 |
| GS598 | 2852 | GCCCAAGTCATGCAAAACTACGGCAGCGCACAG | 7441 | AQVMQNYGSAQ | 12030 | VMQNYGS | 0.278395 | -0.1774 |
| SyS1123 | 2853 | GCCCAAACTCATTCGGCGCAGCAGAATGCACAG | 7442 | AQTHSAQQNAQ | 12031 | THSAQQN | 0.277996 | -0.10236 |
| GS601 | 2854 | GCCCAATGCGGTTCCTCCGAATAGGAATGCACAG | 7443 | AQSVPPNRNAQ | 12032 | SVPPNRN | 0.277804 | -0.13857 |
| SyS1125 | 2855 | GCCCAATCTGTTGCGGCGAGTCCTCGTGCACAG | 7444 | AQSVAASPRAQ | 12033 | SVAASPR | 0.277759 | -0.03359 |
| SyS1127 | 2856 | GCCCAAAATAATACTTCGACGCTGCATGCACAG | 7445 | AQNNTSTLHAQ | 12034 | NNTSTLH | 0.277642 | -0.19739 |
| SyS1128 | 2857 | GCCCAAAATCTTTCTGATCATATGCCGGCACAG | 7446 | AQNLSDHMPAQ | 12035 | NLSDHMP | 0.277561 | -0.22803 |

FIG. 33 (Continued)

| | | | | | | | |
|---|---|---|---|---|---|---|---|
| GP125 | 2858 | GCCCAAGGTCTGTATGCTACGACTTCTGCACAG | 7447 | AQGLYATTSAQ | 12036 | GLYATTS | 0.277546 | 0.324596 |
| SyS1129 | 2859 | GCCCAACGTAATGGTGGTGCGAATGTTGCACAG | 7448 | AQRNGGANVAQ | 12037 | RNGGANV | 0.277332 | 0.271066 |
| SyS1130 | 2860 | GCCCAATTCCACAACCTCACCCTCAGCGCACAG | 7449 | AQFHNLTLSAQ | 12038 | FHNLTLS | 0.277251 | -0.09337 |
| SyS1131 | 2861 | GCCCAATGGAAGAGTCCTGCTGCTATTGCACAG | 7450 | AQWKSPAAIAQ | 12039 | WKSPAAI | 0.277234 | -0.14405 |
| SyS1132 | 2862 | GCCCAACCCAAAGGCCTCAGCGGCGAAGCACAG | 7451 | AQPKGLSGEAQ | 12040 | PKGLSGE | 0.277183 | 0.248416 |
| GS603 | 2863 | GCCCAATCGCATTATCAGTTGCATCCGGCACAG | 7452 | AQSHYQLHPAQ | 12041 | SHYQLHP | 0.27717 | -0.17005 |
| SyS1133 | 2864 | GCCCAACCACCTTCAGAAGCGCCCCGCACAG | 7453 | AQTTFRSAPAQ | 12042 | TTFRSAP | 0.277074 | -0.08464 |
| SyS1134 | 2865 | GCCCAATACGACGCCACCCACAGCGCCGCACAG | 7454 | AQYDATHSAAQ | 12043 | YDATHSA | 0.27674 | -0.16889 |
| GS605 | 2866 | GCCCAAAATCAGTCGGGTCCGTTGAAGGCACAG | 7455 | AQNQSGPLKAQ | 12044 | NQSGPLK | 0.276624 | -0.00392 |
| SyS1135 | 2867 | GCCCAACACACCAACATGACCAGCATGGCACAG | 7456 | AQHTNMTSMAQ | 12045 | HTNMTSM | 0.276609 | 0.123822 |
| SyS1136 | 2868 | GCCCAACATATGAAGAGTCAGCTGCCGGCACAG | 7457 | AQHMKSQLPAQ | 12046 | HMKSQLP | 0.276324 | 0.098421 |
| GS606 | 2869 | GCCCAAAAACTCCCACCATGGCCAACGCACAG | 7458 | AQKLPTMANAQ | 12047 | KLPTMAN | 0.275986 | -0.0594 |
| GS607 | 2870 | GCCCAAGTTGGGACTAATGCGAATCATGCACAG | 7459 | AQVGTNANHAQ | 12048 | VGTNANH | 0.275965 | -0.13666 |
| GP126 | 2871 | GCCCAATTGAAGACTGATCCTTTTCTGGCACAG | 7460 | AQLKTDPFLAQ | 12049 | LKTDPFL | 0.275884 | -0.07259 |
| GS608 | 2872 | GCCCAACACCTCCAACAAAACCTCACCGCACAG | 7461 | AQHLQQNLTAQ | 12050 | HLQQNLT | 0.275812 | -0.16146 |
| SyS1137 | 2873 | GCCCAAACTCAGAATAAGAATTCTCATGCACAG | 7462 | AQTQNKNSHAQ | 12051 | TQNKNSH | 0.275704 | -0.04648 |
| SS76 | 2874 | GCCCAACCCAACGCCCAAAGCCAAAGAGCACAG | 7463 | AQPNAQSQRAQ | 12052 | PNAQSQR | 0.27556 | -0.34576 |
| SyS1138 | 2875 | GCCCAAGGTAGTGGTCATTCGACTCTTGCACAG | 7464 | AQGSGHSTLAQ | 12053 | GSGHSTL | 0.275521 | -0.11616 |
| SyS1139 | 2876 | GCCCAATTGACGGGTAGGCTTGAGAAGGCACAG | 7465 | AQLTGRLEKAQ | 12054 | LTGRLEK | 0.275499 | -0.06888 |
| SyS1140 | 2877 | GCCCAACCCAGCAGAAACGCCAGCCTCGCACAG | 7466 | AQPSRNASLAQ | 12055 | PSRNASL | 0.275483 | -0.0216 |
| GS610 | 2878 | GCCCAAGTTTTAGGACGTCGGATCTTGCACAG | 7467 | AQVFRTSDLAQ | 12056 | VFRTSDL | 0.275429 | -0.12297 |
| GS611 | 2879 | GCCCAAATCGCCAGCACCTACAGCAGCGCACAG | 7468 | AQIASTYSSAQ | 12057 | IASTYSS | 0.275379 | 0.042246 |
| SyS1141 | 2880 | GCCCAAACCATCAACCACGCCACCAGCGCACAG | 7469 | AQTINHATSAQ | 12058 | TINHATS | 0.275307 | 0.060839 |
| SyS1142 | 2881 | GCCCAAGCTATGAATAATCGTGCTCATGCACAG | 7470 | AQAMNNRAHAQ | 12059 | AMNNRAH | 0.275089 | -0.19723 |
| GS612 | 2882 | GCCCAATCGCATCATGAGCAGGTTTCTGCACAG | 7471 | AQSHHEQVSAQ | 12060 | SHHEQVS | 0.274982 | -0.12807 |
| SyS1143 | 2883 | GCCCAATCGGGGGTTACTAGTAAGCTTGCACAG | 7472 | AQSGVTSKLAQ | 12061 | SGVTSKL | 0.274938 | -0.12208 |
| SyS1144 | 2884 | GCCCAAGTGTTTACTAATGATGTGCCTGCACAG | 7473 | AQVFTNDVPAQ | 12062 | VFTNDVP | 0.274934 | -0.14041 |
| SyS1145 | 2885 | GCCCAAGCTGCGGTGTTGGTGGCTCCGGCACAG | 7474 | AQAAVLVAPAQ | 12063 | AAVLVAP | 0.274757 | -0.22434 |
| GS613 | 2886 | GCCCAACCCACGGCCAGATACCTGCCGGCACAG | 7475 | AQPTAGRYLAQ | 12064 | PTAGRYL | 0.274712 | -0.18816 |
| GS614 | 2887 | GCCCAACATCTTAATTCGCAGAATATGGCACAG | 7476 | AQHLNSQNMAQ | 12065 | HLNSQNM | 0.274394 | -0.04601 |
| SyS1146 | 2888 | GCCCAACCCAACGTCGGGCAGAGCACAG | 7477 | AQPNPNVGRAQ | 12066 | PNPNVGR | 0.274299 | 0.025701 |
| SyS1147 | 2889 | GCCCAAGCTAGTGAGAATCTTCGTTCGGCACAG | 7478 | AQASENLRSAQ | 12067 | ASENLRS | 0.2742 | -0.12824 |

FIG. 33 (Continued)

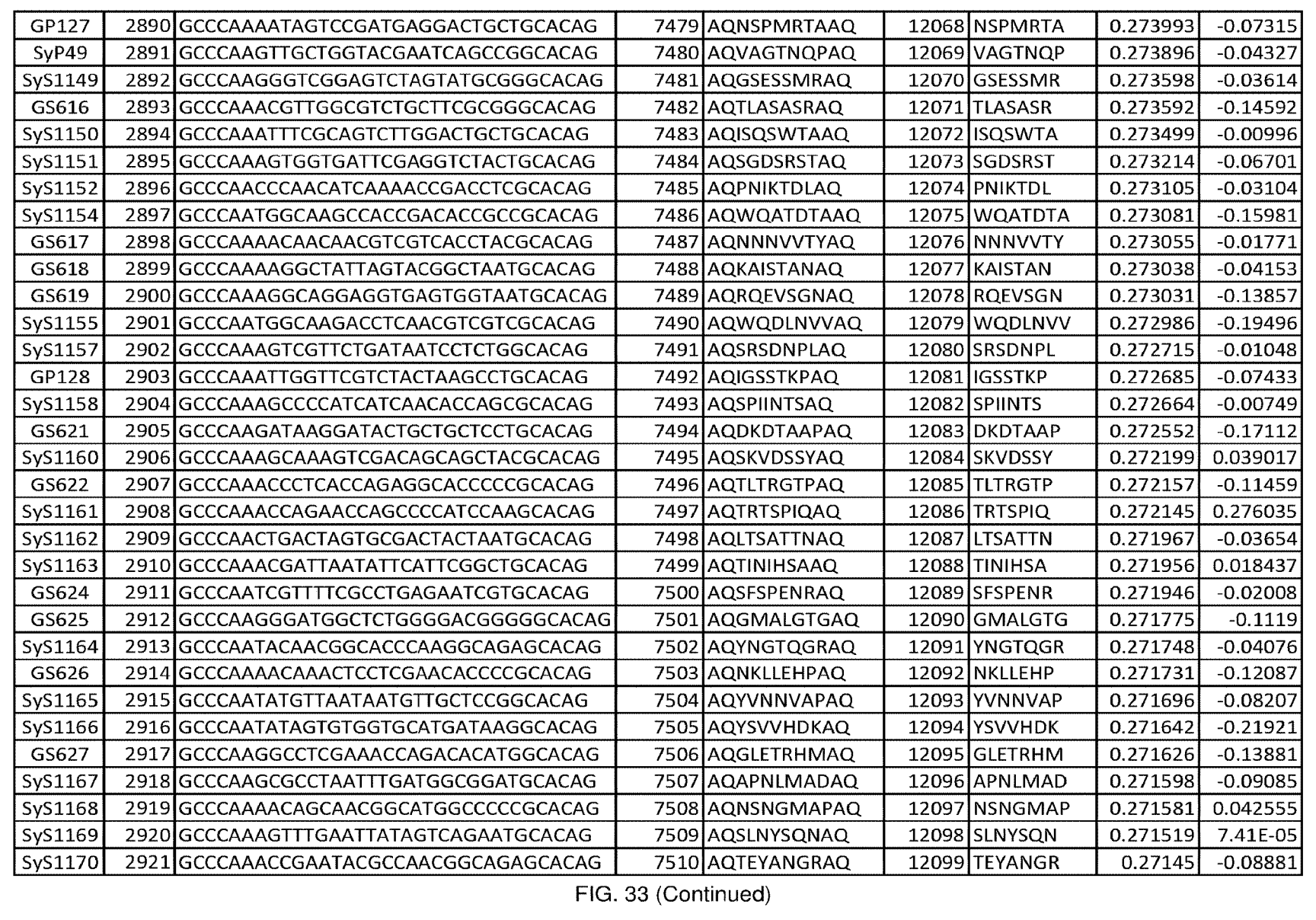

| | | | | | | | | |
|---|---|---|---|---|---|---|---|---|
| GP127 | 2890 | GCCCAAAATAGTCCGATGAGGACTGCTGCACAG | 7479 | AQNSPMRTAAQ | 12068 | NSPMRTA | 0.273993 | -0.07315 |
| SyP49 | 2891 | GCCCAAGTTGCTGGTACGAATCAGCGGCACAG | 7480 | AQVAGTNQPAQ | 12069 | VAGTNQP | 0.273896 | -0.04327 |
| SyS1149 | 2892 | GCCCAAACGTTGGCGTCTGCTTCGCGGGCACAG | 7481 | AQGSESSMRAQ | 12070 | GSESSMR | 0.273598 | -0.03614 |
| GS616 | 2893 | GCCCAAATTTCGCAGTCTTGGACTGCTGCACAG | 7482 | AQTLASASRAQ | 12071 | TLASASR | 0.273592 | -0.14592 |
| SyS1150 | 2894 | GCCCAAAGTGGTGATTCGAGGTCTACTGCACAG | 7483 | AQISQSWTAAQ | 12072 | ISQSWTA | 0.273499 | -0.00996 |
| SyS1151 | 2895 | GCCCAAAGTGGTGATTCGAGGTCTACTGCACAG | 7484 | AQSGDSRSTAQ | 12073 | SGDSRST | 0.273214 | -0.06701 |
| SyS1152 | 2896 | GCCCAACCCAACATCAAAACCGACCTCGCACAG | 7485 | AQPNIKTDLAQ | 12074 | PNIKTDL | 0.273105 | -0.03104 |
| SyS1154 | 2897 | GCCCAATGGCAAGCACCGACACCGCCGCACAG | 7486 | AQWQATDTAAQ | 12075 | WQATDTA | 0.273081 | -0.15981 |
| GS617 | 2898 | GCCCAAAACAACAACGTCGTCACCTAGGCACAG | 7487 | AQNNNVVTYAQ | 12076 | NNNVVTY | 0.273055 | -0.01771 |
| GS618 | 2899 | GCCCAAAAGGCTATTAGTACGGCTAATGCACAG | 7488 | AQKAISTANAQ | 12077 | KAISTAN | 0.273038 | -0.04153 |
| GS619 | 2900 | GCCCAAAGGCAGGAGGTGAGTGGTAATGCACAG | 7489 | AQRQEVSGNAQ | 12078 | RQEVSGN | 0.273031 | -0.13857 |
| SyS1155 | 2901 | GCCCAATGGCAAGACCTCAACGTCGTCGCACAG | 7490 | AQWQDLNVVAQ | 12079 | WQDLNVV | 0.272986 | -0.19496 |
| SyS1157 | 2902 | GCCCAAAGTCGTTCTGATAATCCTCTGGCACAG | 7491 | AQSRSDNPLAQ | 12080 | SRSDNPL | 0.272715 | -0.01048 |
| GP128 | 2903 | GCCCAAAATTGGTTCGTTCGTTACTAAGCCTGCACAG | 7492 | AQIGSSTKPAQ | 12081 | IGSSTKP | 0.272685 | -0.07433 |
| SyS1158 | 2904 | GCCCAAAGCCCCATCATCAACACCAGCGCACAG | 7493 | AQSPIINTSAQ | 12082 | SPIINTS | 0.272664 | -0.00749 |
| GS621 | 2905 | GCCCAAGATAAGGATACTGCTGCTCCTGCACAG | 7494 | AQDKDTAAPAQ | 12083 | DKDTAAP | 0.272552 | -0.17112 |
| SyS1160 | 2906 | GCCCAAAGCAAAGTCGACAGCAGCTACGCCACAG | 7495 | AQSKVDSSYAQ | 12084 | SKVDSSY | 0.272199 | 0.039017 |
| GS622 | 2907 | GCCCAAACCCTCACCAGAGGCACCCCGCACAG | 7496 | AQTLTRGTPAQ | 12085 | TLTRGTP | 0.272157 | -0.11459 |
| SyS1161 | 2908 | GCCCAAACCAGAACCAGCCCCATCCAAGCACAG | 7497 | AQTRTSPIQAQ | 12086 | TRTSPIQ | 0.272145 | 0.276035 |
| SyS1162 | 2909 | GCCCAACTGACTAGTGCGACTACTAATGCACAG | 7498 | AQLTSATTNAQ | 12087 | LTSATTN | 0.271967 | -0.03654 |
| SyS1163 | 2910 | GCCCAAACGATTAATATTCATTCGGCTGCACAG | 7499 | AQTINIHSAAQ | 12088 | TINIHSA | 0.271956 | 0.018437 |
| GS624 | 2911 | GCCCAATCGTTTCGCCTGAGAATCGTGCACAG | 7500 | AQSFSPENRAQ | 12089 | SFSPENR | 0.271946 | -0.02008 |
| GS625 | 2912 | GCCCAAGGGATGGCTCTGGGGACGGGGGCACAG | 7501 | AQGMALGTGAQ | 12090 | GMALGTG | 0.271775 | -0.1119 |
| SyS1164 | 2913 | GCCCAATACAACGGCACCAAGGCAGAGCACAG | 7502 | AQYNGTQGRAQ | 12091 | YNGTQGR | 0.271748 | -0.04076 |
| GS626 | 2914 | GCCCAAAACAAACTCCTCGAACACCCCGCACAG | 7503 | AQNKLLEHPAQ | 12092 | NKLLEHP | 0.271731 | -0.12087 |
| SyS1165 | 2915 | GCCCAATATGTTAATAATGTTGCTCCGGCACAG | 7504 | AQYVNNVAPAQ | 12093 | YVNNVAP | 0.271696 | -0.08207 |
| SyS1166 | 2916 | GCCCAATATAGTGGTGCATGATAAGGCACAG | 7505 | AQYSVVHDKAQ | 12094 | YSVVHDK | 0.271642 | -0.21921 |
| GS627 | 2917 | GCCCAAGGCCTCGAAACCAGACACATGGCACAG | 7506 | AQGLETRHMAQ | 12095 | GLETRHM | 0.271626 | -0.13881 |
| SyS1167 | 2918 | GCCCAAGCGCCTAATTTGATGGCGGATGCACAG | 7507 | AQAPNLMADAQ | 12096 | APNLMAD | 0.271598 | -0.09085 |
| SyS1168 | 2919 | GCCCAAAACAGCAACGGCATGGCCCCGCACAG | 7508 | AQNSNGMAPAQ | 12097 | NSNGMAP | 0.271581 | 0.042555 |
| SyS1169 | 2920 | GCCCAAAGTTTGAATTATATAGTCAGAATGCACAG | 7509 | AQSLNYSQNAQ | 12098 | SLNYSQN | 0.271519 | 7.41E-05 |
| SyS1170 | 2921 | GCCCAAAACCGAATACGCCAACGGCAGAGCACAG | 7510 | AQTEYANGRAQ | 12099 | TEYANGR | 0.27145 | -0.08881 |

FIG. 33 (Continued)

| | | | | | | | | |
|---|---|---|---|---|---|---|---|---|
| GP129 | 2922 | GCCCAACCTCTTGGGCATGTTAGGTCTGCACAG | 7511 | AQPLGHVRSAQ | 12100 | PLGHVRS | 0.271369 | 0.161673 |
| GS628 | 2923 | GCCCAACTTCGGGATTCGCCGGGGCTGGCACAG | 7512 | AQLRDSPGLAQ | 12101 | LRDSPGL | 0.271307 | -0.1747 |
| SyS1171 | 2924 | GCCCAAGTTATTAGGTCGAATACTCATGCACAG | 7513 | AQVIRSNTHAQ | 12102 | VIRSNTH | 0.271216 | -0.15781 |
| SyS1172 | 2925 | GCCCAAGCGTCGGTGAGTAATCTTTCGGCACAG | 7514 | AQASVSNLSAQ | 12103 | ASVSNLS | 0.271028 | -0.12012 |
| SyS1173 | 2926 | GCCCAATGGGCCCAAAGAACCAGCCAAGCACAG | 7515 | AQWAQRTSQAQ | 12104 | WAQRTSQ | 0.271025 | -0.17382 |
| GS630 | 2927 | GCCCAAAACGACAAAGGCATGAGCAGAGCACAG | 7516 | AQNDKGMSRAQ | 12105 | NDKGMSR | 0.270989 | -0.07517 |
| GP130 | 2928 | GCCCAACAGAATGATACTCGTAATTATGCACAG | 7517 | AQQNDTRNYAQ | 12106 | QNDTRNY | 0.270955 | -0.07273 |
| SyS1174 | 2929 | GCCCAAGGCGAAGTCGCCGGCAGACTCGCACAG | 7518 | AQGEVAGRLAQ | 12107 | GEVAGRL | 0.270924 | -0.02281 |
| SyS1175 | 2930 | GCCCAAACCACCACCAACACCGTCAGCGCACAG | 7519 | AQTTTNTVSAQ | 12108 | TTTNTVS | 0.270848 | -0.1792 |
| SyS1176 | 2931 | GCCCAACCGGTTATGTCGAATAAGGATGCACAG | 7520 | AQPVMSNKDAQ | 12109 | PVMSNKD | 0.270622 | -0.13314 |
| GS632 | 2932 | GCCCAAAACGGGCGGCACCACCTTCATCGCACAG | 7521 | AQNGGTTFIAQ | 12110 | NGGTTFI | 0.270379 | -0.12521 |
| SyS1177 | 2933 | GCCCAAGTTTGAAGACTACGGCTATTGCACAG | 7522 | AQVLKTTAIAQ | 12111 | VLKTTAI | 0.270139 | -0.19133 |
| SyS1178 | 2934 | GCCCAACCCCACGGCGTCGGCAGCGCCGCACAG | 7523 | AQPHGVGSAAQ | 12112 | PHGVGSA | 0.27008 | -0.03489 |
| GS635 | 2935 | GCCCAATCTAATGCGCATCCTCTGGCTGCACAG | 7524 | AQSNAHPLAAQ | 12113 | SNAHPLA | 0.270011 | -0.17958 |
| SyS1179 | 2936 | GCCCAAAAAAGCACCAGCCTCGACCCCGCACAG | 7525 | AQKSTSLDPAQ | 12114 | KSTSLDP | 0.269961 | -0.05312 |
| SyS1180 | 2937 | GCCCAATTCAACAAAACCAACGACATGGCACAG | 7526 | AQFNKTNDMAQ | 12115 | FNKTNDM | 0.269911 | 0.039016 |
| SyS1181 | 2938 | GCCCAACACCAAACCAGCGAACTCAGAGCACAG | 7527 | AQHQTSELRAQ | 12116 | HQTSELR | 0.269505 | -0.13316 |
| SyS1182 | 2939 | GCCCAATGGGCCAAAGTCCTCGACAAAGCACAG | 7528 | AQWAKVLDKAQ | 12117 | WAKVLDK | 0.269376 | -0.18042 |
| GS637 | 2940 | GCCCAAATGAGCAGCAACAACAAAAGCGCACAG | 7529 | AQMSSNNKSAQ | 12118 | MSSNNKS | 0.26924 | -0.10804 |
| GS638 | 2941 | GCCCAAGATGGTACTCATTTGAAGCTGGCACAG | 7530 | AQDGTHLKLAQ | 12119 | DGTHLKL | 0.269216 | -0.12903 |
| SyS1183 | 2942 | GCCCAAACGGTTATTAGTGATCAGAGGGCACAG | 7531 | AQTVISDQRAQ | 12120 | TVISDQR | 0.269208 | -0.23296 |
| GS639 | 2943 | GCCCAAATGCACAGCCAACTCCTCCCCGCACAG | 7532 | AQMHSQLLPAQ | 12121 | MHSQLLP | 0.269185 | -0.16394 |
| GP131 | 2944 | GCCCAATCGTCTTATGGGACTGCGGCGGCACAG | 7533 | AQSSYGTAAAQ | 12122 | SSYGTAA | 0.269078 | -0.07134 |
| SyS1184 | 2945 | GCCCAAGTGTTGTCTACGATGGCTGTTGCACAG | 7534 | AQVLSTMAVAQ | 12123 | VLSTMAV | 0.269054 | -0.01394 |
| GS640 | 2946 | GCCCAATGCGCTTCGAATTTTGCGTCTGCACAG | 7535 | AQSASNFASAQ | 12124 | SASNFAS | 0.268964 | -0.14715 |
| GS642 | 2947 | GCCCAAAGTAAGGCTGGTCTGAGTGATGCACAG | 7536 | AQSKAGLSDAQ | 12125 | SKAGLSD | 0.268902 | -0.06703 |
| GS643 | 2948 | GCCCAAATTAATCGGATTGTTAGTGGGGCACAG | 7537 | AQINRIVSGAQ | 12126 | INRIVSG | 0.268902 | -0.0141 |
| SyS1185 | 2949 | GCCCAAAAAACTCGACACCCCGGCAAAGCACAG | 7538 | AQKLDTPGKAQ | 12127 | KLDTPGK | 0.268816 | -0.14647 |
| GS644 | 2950 | GCCCAAATGGATCGTATTGTTAAGATGGCACAG | 7539 | AQMDRIVKMAQ | 12128 | MDRIVKM | 0.268718 | -0.16125 |
| SyS1186 | 2951 | GCCCAAAGAGAAAGAAGCACCGACGCCGCACAG | 7540 | AQRERSTDAAQ | 12129 | RERSTDA | 0.26861 | 0.020477 |
| GS645 | 2952 | GCCCAACTCAGAGACTGGCACCGCCACGCACAG | 7541 | AQLRDSTGHAQ | 12130 | LRDSTGH | 0.268608 | -0.08258 |
| SyS1187 | 2953 | GCCCAAATGAGAGGCCAAGGCGTCCACGCACAG | 7542 | AQMRGQGVHAQ | 12131 | MRGQGVH | 0.268511 | 0.013557 |

FIG. 33 (Continued)

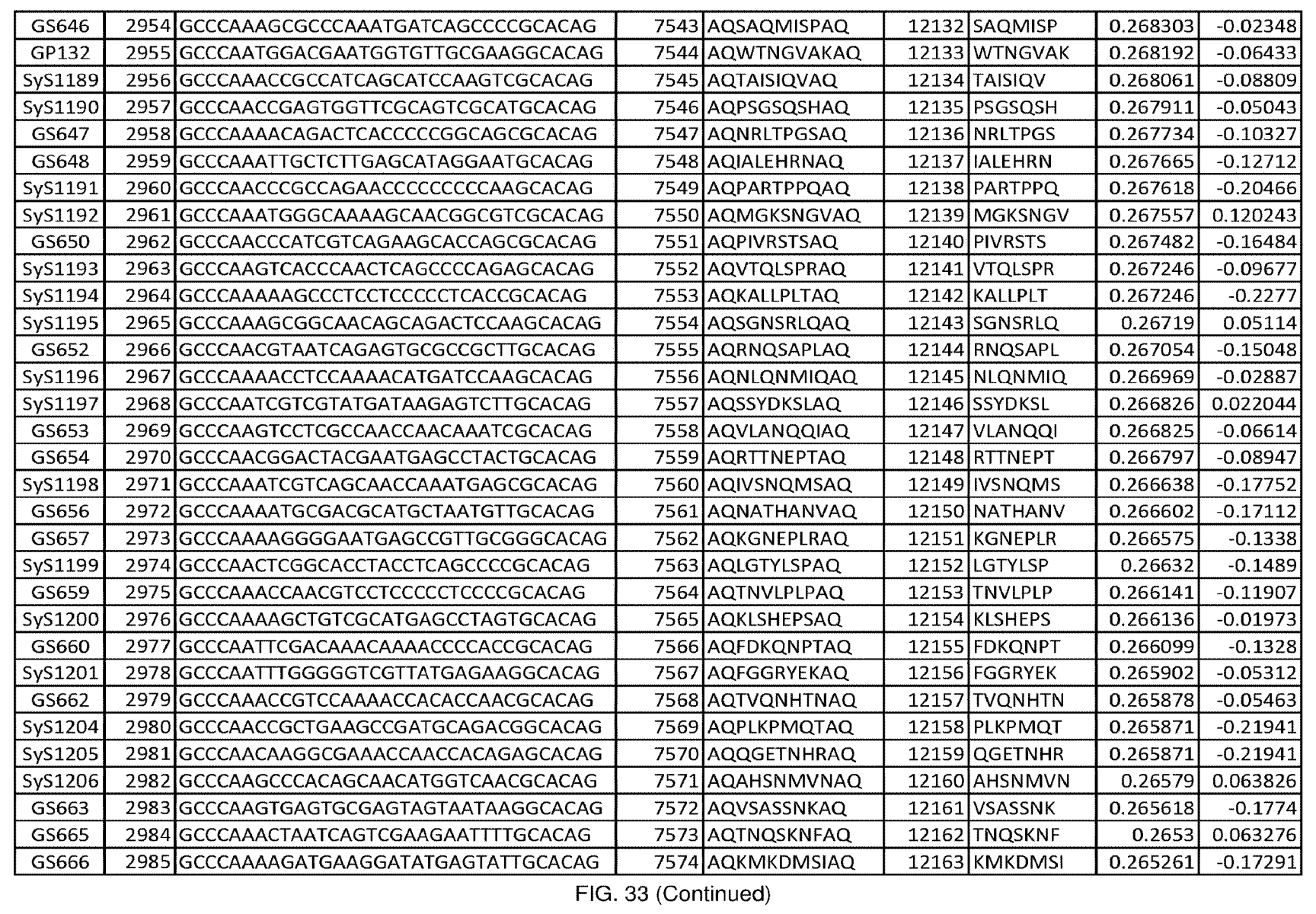

| | | | | | | | | |
|---|---|---|---|---|---|---|---|---|
| GS646 | 2954 | GCCCAAAGGCGCCCAAAATGATCAGCCCGCACAG | 7543 | AQSAQMISPAQ | 12132 | SAQMISP | 0.268303 | -0.02348 |
| GP132 | 2955 | GCCCAATGGACGAATGGTGTTGCGAAGGCACAG | 7544 | AQWTNGVAKAQ | 12133 | WTNGVAK | 0.268192 | -0.06433 |
| SyS1189 | 2956 | GCCCAAACCGCCATCAGCATCCAAGTCGCACAG | 7545 | AQTAISIQVAQ | 12134 | TAISIQV | 0.268061 | -0.08809 |
| SyS1190 | 2957 | GCCCAACCGAGTGGTTCGCGAGTGCCATGCACAG | 7546 | AQPSGSQSHAQ | 12135 | PSGSQSH | 0.267911 | -0.05043 |
| GS647 | 2958 | GCCCAAAACAGACTCACCCCGGCAGCGGCACAG | 7547 | AQNRLTPGSAQ | 12136 | NRLTPGS | 0.267734 | -0.10327 |
| GS648 | 2959 | GCCCAAATTGCTCTTGAGCATAGGAATGCACAG | 7548 | AQIALEHRNAQ | 12137 | IALEHRN | 0.267665 | -0.12712 |
| SyS1191 | 2960 | GCCCAACCGCCAGAAACCCCCCAAGCACAG | 7549 | AQPARTPPQAQ | 12138 | PARTPPQ | 0.267618 | -0.20466 |
| SyS1192 | 2961 | GCCCAAATGGGCAAAAGCAACGGCGTCGCACAG | 7550 | AQMGKSNGVAQ | 12139 | MGKSNGV | 0.267557 | 0.120243 |
| GS650 | 2962 | GCCCAACCATCGTCAGAAGCACCAGCGCACAG | 7551 | AQPIVRSTSAQ | 12140 | PIVRSTS | 0.267482 | -0.16484 |
| SyS1193 | 2963 | GCCCAAGTCACCCAACTCAGCCCCAGAGCACAG | 7552 | AQVTQLSPRAQ | 12141 | VTQLSPR | 0.267246 | -0.09677 |
| SyS1194 | 2964 | GCCCAAAAAGCCCTCCTCCCCTCACCGCACAG | 7553 | AQKALLPLTAQ | 12142 | KALLPLT | 0.267246 | -0.2277 |
| SyS1195 | 2965 | GCCCAAAGCGGCAACAGCAGACTCCAAGCACAG | 7554 | AQSGNSRLQAQ | 12143 | SGNSRLQ | 0.26719 | 0.05114 |
| GS652 | 2966 | GCCCAACGTAATCAGAGTGCGCGCGCTTGCACAG | 7555 | AQRNQSAPLAQ | 12144 | RNQSAPL | 0.267054 | -0.15048 |
| SyS1196 | 2967 | GCCCAAAAACCTCCAAAACATGATCCAAGCACAG | 7556 | AQNLQNMIQAQ | 12145 | NLQNMIQ | 0.266969 | -0.02887 |
| SyS1197 | 2968 | GCCCAATCGTCGTATGATAAGAGTCTTGCACAG | 7557 | AQSSYDKSLAQ | 12146 | SSYDKSL | 0.266826 | 0.022044 |
| GS653 | 2969 | GCCCAAGTCCTCGCCAACCAACAAATCGCACAG | 7558 | AQVLANQQIAQ | 12147 | VLANQQI | 0.266825 | -0.06614 |
| GS654 | 2970 | GCCCAACGGACTACGAATGAGCCTACTGCACAG | 7559 | AQRTTNEPTAQ | 12148 | RTTNEPT | 0.266797 | -0.08947 |
| SyS1198 | 2971 | GCCCAAATCGTCAGCAACCAAATGAGCGCACAG | 7560 | AQIVSNQMSAQ | 12149 | IVSNQMS | 0.266638 | -0.17752 |
| GS656 | 2972 | GCCCAAAATGCGACGCATGCTAATGTTGCACAG | 7561 | AQNATHANVAQ | 12150 | NATHANV | 0.266602 | -0.17112 |
| GS657 | 2973 | GCCCAAAAGGGGAATGAGCCGTTGCGGGCACAG | 7562 | AQKGNEPLRAQ | 12151 | KGNEPLR | 0.266575 | -0.1338 |
| SyS1199 | 2974 | GCCCAACTCGGCCACCTACCTCAGCCCGCACAG | 7563 | AQLGTYLSPAQ | 12152 | LGTYLSP | 0.26632 | -0.1489 |
| GS659 | 2975 | GCCCAAACCAACGTCCTCCCCCGCACAG | 7564 | AQTNVLPLPAQ | 12153 | TNVLPLP | 0.266141 | -0.11907 |
| SyS1200 | 2976 | GCCCAAAAGCTGTCGCATGAGCCTAGTGCACAG | 7565 | AQKLSHEPSAQ | 12154 | KLSHEPS | 0.266136 | -0.01973 |
| GS660 | 2977 | GCCCAATTCGACAAAACCCACCGCACAG | 7566 | AQFDKQNPTAQ | 12155 | FDKQNPT | 0.266099 | -0.1328 |
| SyS1201 | 2978 | GCCCAATTTGGGGGTCGTTATGAGAAGGCACAG | 7567 | AQFGGRYEKAQ | 12156 | FGGRYEK | 0.265902 | -0.05312 |
| GS662 | 2979 | GCCCAAACCGTCCAAAACCAACGCACAG | 7568 | AQTVQNHTNAQ | 12157 | TVQNHTN | 0.265878 | -0.05463 |
| SyS1204 | 2980 | GCCCAACCGCTGAAGCCGATGCAGACGGCACAG | 7569 | AQPLKPMQTAQ | 12158 | PLKPMQT | 0.265871 | -0.21941 |
| SyS1205 | 2981 | GCCCAACAGGCGAAACAACCACAGAGCACAG | 7570 | AQQGETNHRAQ | 12159 | QGETNHR | 0.265871 | -0.21941 |
| SyS1206 | 2982 | GCCCAAGCCCACAGCAACAACATGGTCAACGCACAG | 7571 | AQAHSNMVNAQ | 12160 | AHSNMVN | 0.26579 | 0.063826 |
| GS663 | 2983 | GCCCAAGTGAGTGCGAGTAGTAATAAGGCACAG | 7572 | AQVSASSNKAQ | 12161 | VSASSNK | 0.265618 | -0.1774 |
| GS665 | 2984 | GCCCAAACTAATCAGTCGGAAGAATTTTGCACAG | 7573 | AQTNQSKNFAQ | 12162 | TNQSKNF | 0.2653 | 0.063276 |
| GS666 | 2985 | GCCCAAAAGATGAAGGATATGAGTATTGCACAG | 7574 | AQKMKDMSIAQ | 12163 | KMKDMSI | 0.265261 | -0.17291 |

FIG. 33 (Continued)

| | | | | | | | | |
|---|---|---|---|---|---|---|---|---|
| SyS1209 | 2986 | GCCCAACACCCAGCGGGCAGCACCCTCGCACAG | 7575 | AQHPSGSTLAQ | 12164 | HPSGSTL | 0.265242 | -0.09127 |
| SyS1210 | 2987 | GCCCAAATTAAGGATACTGTTTCTGTGGGCACAG | 7576 | AQIKDTVSGAQ | 12165 | IKDTVSG | 0.265119 | -0.06613 |
| GS668 | 2988 | GCCCAAATGAACACCCTCACCAACGTCGCACAG | 7577 | AQMNTLTNVAQ | 12166 | MNTLTNV | 0.264894 | -0.09087 |
| SyS1211 | 2989 | GCCCAAACTGATAGTGCTCCGCATCCGGCACAG | 7578 | AQTDSAPHPAQ | 12167 | TDSAPHP | 0.264791 | -0.12222 |
| SyS1212 | 2990 | GCCCAACCCAGACCCGTCAGCAACGGCGCACAG | 7579 | AQPRPVSNGAQ | 12168 | PRPVSNG | 0.264764 | -0.02466 |
| SyS1213 | 2991 | GCCCAATCTGTTGATAGGCGGCGCCGCAGGCACAG | 7580 | AQSVDRRPQAQ | 12169 | SVDRRPQ | 0.264728 | -0.0604 |
| GS670 | 2992 | GCCCAAATGGATTCTCCTATTAGGAATGCACAG | 7581 | AQMDSPIRNAQ | 12170 | MDSPIRN | 0.264655 | -0.15766 |
| GS671 | 2993 | GCCCAAGCTACGCGTATGAGTATTCCTGCACAG | 7582 | AQATRMSIPAQ | 12171 | ATRMSIP | 0.264401 | -0.16932 |
| SyS1214 | 2994 | GCCCAAAACGTCCCACCAGCCTCCCGCACAG | 7583 | AQNVPTSLPAQ | 12172 | NVPTSLP | 0.264383 | 0.102058 |
| SyS1215 | 2995 | GCCCAAAGCCTCAGAATCGAAAGCAAAGCACAG | 7584 | AQSLRIESKAQ | 12173 | SLRIESK | 0.264383 | -0.12829 |
| GS673 | 2996 | GCCCAAAACAGCGGCAACACCCTCGGCGCACAG | 7585 | AQNSGNTLGAQ | 12174 | NSGNTLG | 0.264155 | -0.1119 |
| SyS1216 | 2997 | GCCCAACGGTTGGATCATGCTAGTATTGCACAG | 7586 | AQRLDHASIAQ | 12175 | RLDHASI | 0.264068 | -0.07051 |
| SyS1217 | 2998 | GCCCAAAGCCACCTCGTCGTCAGCGCCGCACAG | 7587 | AQSHLVVSAAQ | 12176 | SHLVVSA | 0.263941 | -0.22064 |
| SyS1218 | 2999 | GCCCAACCCGCCAGCCCCAGAAGCCACGCACAG | 7588 | AQPASPRSHAQ | 12177 | PASPRSH | 0.263752 | -0.19618 |
| SyS1219 | 3000 | GCCCAAAACCACCACCCTCGTCCCCCGCACAG | 7589 | AQNHTLVPPAQ | 12178 | NHTLVPP | 0.263502 | -0.06767 |
| SyS1220 | 3001 | GCCCAAATGCAGATGACGGGGACTGCTGCACAG | 7590 | AQMQMTGTAAQ | 12179 | MQMTGTA | 0.26338 | 0.109806 |
| SyS1221 | 3002 | GCCCAAAATACTCAGGCGAATCCGAGGGCACAG | 7591 | AQNTQANPRAQ | 12180 | NTQANPR | 0.263187 | 0.026893 |
| GS675 | 3003 | GCCCAAACCAGAGACCTCAACGCCATCGCACAG | 7592 | AQTRDLNAIAQ | 12181 | TRDLNAI | 0.263161 | -0.06205 |
| SyS1222 | 3004 | GCCCAAACCGACGCCAGCAGCCCCTTCGCACAG | 7593 | AQTDASSPFAQ | 12182 | TDASSPF | 0.263114 | -0.20224 |
| SyS1223 | 3005 | GCCCAAGCTGATCAGAGGACCGGAAGGCACAG | 7594 | AQADQRQPKAQ | 12183 | ADQRQPK | 0.263076 | -0.0037 |
| SyS1224 | 3006 | GCCCAAGCCGTCAACCCAACTACGCCGCACAG | 7595 | AQAVNPNYAAQ | 12184 | AVNPNYA | 0.262974 | -0.0907 |
| SyS1225 | 3007 | GCCCAACTGACTGCGTCTACGAATGTTCGGGCACAG | 7596 | AQLTATNVRAQ | 12185 | LTATNVR | 0.262845 | 0.030087 |
| SyS1226 | 3008 | GCCCAATTGACTGCGTCTACTTATTCGGCACAG | 7597 | AQLTASTYSAQ | 12186 | LTASTYS | 0.262777 | -0.16344 |
| SyS1227 | 3009 | GCCCAAGGGTGCGTGATAATTCTGTGGCACAG | 7598 | AQGSRDNSVAQ | 12187 | GSRDNSV | 0.262777 | -0.21921 |
| SyS1228 | 3010 | GCCCAAACTGATACTCAGAATCGGCTTGCACAG | 7599 | AQTDTQNRLAQ | 12188 | TDTQNRL | 0.262725 | -0.15534 |
| GS676 | 3011 | GCCCAAAATAGTACGGTTAATACGGGTGCACAG | 7600 | AQNSTVNTGAQ | 12189 | NSTVNTG | 0.262505 | -0.14811 |
| SyS1229 | 3012 | GCCCAATTGTCTCATGCGATGCGTTCTGCACAG | 7601 | AQLSHAMRSAQ | 12190 | LSHAMRS | 0.262482 | -0.18042 |
| SyS1230 | 3013 | GCCCAACGGCTGCCGATGACTACTATGGCACAG | 7602 | AQRLPMTTMAQ | 12191 | RLPMTTM | 0.262441 | -0.04775 |
| SyS1231 | 3014 | GCCCAACTCTACCACGAAAGCCAAACGCGCACAG | 7603 | AQLYHESQTAQ | 12192 | LYHESQT | 0.262338 | -0.18614 |
| SyS1232 | 3015 | GCCCAAATTTTGCATCAGAGTTCGACTGCACAG | 7604 | AQILHQSSTAQ | 12193 | ILHQSST | 0.262234 | 0.103448 |
| GS677 | 3016 | GCCCAAACCAGCTTCGCCACCCAAACCGCACAG | 7605 | AQTSLATQTAQ | 12194 | TSLATQT | 0.262228 | -0.11907 |
| GS678 | 3017 | GCCCAAAGAACCCCACCCTCACCGTCGCACAG | 7606 | AQRTPTLTVAQ | 12195 | RTPTLTV | 0.262188 | -0.1338 |

FIG. 33 (Continued)

| | | | | | | | |
|---|---|---|---|---|---|---|---|
| GS679 | 3018 | GCCCAAGCTACGCGCGTGAGAGTCGTACGGCACAG | 7607 | AQATRESRTAQ | 12196 | ATRESRT | 0.262188 | -0.1338 |
| SyS1233 | 3019 | GCCCAATTGTCTGAGAGTCTGCGGATTGCACAG | 7608 | AQLSESLRIAQ | 12197 | LSESLRI | 0.262085 | -0.13071 |
| SyS1234 | 3020 | GCCCAAAGGCGTCACCGGCGGCATGGTCGCACAG | 7609 | AQSVTGGMVAQ | 12198 | SVTGGMV | 0.261982 | 0.275265 |
| SyS1235 | 3021 | GCCCAACCCAGAACCAGCAGCGACAGCAACGCACAG | 7610 | AQPRTSDSNAQ | 12199 | PRTSDSN | 0.261751 | 0.100471 |
| GS680 | 3022 | GCCCAAGTTCATTCTACGGTTACGTCGGCACAG | 7611 | AQVHSTVTSAQ | 12200 | VHSTVTS | 0.261737 | -0.09477 |
| SyS1236 | 3023 | GCCCAAGGCACCACAACATGAACCACCTGCACAG | 7612 | AQGTNMNHLAQ | 12201 | GTNMNHL | 0.261685 | -0.07009 |
| SyS1237 | 3024 | GCCCAAATGAAGGCTGAGTTGTATGGCGGCACAG | 7613 | AQMKAELYAAQ | 12202 | MKAELYA | 0.261535 | -0.02039 |
| GS681 | 3025 | GCCCAACTCAGAAGCCCAGCGTCGACGCACAG | 7614 | AQLRSPSVDAQ | 12203 | LRSPSVD | 0.261426 | 0.021615 |
| SyS1238 | 3026 | GCCCAAACCAACAGCCCCAATTCCCGCACAG | 7615 | AQTNSPQFPAQ | 12204 | TNSPQFP | 0.261388 | 0.019965 |
| TS158 | 3027 | GCCCAAAATAATTCGCTTAGGTCGAATGCACAG | 7616 | AQNNSLRSNAQ | 12205 | NNSLRSN | 0.261381 | -0.10273 |
| GS682 | 3028 | GCCCAAGACAGCCACATGGGCAAATACGCACAG | 7617 | AQDSHMGKYAQ | 12206 | DSHMGKY | 0.261318 | -0.11556 |
| SyS1239 | 3029 | GCCCAAGTTAATTCGATGACGCCGGGCACAG | 7618 | AQVNSMTPRAQ | 12207 | VNSMTPR | 0.261313 | 0.013095 |
| SyS1240 | 3030 | GCCCAACTCGCCCCCATCAGCCTCAACGCACAG | 7619 | AQLAPISLNAQ | 12208 | LAPISLN | 0.261307 | -0.03736 |
| SyS1241 | 3031 | GCCCAAAATATGCCGAGTATTATGCAGGCACAG | 7620 | AQNMPSIMQAQ | 12209 | NMPSIMQ | 0.261198 | -0.19254 |
| TS159 | 3032 | GCCCAAGGGAATATGATTAAGGTGGCGGCACAG | 7621 | AQGNMIKVAAQ | 12210 | GNMIKVA | 0.261132 | -0.28624 |
| SyS1242 | 3033 | GCCCAAACCGGCGTCAGCCTCCAAGTCGCACAG | 7622 | AQTGVSLQVAQ | 12211 | TGVSLQV | 0.261129 | -0.23133 |
| SyS1243 | 3034 | GCCCAACCTCAGTTTAATACTGCGCTCGGCACAG | 7623 | AQPQFNTASAQ | 12212 | PQFNTAS | 0.261076 | -0.14283 |
| SyS1244 | 3035 | GCCCAAACGGAGGCGTATAGGAATACTGCACAG | 7624 | AQTEAYRNTAQ | 12213 | TEAYRNT | 0.261 | -0.18163 |
| SyS1245 | 3036 | GCCCAACTTATGAAGGCTGATACTGTGGCACAG | 7625 | AQLMKADTVAQ | 12214 | LMKADTV | 0.260947 | -0.04342 |
| GS683 | 3037 | GCCCAAAATCATAAGGAGTTTATGCTTGCACAG | 7626 | AQNHKEFMLAQ | 12215 | NHKEFML | 0.260914 | -0.14906 |
| GS684 | 3038 | GCCCAATTGAATGGCGACTTTGACTGTGGCACAG | 7627 | AQLNGTLTVAQ | 12216 | LNGTLTV | 0.26088 | -0.1462 |
| GS686 | 3039 | GCCCAAACTGCGAAGATTTTGACGATGGCACAG | 7628 | AQTAKILTMAQ | 12217 | TAKILTM | 0.260811 | -0.17112 |
| SyS1246 | 3040 | GCCCAACTCAGAGACAGCCTCCCGTCGCACAG | 7629 | AQLRDSLPVAQ | 12218 | LRDSLPV | 0.260626 | 0.104246 |
| SyS1247 | 3041 | GCCCAACTCAAAGGCGGCGACAGCTGGGCACAG | 7630 | AQLKGGDSWAQ | 12219 | LKGGDSW | 0.260615 | -0.12208 |
| GS687 | 3042 | GCCCAAAAAACCGTCGACATCATGGGCGCACAG | 7631 | AQKTVDIMGAQ | 12220 | KTVDIMG | 0.260533 | -0.09485 |
| GS688 | 3043 | GCCCAACTCAACATGGGCAAATGAAAGCACAG | 7632 | AQLNMGQMKAQ | 12221 | LNMGQMK | 0.260458 | -0.09755 |
| SyS1248 | 3044 | GCCCAAAGCGTCCCCAGCCTCGACAGAGCACAG | 7633 | AQSVPSLDRAQ | 12222 | SVPSLDR | 0.260448 | -0.05185 |
| SyS1249 | 3045 | GCCCAACAGCTGTTGGGGACGAGTAAGGCACAG | 7634 | AQQLLGTSKAQ | 12223 | QLLGTSK | 0.260344 | -0.23296 |
| SyS1250 | 3046 | GCCCAAATGAATCCTAAGCATGGTCTGGCACAG | 7635 | AQMNPKHGLAQ | 12224 | MNPKHGL | 0.260327 | -0.18769 |
| SyS1251 | 3047 | GCCCAATCTCCGGAGGGTTCTCTGAAGGCACAG | 7636 | AQSPEGSLKAQ | 12225 | SPEGSLK | 0.260327 | -0.18769 |
| SyS1252 | 3048 | GCCCAAGCGAATATGCCGAATTCTGGGCACAG | 7637 | AQANMPNSRAQ | 12226 | ANMPNSR | 0.260318 | -0.08035 |
| SyS1253 | 3049 | GCCCAAGCCTACATCAGCAGCGGCGTCGCACAG | 7638 | AQAYISSGVAQ | 12227 | AYISSGV | 0.260028 | -0.08758 |

FIG. 33 (Continued)

| | | | | | | | | |
|---|---|---|---|---|---|---|---|---|
| GS690 | 3050 | GCCCAAGAGAAAGAGGGCAGCCAAGCCAAGCCAAGCCACAG | 7639 | AQERGSQANAQ | 12228 | ERGSQAN | 0.260015 | -0.16304 |
| GS691 | 3051 | GCCCAAGGTCATGATAGGCTGAGTCCGGCACAG | 7640 | AQGHDRLSPAQ | 12229 | GHDRLSP | 0.259905 | -0.06434 |
| GS692 | 3052 | GCCCAAACGAGTAATGTGACTGGTACTGCACAG | 7641 | AQTSNVTGTAQ | 12230 | TSNVTGT | 0.259758 | -0.10244 |
| GS693 | 3053 | GCCCAACTCACCCACCACGTCGGCGTCGCACAG | 7642 | AQLTHNVGVAQ | 12231 | LTHNVGV | 0.259654 | -0.0842 |
| GS694 | 3054 | GCCCAAGGGAGGAGGATGGGGTGGCTAAGGCACAG | 7643 | AQREDGVAKAQ | 12232 | REDGVAK | 0.2595 | -0.1774 |
| SyS1254 | 3055 | GCCCAACCCGCGACGGCTACAAACTCGCACAG | 7644 | AQPADGYKLAQ | 12233 | PADGYKL | 0.259383 | 0.021493 |
| GS697 | 3056 | GCCCAACAACTCGACGCGCCACCAGAGCCGCACAG | 7645 | AQQLDATRAAQ | 12234 | QLDATRA | 0.259246 | -0.02679 |
| GS698 | 3057 | GCCCAAGTGACTGGTATGACGACTCGTGCACAG | 7646 | AQVTGMTTRAQ | 12235 | VTGMTTR | 0.259241 | -0.1747 |
| SyS1255 | 3058 | GCCCAATCGGATAGTCGGACGTATGAGGCACAG | 7647 | AQSDSRTYEAQ | 12236 | SDSRTYE | 0.25915 | -0.12829 |
| SyS1259 | 3059 | GCCCAAGTTGAGCCGCTGAAGCCGGATGCACAG | 7648 | AQVEPLKPDAQ | 12237 | VEPLKPD | 0.258734 | -0.17799 |
| SyS1260 | 3060 | GCCCAAGGCGTCCTCGCCAGCAACAGAGCACAG | 7649 | AQGVLASNRAQ | 12238 | GVLASNR | 0.258676 | -0.15411 |
| SyS1262 | 3061 | GCCCAAATGGGCGAAAGAATGAGCATCGCACAG | 7650 | AQMGERMSIAQ | 12239 | MGERMSI | 0.258443 | -0.05797 |
| SyS1263 | 3062 | GCCCAATTTACGAAGACTGAGGATTTGGCACAG | 7651 | AQFTKTEDLAQ | 12240 | FTKTEDL | 0.258323 | -0.0551 |
| SyS1264 | 3063 | GCCCAAGTCAAAAACACCGAACTCCTCGCACAG | 7652 | AQVKNTELLAQ | 12241 | VKNTELL | 0.258283 | 0.073327 |
| GS700 | 3064 | GCCCAAACTGTTACGAGTACGGTGGTGGCACAG | 7653 | AQTVTSTVVAQ | 12242 | TVTSTVV | 0.258274 | -0.18637 |
| SyS1267 | 3065 | GCCCAAGCCAAATACGGCGACCCCACCGCACAG | 7654 | AQAKYGDPTAQ | 12243 | AKYGDPT | 0.257892 | 0.222899 |
| GS701 | 3066 | GCCCAAACCAGCGACAGACTCCTCGGCGCACAG | 7655 | AQTSDRLLGAQ | 12244 | TSDRLLG | 0.257859 | -0.13666 |
| GS702 | 3067 | GCCCAAGTCGTTGGGAATACTAAGATGGCACAG | 7656 | AQAVGNTKMAQ | 12245 | AVGNTKM | 0.25783 | -0.13952 |
| GS704 | 3068 | GCCCACCAACAGACGTATAATAAGATGGATGCACAG | 7657 | AQQTYNKMDAQ | 12246 | QTYNKMD | 0.257666 | -0.05596 |
| GS706 | 3069 | GCCCAAGCGTGGGCTAGTCAGTCTTCGGCACAG | 7658 | AQAWASQSSAQ | 12247 | AWASQSS | 0.25724 | -0.14779 |
| SyS1269 | 3070 | GCCCAAAATGCGTTTCTTACTGGTGGGGCACAG | 7659 | AQNAFLTGGAQ | 12248 | NAFLTGG | 0.257171 | -0.20103 |
| SyS1270 | 3071 | GCCCAAAGCATCGGGCAGACAAATACACCGCACAG | 7660 | AQSIGDKYTAQ | 12249 | SIGDKYT | 0.257047 | -0.09127 |
| GS707 | 3072 | GCCCAATCGAATCATCATCATACTGGGGCACAG | 7661 | AQSNHHHTGAQ | 12250 | SNHHHTG | 0.256757 | -0.11758 |
| GS708 | 3073 | GCCCAAATCACCAACAAACCCATGACCGCACAG | 7662 | AQITNKPMTAQ | 12251 | ITNKPMT | 0.256656 | -0.13702 |
| SS84 | 3074 | GCCCAACTCAGCGGCCAAGTCAGCAACGCACAG | 7663 | AQLSGQVSNAQ | 12252 | LSGQVSN | 0.256425 | -0.35654 |
| GS709 | 3075 | GCCCAAAATAGTATGTCGGGGCATTTGGCACAG | 7664 | AQNSMSGHLAQ | 12253 | NSMSGHL | 0.256275 | -0.14334 |
| SyS1271 | 3076 | GCCCAACCTGCGGTGCATGGTTATGCTGCACAG | 7665 | AQPAVHGYAAQ | 12254 | PAVHGYA | 0.256274 | -0.20709 |
| GS710 | 3077 | GCCCAACTCATGAGAACCAAACAACACCGCACAG | 7666 | AQLMRTKQPAQ | 12255 | LMRTKQP | 0.256142 | -0.14906 |
| SyS1272 | 3078 | GCCCAAGCAGCCTCGCCGTCAACAAAGCACAG | 7667 | AQSSLAVNKAQ | 12256 | SSLAVNK | 0.256141 | -0.07737 |
| SyS1273 | 3079 | GCCCAAAATACGCAGTCGGAGCCTCGTGCACAG | 7668 | AQNTQSEPRAQ | 12257 | NTQSEPR | 0.2561 | 0.127962 |
| SyS1275 | 3080 | GCCCAAGATCATCTGGTTAGTGTTCCTGCACAG | 7669 | AQDHLVSVPAQ | 12258 | DHLVSVP | 0.256044 | -0.19107 |
| SyS1276 | 3081 | GCCCAATGGGCCACCAGCACCCACGACGCACAG | 7670 | AQWATSTHDAQ | 12259 | WATSTHD | 0.256044 | -0.18121 |

FIG. 33 (Continued)

| | | | | | | | | |
|---|---|---|---|---|---|---|---|---|
| SyS1277 | 3082 | GCCCAACCCCAACAACAACCATCGGGCACAG | 7671 | AQPQQQPIGAQ | 12260 | PQQQPIG | 0.256044 | -0.21571 |
| SyS1278 | 3083 | GCCCAAAGCCTCAGCAGCACCCACAGCGACGCACAG | 7672 | AQSLSTHSDAQ | 12261 | SLSTHSD | 0.255878 | -0.0507 |
| SyS1279 | 3084 | GCCCAAGGCAGCATGGCCGCCAGAAGCGCACAG | 7673 | AQGSMAARSAQ | 12262 | GSMAARS | 0.2558 | -0.12101 |
| GS711 | 3085 | GCCCAAGCCCCGGCATGACCGCCAGAGCACAG | 7674 | AQAPGMTARAQ | 12263 | APGMTAR | 0.255662 | -0.16623 |
| SyS1280 | 3086 | GCCCAAGTCCTGCCAACATGACCGCCGCACAG | 7675 | AQVLANMTAAQ | 12264 | VLANMTA | 0.255612 | 0.070331 |
| SyS1281 | 3087 | GCCCAACTCACCAAACAAGAGAAGCGCCGCACAG | 7676 | AQLTKQESAAQ | 12265 | LTKQESA | 0.255528 | -0.09434 |
| SyS1282 | 3088 | GCCCAAGGCGCCAACAGCGGCGGCGTCGCACAG | 7677 | AQGANSGGVAQ | 12266 | GANSGGV | 0.255503 | 0.080739 |
| SyS1283 | 3089 | GCCCAACAGAGTGAGCCGAAGCGTCCTGCACAG | 7678 | AQQSEPKRPAQ | 12267 | QSEPKRP | 0.255307 | -0.11616 |
| SyS1284 | 3090 | GCCCAAGTCCACGGCGAAAGAAGCGTCGCACAG | 7679 | AQVHGERSVAQ | 12268 | VHGERSV | 0.255229 | 0.018407 |
| SyS1285 | 3091 | GCCCAAGGCCATCAGACTGCTGCTTTCTGCACAG | 7680 | AQAHQTAASAQ | 12269 | AHQTAAS | 0.255147 | -0.17557 |
| GP133 | 3092 | GCCCAAGTTCGGGAGGATGCAGACGGCGGGCACAG | 7681 | AQVREMQTAAQ | 12270 | VREMQTA | 0.255121 | -0.07329 |
| GS713 | 3093 | GCCCAAGTCGCCCCCAGCGCCCTCCACGCACAG | 7682 | AQVAPSALHAQ | 12271 | VAPSALH | 0.255035 | -0.16842 |
| SyS1286 | 3094 | GCCCAAAGTGTTGGTCATCATAATATGGCACAG | 7683 | AQSVGHHNMAQ | 12272 | SVGHHNM | 0.254967 | -0.18648 |
| SyS1287 | 3095 | GCCCAATTCCTCACCCAAGGCGACGTCGCACAG | 7684 | AQFLTQGDVAQ | 12273 | FLTQGDV | 0.254933 | -0.11838 |
| SyS1288 | 3096 | GCCCAATTCAGCACCCAATTCCAACACGCACAG | 7685 | AQFSTQFQHAQ | 12274 | FSTQFQH | 0.254806 | -0.14302 |
| GP134 | 3097 | GCCCAACAGAATACGACGCGGTCGAATGCACAG | 7686 | AQQNTTRSNAQ | 12275 | QNTTRSN | 0.254756 | 0.347693 |
| SyS1289 | 3098 | GCCCAACCCGCCGTCACCAGCATCGCCGCACAG | 7687 | AQPAVTSIAAQ | 12276 | PAVTSIA | 0.254579 | -0.07092 |
| SyS1290 | 3099 | GCCCAAGGCCAGCACCAACAACTACGTCGCACAG | 7688 | AQASTNTYVAQ | 12277 | ASTNTYV | 0.254465 | 0.185493 |
| SyS1291 | 3100 | GCCCAATCGACGGCTACGCCTACGTCGGCACAG | 7689 | AQSTATPTSAQ | 12278 | STATPTS | 0.254392 | -0.19723 |
| GS714 | 3101 | GCCCAACATTTAATAGGACGTCGCCTGCACAG | 7690 | AQHFNRTSPAQ | 12279 | HFNRTSP | 0.254355 | -0.04208 |
| SyS1294 | 3102 | GCCCAAAGCGTCGCCGGCATGCTCCCCGCACAG | 7691 | AQSVAGMLPAQ | 12280 | SVAGMLP | 0.254355 | -0.14405 |
| SyS1295 | 3103 | GCCCAACCTATGAGTTCTGAGAGTAGTGCACAG | 7692 | AQPMSSESSAQ | 12281 | PMSSESS | 0.25434 | -0.20216 |
| SyS1296 | 3104 | GCCCAAAGCCTCGCCCAGCACCACCGTCGCACAG | 7693 | AQSLASTTVAQ | 12282 | SLASTTV | 0.254318 | -0.00463 |
| SyS1297 | 3105 | GCCCAAACTTCTACTCCTGCTCAGGTTGCACAG | 7694 | AQTSTPAQVAQ | 12283 | TSTPAQV | 0.254198 | 0.05736 |
| SyS1298 | 3106 | GCCCAAAGTCTGACGCGGCGCAGCCTGCACAG | 7695 | AQSLTAQQPAQ | 12284 | SLTAQQP | 0.254112 | -0.01576 |
| GS715 | 3107 | GCCCAAAGTGGTCGTGTGCCTGTGGCTGCACAG | 7696 | AQSGRVPVAAQ | 12285 | SGRVPVA | 0.254016 | -0.18816 |
| GS716 | 3108 | GCCCAACTCGACGCCGCCAAAAGCCTCGCACAG | 7697 | AQLDAAKSLAQ | 12286 | LDAAKSL | 0.253973 | -0.14151 |
| GS717 | 3109 | GCCCAAAACTTCGCCAACAAAAACGTCGCACAG | 7698 | AQNFANKNVAQ | 12287 | NFANKNV | 0.25395 | 0.011201 |
| GS718 | 3110 | GCCCAAGGCCCCGGCCCAGCGTCACCCCGCCACAG | 7699 | AQGPASVTPAQ | 12288 | GPASVTP | 0.253945 | -0.05651 |
| SyS1299 | 3111 | GCCCAATATTCTCGGGAGGCGACGAATGCACAG | 7700 | AQYSREATNAQ | 12289 | YSREATN | 0.253828 | 0.015982 |
| SyS1300 | 3112 | GCCCAAACCGGCAGCAGCTTCGCCATGGCACAG | 7701 | AQTGSSFAMAQ | 12290 | TGSSFAM | 0.25367 | -0.1344 |
| SyS1301 | 3113 | GCCCAAGGGATTAAGGGGGATCCGGTTGCACAG | 7702 | AQGIKGDPVAQ | 12291 | GIKGDPV | 0.253653 | -0.05918 |

FIG. 33 (Continued)

| | | | | | | | |
|---|---|---|---|---|---|---|---|
| SyS1302 | 3114 | GCCCAAGTCACCAGCACCAGCACGCCGCACAG | 7703 | AQVTSTSHAAQ | 12292 | VTSTSHA | 0.253643 | 0.149339 |
| SyS1303 | 3115 | GCCCAAACCAGCCAAAACAACCTCAGAGCACAG | 7704 | AQTSQNNIRAQ | 12293 | TSQNNIR | 0.253347 | -0.04388 |
| GS719 | 3116 | GCCCAAATGAGACAAGAGGGCTCAGGCACAG | 7705 | AQMRQEGLSAQ | 12294 | MRQEGLS | 0.253321 | -0.14238 |
| SyS1304 | 3117 | GCCCAACTCAACCTCAACGCCATCGCCGCACAG | 7706 | AQLNLNAIAAQ | 12295 | LNLNAIA | 0.253187 | -0.10853 |
| SyS1305 | 3118 | GCCCAAGTAAGAATGAGGGGCCTACTGCACAG | 7707 | AQSKNEGPTAQ | 12296 | SKNEGPT | 0.253158 | -0.05578 |
| SyS1306 | 3119 | GCCCAAGATTCTCGTTCTACGACTAATGCACAG | 7708 | AQDSRSTTNAQ | 12297 | DSRSTTN | 0.252881 | 0.072962 |
| SyS1307 | 3120 | GCCCAAAGCACCGGCGACGCCCTCAGAGCACAG | 7709 | AQSTGDALRAQ | 12298 | STGDALR | 0.252785 | 0.062357 |
| SyS1308 | 3121 | GCCCAAATTAATAAGCCTGGTACGCCTGCACAG | 7710 | AQINKPGTPAQ | 12299 | INKPGTP | 0.25278 | 0.014889 |
| SyS1309 | 3122 | GCCCAAGTTTCGGCTCCTTGAATATTGCACAG | 7711 | AQVSAPLNIAQ | 12300 | VSAPLNI | 0.252695 | -0.23618 |
| GP135 | 3123 | GCCCAAGTTTCTTGGGTTCGCTTGCGGCACAG | 7712 | AQVSLGSLAAQ | 12301 | VSLGSLA | 0.252596 | 0.083569 |
| SyS1310 | 3124 | GCCCAACTCAACCACATCAACGAAAAAGCACAG | 7713 | AQLNHINEKAQ | 12302 | LNHINEK | 0.252494 | -0.00166 |
| SyS1311 | 3125 | GCCCAAAAGTCGGTGACGATTCTTTCGGCACAG | 7714 | AQKSVTILSAQ | 12303 | KSVTILS | 0.252487 | -0.19375 |
| GS722 | 3126 | GCCCAATCTAATGTGTCGTCGCTTGTTGCACAG | 7715 | AQSNVSSLVAQ | 12304 | SNVSSLV | 0.252289 | -0.12894 |
| GS723 | 3127 | GCCCAATTTTCGCAGACTGTTGGGGGGGCACAG | 7716 | AQFSQTVGGAQ | 12305 | FSQTVGG | 0.252132 | -0.0379 |
| GS724 | 3128 | GCCCAACGTCCGTCTATTACGCATGATGCACAG | 7717 | AQRPSITHDAQ | 12306 | RPSITHD | 0.252097 | -0.13761 |
| SyS1314 | 3129 | GCCCAAAGACAAGAAAGCACCACCCTCGCACAG | 7718 | AQRQESTTLAQ | 12307 | RQESTTL | 0.252004 | -0.07737 |
| SyS1315 | 3130 | GCCCAAGGGCCTTATGTGACTCCTCAGGCACAG | 7719 | AQGPYVTPQAQ | 12308 | GPYVTPQ | 0.251887 | 0.023256 |
| SyS1316 | 3131 | GCCCAAAACGGCCTCGTCACCACGCGCGCACAG | 7720 | AQNGLVTTAAQ | 12309 | NGLVTTA | 0.251887 | -0.01918 |
| SyS1317 | 3132 | GCCCAACACGCCGGCAACGTCCCCGGCGCACAG | 7721 | AQHAGNVPGAQ | 12310 | HAGNVPG | 0.251887 | -0.1889 |
| SyS1318 | 3133 | GCCCAACCCATGGGCAACAACCTCGTCGCACAG | 7722 | AQPMGNNLVAQ | 12311 | PMGNNLV | 0.251827 | -0.23296 |
| SyS1319 | 3134 | GCCCAAGTCTACAACGACAGAAGCCACGCACAG | 7723 | AQVYNDRSHAQ | 12312 | VYNDRSH | 0.251746 | -0.03526 |
| GS725 | 3135 | GCCCAAACCCACAAAGAAAGCGGGTACGCACAG | 7724 | AQTHKESGYAQ | 12313 | THKESGY | 0.251703 | -0.06465 |
| SyS1320 | 3136 | GCCCAAGGCATGAACAGCGTTCTCCTCGCACAG | 7725 | AQGMNSVLLAQ | 12314 | GMNSVLL | 0.25156 | -0.15738 |
| GS726 | 3137 | GCCCAATACCTCGAAAACCAATACAGCGCACAG | 7726 | AQYLENQYSAQ | 12315 | YLENQYS | 0.251521 | -0.17291 |
| GP137 | 3138 | GCCCAATCTATTACGTCGAGGCCTAATGCACAG | 7727 | AQSITSRPNAQ | 12316 | SITSRPN | 0.251405 | -0.02611 |
| GS727 | 3139 | GCCCAAAGCCACCAAAAACACCGCCAGAGCACAG | 7728 | AQSHQNTARAQ | 12317 | SHQNTAR | 0.251208 | -0.15138 |
| GS728 | 3140 | GCCCAACGTTTGGTTCAGTCTGCGGAGGCACAG | 7729 | AQRLVQSAEAQ | 12318 | RLVQSAE | 0.251117 | -0.12998 |
| SyS1321 | 3141 | GCCCAATACCCCAAAAGCGCCACCAACGCACAG | 7730 | AQYPKSATNAQ | 12319 | YPKSATN | 0.250939 | -0.04706 |
| SyS1322 | 3142 | GCCCAAATTAATTCTTCTCCGCCGCTGGCACAG | 7731 | AQINSSPPLAQ | 12320 | INSSPPL | 0.250894 | -0.20462 |
| GS729 | 3143 | GCCCAAACTCAGAATCTGGCGGGTGGTGCACAG | 7732 | AQTQNLAGGAQ | 12321 | TQNLAGG | 0.250713 | -0.13682 |
| SyS1323 | 3144 | GCCCAATTTCCAAGTCGCGCCAAAGACAGAGCACAG | 7733 | AQFQVAKDRAQ | 12322 | FQVAKDR | 0.250692 | 0.020536 |
| GS731 | 3145 | GCCCAACGGCTGAGTGGTAATCAGAATGCACAG | 7734 | AQRLSGNQNAQ | 12323 | RLSGNQN | 0.250664 | 0.025382 |

FIG. 33 (Continued)

| SyS1324 | 3146 | GCCCAAACTACGGATCGGGTGTCGCATGCACAG | 7735 | AQTTDRVSHAQ | 12324 | TTDRVSH | 0.250526 | 0.007999 |
|---|---|---|---|---|---|---|---|---|
| SyS1325 | 3147 | GCCCAAACTGCTACTGTGACGGCTCGGGCACAG | 7736 | AQTATVTARAQ | 12325 | TATVTAR | 0.250464 | -0.16039 |
| SyS1326 | 3148 | GCCCAACTCAGCATGATGAGGCGACAAAGCACAG | 7737 | AQLSMMSDKAQ | 12326 | LSMMSDK | 0.250432 | -0.15808 |
| GS733 | 3149 | GCCCAAACTCTGATTCAGACTAGTCCGGCACAG | 7738 | AQTLIQTSPAQ | 12327 | TLIQTSP | 0.250263 | -0.14429 |
| SyS1327 | 3150 | GCCCAACCGATGCATATTACGAATGCTGCACAG | 7739 | AQPMHITNAAQ | 12328 | PMHITNA | 0.250148 | -0.22434 |
| GS734 | 3151 | GCCCAAACCGTCGGCCAACCGCCCACGCACAG | 7740 | AQTVGQPAHAQ | 12329 | TVGQPAH | 0.25007 | -0.08134 |
| SyS1328 | 3152 | GCCCAAGAAGACAAAGACGTCAGACTCGCACAG | 7741 | AQEDKDVRLAQ | 12330 | EDKDVRL | 0.249926 | -0.22926 |
| GS735 | 3153 | GCCCAAATGAAGGTTGCGCAGCCTATGGCACAG | 7742 | AQMKVAQPMAQ | 12331 | MKVAQPM | 0.249854 | -0.12039 |
| SyS1329 | 3154 | GCCCAAGTGGGGGTGCCTAATCTGCCGGCACAG | 7743 | AQVGVPNLPAQ | 12332 | VGVPNLP | 0.24985 | -0.07803 |
| SyS1330 | 3155 | GCCCAAGGCGCCGCTGAGTAGTGATCCGGCACAG | 7744 | AQAPLSSDPAQ | 12333 | APLSSDP | 0.249809 | -0.13798 |
| GS737 | 3156 | GCCCAATTCCTCCACGCGTCGACGCGCACAG | 7745 | AQFLHASVDAQ | 12334 | FLHASVD | 0.249673 | -0.17919 |
| GS738 | 3157 | GCCCAACCTACTGTGGGGACGTATATTGCACAG | 7746 | AQPTVGTYIAQ | 12335 | PTVGTYI | 0.249673 | -0.1765 |
| GS739 | 3158 | GCCCAAGAGCCTCTGCATAGGAATTCTGCACAG | 7747 | AQEPLHRNSAQ | 12336 | EPLHRNS | 0.249673 | -0.1442 |
| GS740 | 3159 | GCCCAAGCCAGCACCGTCACCGTCGAAGCACAG | 7748 | AQASTVTVEAQ | 12337 | ASTVTVE | 0.249673 | -0.18727 |
| GS741 | 3160 | GCCCAAGCCCCAGAATCGACAACGCCGCACAG | 7749 | AQAPRIDNAAQ | 12338 | APRIDNA | 0.249673 | -0.05537 |
| GS744 | 3161 | GCCCAAATATCGTGATTCGGCTGCTCCTGCACAG | 7750 | AQYRDSAAPAQ | 12339 | YRDSAAP | 0.249343 | -0.13666 |
| SyS1332 | 3162 | GCCCAACTCACCCAAAACGCCAGCGTGCACAG | 7751 | AQLTQNASVAQ | 12340 | LTQNASV | 0.249317 | -0.0022 |
| SyS1335 | 3163 | GCCCAATTGAGTGCTCGTTTGACGACTGCACAG | 7752 | AQLSARLTTAQ | 12341 | LSARLTT | 0.24914 | -0.09677 |
| SS87 | 3164 | GCCCAAAACGGCAAAAGCAGCGACAAAGCACAG | 7753 | AQNGKSSDKAQ | 12342 | NGKSSDK | 0.249118 | -0.28649 |
| SyS1336 | 3165 | GCCCAAGCGCTGGTGAAGGATACTACTGCACAG | 7754 | AQALVKDTTAQ | 12343 | ALVKDTT | 0.248993 | -0.14405 |
| SyS1337 | 3166 | GCCCAAATGCTCGTCACCACCGGCGAAGCACAG | 7755 | AQMLVTTGEAQ | 12344 | MLVTTGE | 0.248845 | -0.13932 |
| SyS1338 | 3167 | GCCCAAGGCGGCAACCCAGCTACGCCGCACAG | 7756 | AQSGNPSYAAQ | 12345 | SGNPSYA | 0.248803 | -0.02317 |
| SyS1339 | 3168 | GCCCAAGTCATCACCGGCGGCATGAGCGCACAG | 7757 | AQVITGGMSAQ | 12346 | VITGGMS | 0.248801 | 0.075387 |
| SyS1340 | 3169 | GCCCAACTCGAACCCAACGTCCAAACCGCACAG | 7758 | AQLEPNVQTAQ | 12347 | LEPNVQT | 0.248763 | -0.19133 |
| SyS1341 | 3170 | GCCCAAAGATTCAGCGAAGTCACCCCCGCACAG | 7759 | AQRFSEVTPAQ | 12348 | RFSEVTP | 0.248692 | 0.100649 |
| GS745 | 3171 | GCCCAAGATCCGGGGAAGGCGAGTCTGGCACAG | 7760 | AQDPGKASLAQ | 12349 | DPGKASL | 0.248503 | -0.07157 |
| SyS1343 | 3172 | GCCCAAATCGCCCACGAAAGCACCGACGCACAG | 7761 | AQIAHESTDAQ | 12350 | IAHESTD | 0.248487 | -0.15595 |
| GS748 | 3173 | GCCCAATATCCTAGTAATTCTATGCATGCACAG | 7762 | AQYPSNSMHAQ | 12351 | YPSNSMH | 0.248436 | -0.05512 |
| SyS1345 | 3174 | GCCCAAGAGCACCACCCCCCAGCGGCGCACAG | 7763 | AQSTTPPSGAQ | 12352 | STTPPSG | 0.248285 | -0.18648 |
| SyS1346 | 3175 | GCCCAAGTTGAGCAGAATTCTAAGAATGCACAG | 7764 | AQVEQNSKNAQ | 12353 | VEQNSKN | 0.248285 | -0.18648 |
| GS749 | 3176 | GCCCAAAACGATTGCGGGTCGGCTTGTGTGGCACAG | 7765 | AQTIAGRLVAQ | 12354 | TIAGRLV | 0.248255 | -0.15097 |
| GS750 | 3177 | GCCCAAGCTAGGCATACGGGGTGAGATGGCACAG | 7766 | AQARHTGEMAQ | 12355 | ARHTGEM | 0.24798 | -0.11854 |

FIG. 33 (Continued)

| | | | | | | | | |
|---|---|---|---|---|---|---|---|---|
| GS751 | 3178 | GCCCAACAGCATCTGCCGAATCATATTGCACAG | 7767 | AQQHLPNHIAQ | 12356 | QHLPNHI | 0.2479 | -0.16932 |
| GS752 | 3179 | GCCCAAACTACTATGGGGACTTATCCTGCACAG | 7768 | AQTTMGTYPAQ | 12357 | TTMGTYP | 0.247856 | -0.17201 |
| SyS1347 | 3180 | GCCCAAACCGAAAGCGTCATGCCCAGAGCACAG | 7769 | AQTESVMPRAQ | 12358 | TESVMPR | 0.247776 | -0.09369 |
| SyS1348 | 3181 | GCCCAAGGCGCCAAACCCAGCAACGACGCACAG | 7770 | AQGAKPSNDAQ | 12359 | GAKPSND | 0.247643 | 0.125092 |
| SyS1349 | 3182 | GCCCAAGCCGTCAGCAGCGACATGAGCGCACAG | 7771 | AQAVSSDMSAQ | 12360 | AVSSDMS | 0.2476 | -0.16102 |
| SyS1350 | 3183 | GCCCAACACAGCCCCCAACTCGGCGGCGCACAG | 7772 | AQHSPQLGGAQ | 12361 | HSPQLGG | 0.247571 | -0.12465 |
| SyS1351 | 3184 | GCCCAATTGTATACTAATCCTAATACTGCACAG | 7773 | AQLYTNPNTAQ | 12362 | LYTNPNT | 0.247527 | -0.17382 |
| SyS1352 | 3185 | GCCCAAACCGTCGCCCTCAACATGGCCGCACAG | 7774 | AQTVALNMAAQ | 12363 | TVALNMA | 0.247496 | -0.02465 |
| GS754 | 3186 | GCCCAACAGCGGGTTCCTGCTTATCAGGCACAG | 7775 | AQQRVPAYQAQ | 12364 | QRVPAYQ | 0.247403 | -0.14564 |
| SyS1353 | 3187 | GCCCAAAGTGATGTTTCTAAGGTTTATGCACAG | 7776 | AQSDVSKVYAQ | 12365 | SDVSKVY | 0.247354 | -0.11668 |
| SyS1354 | 3188 | GCCCAATCGAATACGGGGGAGCAGGTTGCACAG | 7777 | AQSNTGEQVAQ | 12366 | SNTGEQV | 0.247184 | -0.19254 |
| SyS1355 | 3189 | GCCCAATTCACCACCGGCCTCAACCACGCACAG | 7778 | AQFTTGLNHAQ | 12367 | FTTGLNH | 0.247139 | -0.09374 |
| SyS1356 | 3190 | GCCCAAAACGACACACCAATACAAACACGCACAG | 7779 | AQNDTQYKHAQ | 12368 | NDTQYKH | 0.247109 | -0.10786 |
| SyS1357 | 3191 | GCCCAAGTCCACGACGTCAAAGGCATCGCACAG | 7780 | AQVHDVKGIAQ | 12369 | VHDVKGI | 0.247033 | 0.063895 |
| GS756 | 3192 | GCCCAATATGGTGGTAGGGATAGTTATGCACAG | 7781 | AQYGGRDSYAQ | 12370 | YGGRDSY | 0.246964 | -0.09066 |
| SyS1358 | 3193 | GCCCAACATAGTACTGCGACTACTCATGCACAG | 7782 | AQHSTATTHAQ | 12371 | HSTATTH | 0.246866 | -0.15132 |
| SyS1360 | 3194 | GCCCAACCTTCGCCTACTACTCGGACTGCACAG | 7783 | AQPSPTTRTAQ | 12372 | PSPTTRT | 0.246802 | -0.21694 |
| SyS1361 | 3195 | GCCCAAGGGCATGCGGGAGGCGGGATGGCACAG | 7784 | AQGHAEAAMAQ | 12373 | GHAEAAM | 0.246802 | -0.16027 |
| SyS1362 | 3196 | GCCCAAAGCCTCAGCACCAGACCCGTCGCACAG | 7785 | AQSLSTRPVAQ | 12374 | SLSTRPV | 0.24675 | -0.01949 |
| GS757 | 3197 | GCCCAATCTCCGGTGCCTGGTAAGCCTGCACAG | 7786 | AQSPVPGKPAQ | 12375 | SPVPGKP | 0.246636 | -0.15138 |
| GS758 | 3198 | GCCCAAACCAGAATCACACGCCCCCTGCACAG | 7787 | AQTRINSPLAQ | 12376 | TRINSPL | 0.246552 | -0.07422 |
| SyS1363 | 3199 | GCCCAAGAGTCTACGTATGCGAAGCTGGCACAG | 7788 | AQESTYAKLAQ | 12377 | ESTYAKL | 0.246443 | -0.12586 |
| SyS1364 | 3200 | GCCCAACAAATCAACCAAGGCACCAGAGCACAG | 7789 | AQQINQGTRAQ | 12378 | QINQGTR | 0.246362 | 0.115808 |
| GS759 | 3201 | GCCCAAGGCAGCAGAACCGGCAGCATCGCACAG | 7790 | AQGSRTGSIAQ | 12379 | GSRTGSI | 0.24628 | -0.05088 |
| SyS1365 | 3202 | GCCCAAGGGAATGCTTCTTGGTCTGGCTGCACAG | 7791 | AQGNASWSAAQ | 12380 | GNASWSA | 0.246249 | 0.006225 |
| SyS1366 | 3203 | GCCCAAGCGGCTCATGATATTGGTAAGGCACAG | 7792 | AQAAHDIGKAQ | 12381 | AAHDIGK | 0.2462 | -0.14162 |
| GS760 | 3204 | GCCCAAAAGGATAGGCCTTTTGTGGAGGCACAG | 7793 | AQKDRPFVEAQ | 12382 | KDRPFVE | 0.246199 | -0.16753 |
| SyS1367 | 3205 | GCCCAACTCCCCACCAAACCCTTCGCACAG | 7794 | AQLPHTKPFAQ | 12383 | LPHTKPF | 0.246181 | -0.02281 |
| SyS1368 | 3206 | GCCCAACCTGGGAAGGGTGTGTCTCTTGCACAG | 7795 | AQPGKGVSLAQ | 12384 | PGKGVSL | 0.246139 | 0.157066 |
| SyS1369 | 3207 | GCCCAAGACAGACAAAACGCCAGCGCCGCACAG | 7796 | AQDRQNASAAQ | 12385 | DRQNASA | 0.246065 | -0.07979 |
| SyS1370 | 3208 | GCCCAAGTCCAACCCAGCCTCAGCGTCGCACAG | 7797 | AQVQPSLSVAQ | 12386 | VQPSLSV | 0.246042 | -0.08582 |
| SyS1371 | 3209 | GCCCAAAAGCCTACGCCGATTGAGTTTGCACAG | 7798 | AQKPTPIEFAQ | 12387 | KPTPIEF | 0.246004 | -0.1986 |

FIG. 33 (Continued)

| | | | | | | | | |
|---|---|---|---|---|---|---|---|---|
| SyS1372 | 3210 | GCCCAACTGCTTCATGATATGAAGAGTGCACAG | 7799 | AQLLHDMKSAQ | 12388 | LLHDMKS | 0.245942 | 0.000193 |
| SyS1373 | 3211 | GCCCAAAACAGCGACAGAACCCTCAGCGCACAG | 7800 | AQNSDRTLSAQ | 12389 | NSDRTLS | 0.245806 | -0.17998 |
| SyS1374 | 3212 | GCCCAAAAGGTTGGGCATGGGTTAATGCACAG | 7801 | AQKVGHGFNAQ | 12390 | KVGHGFN | 0.24575 | -0.23173 |
| GS761 | 3213 | GCCCAAACGAAGCCTGCGGTTAGTTTTGCACAG | 7802 | AQTKPAVSFAQ | 12391 | TKPAVSF | 0.245736 | -0.16051 |
| SyS1375 | 3214 | GCCCAAGCTATGACGAATATTCCGAAGGCACAG | 7803 | AQAMTNIPKAQ | 12392 | AMTNIPK | 0.245618 | -0.13316 |
| GS762 | 3215 | GCCCAATTTTCGCATATGTCTTTGCCGGCACAG | 7804 | AQFSHMSLPAQ | 12393 | FSHMSLP | 0.245614 | -0.18368 |
| SyS1376 | 3216 | GCCCAAGGGTCTGTGCGGGATAATCCGGCACAG | 7805 | AQGSVRDNPAQ | 12394 | GSVRDNP | 0.245593 | -0.19375 |
| GS763 | 3217 | GCCCAAGTAGTTCGCAGGGGCCGACTGCACAG | 7806 | AQSSSQGPTAQ | 12395 | SSSQGPT | 0.24552 | -0.10423 |
| GP139 | 3218 | GCCCAACTTGTGGGGCGGCCGGTTACGGCACAG | 7807 | AQLVGRPVTAQ | 12396 | LVGRPVT | 0.245491 | -0.07301 |
| SyS1377 | 3219 | GCCCAAATCAACTACGGCGTCAAAAAGCACAG | 7808 | AQINYGVQKAQ | 12397 | INYGVQK | 0.245326 | 0.004509 |
| SyS1378 | 3220 | GCCCAAATTAATAAGGATAATAATCAGGCACAG | 7809 | AQINKDNNQAQ | 12398 | INKDNNQ | 0.245119 | -0.081 |
| SyS1379 | 3221 | GCCCAAAGTGGTCAGTCTTCTGCTATGGCACAG | 7810 | AQSGQSSAMAQ | 12399 | SGQSSAM | 0.245048 | -0.00536 |
| GS765 | 3222 | GCCCAAGAATACAACAGCACCAAACTCGCACAG | 7811 | AQEYNSTKLAQ | 12400 | EYNSTKL | 0.244968 | 0.026789 |
| SyS1381 | 3223 | GCCCAATTTATGACGCTGGAGCGGGGGGCACAG | 7812 | AQFMTLERAAQ | 12401 | FMTLERA | 0.244739 | -0.20466 |
| GS766 | 3224 | GCCCAATTCGGCAAGACTACGTCAACGCACAG | 7813 | AQFGKDYVNAQ | 12402 | FGKDYVN | 0.244671 | -0.06664 |
| SyS1382 | 3225 | GCCCAACTCCTCCGGCGGCACCCCGCACAG | 7814 | AQLLLGGTPAQ | 12403 | LLLGGTP | 0.244645 | -0.15288 |
| GS767 | 3226 | GCCCAAACCACCACCTACACCAGAAACGCACAG | 7815 | AQTTYTRNAQ | 12404 | TTYTRN | 0.244598 | -0.0132 |
| GP140 | 3227 | GCCCAAGATCGGGGTATGCGGGGGGCTGCACAG | 7816 | AQDRGMRGAAQ | 12405 | DRGMRGA | 0.24456 | -0.07273 |
| GS769 | 3228 | GCCCAAGCGGTTTCGGGTACGCGTACGGCACAG | 7817 | AQAVSGTRTAQ | 12406 | AVSGTRT | 0.244519 | -0.05607 |
| SS88 | 3229 | GCCCAAAACTTCAGCGGCGTGCCAAAGCACAG | 7818 | AQNFSGVAKAQ | 12407 | NFSGVAK | 0.24428 | -0.34565 |
| GS770 | 3230 | GCCCAAGATCGGAATAATAGTATTTCGGCACAG | 7819 | AQDRNNSISAQ | 12408 | DRNNSIS | 0.244033 | -0.1765 |
| GS771 | 3231 | GCCCAAATCCCCAAAGACCCCTCGACGCACAG | 7820 | AQIPQRPLDAQ | 12409 | IPQRPLD | 0.244033 | -0.1424 |
| GP141 | 3232 | GCCCAACCTGCTGCGAATCAGTATGTTGCACAG | 7821 | AQPAANQYVAQ | 12410 | PAANQYV | 0.243833 | 0.318489 |
| GS772 | 3233 | GCCCAATACAGCGGCACCGCCATCGAGCACAG | 7822 | AQYSGTAIRAQ | 12411 | YSGTAIR | 0.243671 | -0.06766 |
| GS773 | 3234 | GCCCAATGGGTTCAGCGGACTGAGAGTGCACAG | 7823 | AQWVQRTESAQ | 12412 | WVQRTES | 0.243512 | -0.17768 |
| SyS1385 | 3235 | GCCCAACCCAAAGACGCGGCCATCGCACAG | 7824 | AQPKDGGAIAQ | 12413 | PKDGGAI | 0.243472 | -0.17259 |
| SyS1386 | 3236 | GCCCAACTTGCTACTCCGCAGGAGGAGGCACAG | 7825 | AQLATPQEEAQ | 12414 | LATPQEE | 0.243453 | -0.23618 |
| GS774 | 3237 | GCCCAACTGAATAGTCCGGTTATGGCGGCACAG | 7826 | AQLNSPVMAAQ | 12415 | LNSPVMA | 0.243434 | -0.14048 |
| GP142 | 3238 | GCCCAAGGGGCTACTGGGACGAGGGGCTGCACAG | 7827 | AQGATGTRAAQ | 12416 | GATGTRA | 0.243373 | -0.01961 |
| SyS1387 | 3239 | GCCCAACGGACGGATGTGCGGGACGAATGCACAG | 7828 | AQRTDVRTNAQ | 12417 | RTDVRTN | 0.243327 | -0.18527 |
| SyS1388 | 3240 | GCCCAAAGAAACCTCGCCCACCCTACGCACAG | 7829 | AQRNLAHPYAQ | 12418 | RNLAHPY | 0.243327 | -0.18527 |
| SyS1389 | 3241 | GCCCAACTCAGCACCAGCTACACAGCCACGCACAG | 7830 | AQLSTSYSTAQ | 12419 | LSTSYST | 0.243288 | -0.15981 |

FIG. 33 (Continued)

| | | | | | | | |
|---|---|---|---|---|---|---|---|
| SyS1390 | 3242 | GCCCAAGGCGGTCAACCAAACCGCCAGAGAGCACAG | 7831 | AQGVNQTARAQ | 12420 | GVNQTAR | 0.243276 | -0.08615 |
| SyS1391 | 3243 | GCCCAACTTCCGGCTAGTTCGGCTAGGGCACAG | 7832 | AQIPASSARAQ | 12421 | LPASSAR | 0.243214 | -0.08645 |
| SyS1392 | 3244 | GCCCAACAACTCTACAGCGTCAACGCCGCACAG | 7833 | AQQLYSVNAAQ | 12422 | QLYSVNA | 0.243023 | -0.15496 |
| SyS1393 | 3245 | GCCCAAGTTGGGACGTATACTGCTACGGCACAG | 7834 | AQVGTYTATAQ | 12423 | VGTYTAT | 0.243023 | -0.18042 |
| GS775 | 3246 | GCCCAAGAAGAGCATGACCGTCATCGAAGCACAG | 7835 | AQRSMTVIEAQ | 12424 | RSMTVIE | 0.242977 | -0.15669 |
| SyS1394 | 3247 | GCCCAATTTGGGCGTGGTGATACGGGGTGCACAG | 7836 | AQFGRGDTGAQ | 12425 | FGRGDTG | 0.242909 | 0.104483 |
| SyS1395 | 3248 | GCCCAAGCCGCGGCAGAAGCAACCCCGCACAG | 7837 | AQAAGRSNPAQ | 12426 | AAGRSNP | 0.242903 | 0.079024 |
| GS776 | 3249 | GCCCAAATGCCTCAGTCGAGTCTTGCTGCACAG | 7838 | AQMPQSSLAAQ | 12427 | MPQSSLA | 0.242838 | -0.16718 |
| SyS1397 | 3250 | GCCCAACCGTCTAAGCATGAGCGGGTATGCACAG | 7839 | AQPSKHERYAQ | 12428 | PSKHERY | 0.242467 | -0.20586 |
| SyS1399 | 3251 | GCCCAATTGTTTGATTCTTCTAAGACTGCACAG | 7840 | AQLFDSSKTAQ | 12429 | LFDSSKT | 0.242166 | -0.06487 |
| GS779 | 3252 | GCCCAAAGCCCCAACCAGACTCAGCGCACAG | 7841 | AQSPQPRLSAQ | 12430 | SPQPRLS | 0.242119 | -0.1774 |
| SyS1400 | 3253 | GCCCAAAGAAGAACCGACGTCGAAAACGCACAG | 7842 | AQRRPDVENAQ | 12431 | RRPDVEN | 0.242029 | -0.04446 |
| GS780 | 3254 | GCCCAACCGATGGGTAGTGCGGGGTAGTGCACAG | 7843 | AQPMGSAGSAQ | 12432 | PMGSAGS | 0.241931 | -0.10709 |
| GS781 | 3255 | GCCCAATGGAGCACCGGCATGACCAGCGCACAG | 7844 | AQWSTGMTSAQ | 12433 | WSTGMTS | 0.241931 | -0.10709 |
| SyS1401 | 3256 | GCCCAAGGCCTCGTCAGAAACGGCGTCGCACAG | 7845 | AQGLVRNGVAQ | 12434 | GLVRNGV | 0.241887 | 0.011133 |
| SyS1402 | 3257 | GCCCAAGAGGGGTCGTATAGTACGTCTCGCACAG | 7846 | AQEGSYSTSAQ | 12435 | EGSYSTS | 0.241562 | -0.07279 |
| SyS1403 | 3258 | GCCCAAGCCACCAGCATGCTCACCCACGCACAG | 7847 | AQATSMLTHAQ | 12436 | ATSMLTH | 0.241541 | -0.18163 |
| SyS1404 | 3259 | GCCCAAGCAACCACCACCGGCCCCCCAGCGCACAG | 7848 | AQSTTGPPSAQ | 12437 | STTGPPS | 0.241416 | -0.00061 |
| SyS1405 | 3260 | GCCCAACGTGGGGCGTCGGTGTCTATGGCACAG | 7849 | AQRGASVSMAQ | 12438 | RGASVSM | 0.241293 | -0.17678 |
| SyS1406 | 3261 | GCCCAAGTCCACGAACACGGCGCCAGCGCACAG | 7850 | AQVHEHGASAQ | 12439 | VHEHGAS | 0.241293 | -0.20709 |
| GS783 | 3262 | GCCCAACATTCTCCTTCTCAGCCGAGGGCACAG | 7851 | AQHSPSQPRAQ | 12440 | HSPSQPR | 0.241239 | -0.18816 |
| SyS1407 | 3263 | GCCCAAGGCATCGGCCAAAACACCGCCGCACAG | 7852 | AQGIGQNTAAQ | 12441 | GIGQNTA | 0.240916 | 0.12394 |
| SyS1408 | 3264 | GCCCAACACAGAGTCGAAAAACAGCTACGCACAG | 7853 | AQHRVENSYAQ | 12442 | HRVENSY | 0.240897 | -0.13677 |
| GS785 | 3265 | GCCCAAACTGAGTTTAAGCCTCCGTCGGCACAG | 7854 | AQTEFKPPSAQ | 12443 | TEFKPPS | 0.240856 | -0.16051 |
| SyS1409 | 3266 | GCCCAATATGGTAATTTGGGGGTTAATGCACAG | 7855 | AQYGNLGVNAQ | 12444 | YGNLGVN | 0.240623 | -0.09677 |
| SyS1410 | 3267 | GCCCAACTCACCAGAGTCCTCACCGGCGCACAG | 7856 | AQLTRVLTGAQ | 12445 | LTRVLTG | 0.240472 | -0.09192 |
| SyS1411 | 3268 | GCCCAAATGAAAAACAGCAACGGCGCCGCACAG | 7857 | AQMKNSNGAAQ | 12446 | MKNSNGA | 0.240422 | -0.05676 |
| GS788 | 3269 | GCCCAAGGCACCCAAACCCACCTCCAAGCACAG | 7858 | AQGTQTHLQAQ | 12447 | GTQTHLQ | 0.24023 | -0.15766 |
| SyS1412 | 3270 | GCCCAAAATGCGCTTGCTAGGACGATGGCACAG | 7859 | AQNALARTMAQ | 12448 | NALARTM | 0.240048 | -0.14768 |
| GS789 | 3271 | GCCCAAAATAATTCTATGCAGACGGTGGCACAG | 7860 | AQNNSMQTVAQ | 12449 | NNSMQTV | 0.24002 | -0.16035 |
| GS790 | 3272 | GCCCAACAACAAGGCAACGGCCAGAAGCGCACAG | 7861 | AQQQGNGRSAQ | 12450 | QQGNGRS | 0.239981 | -0.06255 |
| GS791 | 3273 | GCCCAACTCACCAAAAGCCAAGGCTACGCACAG | 7862 | AQLTKSQGYAQ | 12451 | LTKSQGY | 0.239958 | -0.05367 |

FIG. 33 (Continued)

| | | | | | | | |
|---|---|---|---|---|---|---|---|
| SyS1413 | 3274 | GCCCAAGCCCCGCCGAACCCAAAACCGCACAG | 7863 | AQAPAEPKTAQ | 12452 | APAEPKT | 0.239917 | -0.07252 |
| SyS1415 | 3275 | GCCCAATATAGTAATCAGGTGAGTAATGCACAG | 7864 | AQYSNQVSNAQ | 12453 | YSNQVSN | 0.23984 | -0.17799 |
| GS792 | 3276 | GCCCAAACTCGTACGGGGTTTTCTCCTGCACAG | 7865 | AQTRTGFSPAQ | 12454 | TRTGFSP | 0.23983 | -0.09659 |
| SyS1416 | 3277 | GCCCAACCCGTCTACAAAACCGACGACGCACAG | 7866 | AQPVYKTDDAQ | 12455 | PVYKTDD | 0.23942 | 0.109874 |
| SyS1417 | 3278 | GCCCAATCTGATAGGCGGCTCCTGAGGCACAG | 7867 | AQSDRPAPEAQ | 12456 | SDRPAPE | 0.239322 | -0.20345 |
| GS796 | 3279 | GCCCAAGTTCAGGAGAAGTCGAGGCCTGCACAG | 7868 | AQVQEKSRPAQ | 12457 | VQEKSRP | 0.239154 | -0.05489 |
| SyS1418 | 3280 | GCCCAAAGCGGGCGGCCTCACCGAAAGAGCACAG | 7869 | AQSGGLTERAQ | 12458 | SGGLTER | 0.238974 | 0.018624 |
| GS797 | 3281 | GCCCAAAGCGGCGGCGGCACCAGAGAAGGCGCACAG | 7870 | AQSGGTREGAQ | 12459 | SGGTREG | 0.238968 | -0.17195 |
| GS798 | 3282 | GCCCAAGCCGTCCCGGCGAAACCAGAGCACAG | 7871 | AQAVPGETRAQ | 12460 | AVPGETR | 0.238881 | -0.10872 |
| SyS1419 | 3283 | GCCCAACCGCGGCGGCGGAGAGGATGTATGCACAG | 7872 | AQPRPERMYAQ | 12461 | PRPERMY | 0.238847 | -0.23376 |
| SyS1420 | 3284 | GCCCAAAGCAACGGCAACATCAGCAGAGCACAG | 7873 | AQSNGNISRAQ | 12462 | SNGNISR | 0.23868 | 0.07724 |
| GS799 | 3285 | GCCCAAGCCAGAACCGAAAGAAACCAAGCACAG | 7874 | AQARTERNQAQ | 12463 | ARTERNQ | 0.238676 | -0.07152 |
| SyS1421 | 3286 | GCCCAAAGTCCTCAGCAGTTTCGAAGGCACAG | 7875 | AQSPQQFSKAQ | 12464 | SPQQFSK | 0.238555 | -0.16766 |
| SyS1422 | 3287 | GCCCAAAGCACCGGCCCCTTCCCCCAAGCACAG | 7876 | AQSTGPFPQAQ | 12465 | STGPFPQ | 0.238506 | -0.2268 |
| GS800 | 3288 | GCCCAAGCCAACATCGGCACCAGCACGCACAG | 7877 | AQANIGTSTAQ | 12466 | ANIGTST | 0.238473 | -0.1462 |
| SyS1423 | 3289 | GCCCAATACAGAGACAACACCAGCGGCGCACAG | 7878 | AQYRDNTSGAQ | 12467 | YRDNTSG | 0.238378 | -0.04463 |
| SyS1424 | 3290 | GCCCAAGTGCAGACTAGGTCTCCGATGGCACAG | 7879 | AQVQTRSPMAQ | 12468 | VQTRSPM | 0.238378 | -0.13435 |
| SyS1425 | 3291 | GCCCAAATCCACACCAGCATCGTCGACGCACAG | 7880 | AQIHTSIVDAQ | 12469 | IHTSIVD | 0.238378 | -0.1792 |
| GS801 | 3292 | GCCCAAATGACTCGGACTAGTAGTGAGGCACAG | 7881 | AQMTRTSSEAQ | 12470 | MTRTSSE | 0.23833 | -0.08134 |
| SyP51 | 3293 | GCCCAACCGTCGAATTTTCCTGGGTCTGCACAG | 7882 | AQPSNFPGSAQ | 12471 | PSNFPGS | 0.238303 | -0.0398 |
| SyS1426 | 3294 | GCCCAAATGATCGGCGGCACCCAAAGCGCACAG | 7883 | AQMIGGTQSAQ | 12472 | MIGGTQS | 0.238168 | -0.21921 |
| SyS1427 | 3295 | GCCCAAAAGCTTGATAAGCATGAGTCTGCACAG | 7884 | AQKLDKHESAQ | 12473 | KLDKHES | 0.238069 | -0.16951 |
| SyS1428 | 3296 | GCCCAACTTACGAGTAGTAATAGTGCTGCACAG | 7885 | AQLTSSNSAAQ | 12474 | LTSSNSA | 0.23749 | -0.09555 |
| GS805 | 3297 | GCCCAAAGTACTCGTGATACTCATTTTGCACAG | 7886 | AQSTRDTHFAQ | 12475 | STRDTHF | 0.237351 | -0.04196 |
| GS808 | 3298 | GCCCAAGATACGTTGAAGGGTGTTAGGGCACAG | 7887 | AQDTLKAVRAQ | 12476 | DTLKAVR | 0.237261 | -0.17201 |
| GS809 | 3299 | GCCCAACAGCGTAATCCGTCGCTTCATGCACAG | 7888 | AQQRNPSLHAQ | 12477 | QRNPSLH | 0.237261 | -0.14151 |
| SyS1430 | 3300 | GCCCAATCGGGTGATGGGAATCGTTCGGCACAG | 7889 | AQSGDGNRSAQ | 12478 | SGDGNRS | 0.237239 | 0.28722 |
| SyS1431 | 3301 | GCCCAAGGCGTCTACAAAACCCTCCACGCACAG | 7890 | AQGVYKTLHAQ | 12479 | GVYKTLH | 0.236906 | -0.18042 |
| GS812 | 3302 | GCCCAAATTAATTCGAATCAGGTGAGTGCACAG | 7891 | AQINSNQVSAQ | 12480 | INSNQVS | 0.236622 | -0.1774 |
| SyS1432 | 3303 | GCCCAACACTACAACGAACACATGACCGCACAG | 7892 | AQHYNEHMTAQ | 12481 | HYNEHMT | 0.236614 | -0.05689 |
| SyS1433 | 3304 | GCCCAAACTGTGCAGGTTCGTGATCGGGCACAG | 7893 | AQTVQVRDRAQ | 12482 | TVQVRDR | 0.236461 | -0.06516 |
| TS162 | 3305 | GCCCAAGGCAACGACATCAGAGAAGCAGAGCACAG | 7894 | AQGNDIRSRAQ | 12483 | GNDIRSR | 0.236352 | 0.106582 |

FIG. 33 (Continued)

| | | | | | | | | |
|---|---|---|---|---|---|---|---|---|
| SyS1434 | 3306 | GCCCAAGTCAGCGTCAGCATGGGCCCGCACAG | 7895 | AQVSVSMGPAQ | 12484 | VSVSMGP | 0.236036 | -0.02892 |
| SyS1436 | 3307 | GCCCAATTCAAAACCAACATCAGCGCGCACAG | 7896 | AQFKTNISAAQ | 12485 | FKTNISA | 0.235866 | -0.12707 |
| SyS1438 | 3308 | GCCCAATTTCCGAAGGTGGAGAGGTATGCACAG | 7897 | AQFPKVERYAQ | 12486 | FPKVERY | 0.235735 | -0.23296 |
| SyS1439 | 3309 | GCCCAACTTAGTAAGTTTCAGACTACGGCACAG | 7898 | AQLSKFQTTAQ | 12487 | LSKFQTT | 0.235498 | -0.19723 |
| SyS1442 | 3310 | GCCCAAAGCCTCATGAACAGCAGAAGCGCACAG | 7899 | AQSLMNSRSAQ | 12488 | SLMNSRS | 0.235263 | -0.09106 |
| SyP52 | 3311 | GCCCAAGGGCGTGGGGTGCTGGAGTCTGCACAG | 7900 | AQGRGVLESAQ | 12489 | GRGVLES | 0.235143 | -0.04392 |
| GS814 | 3312 | GCCCAACCTAATGGGTCGCAGATGATTGCACAG | 7901 | AQPNGSQMIAQ | 12490 | PNGSQMI | 0.235069 | -0.1756 |
| SyS1443 | 3313 | GCCCAACCCACCGTCGGCAACAGCTACGCACAG | 7902 | AQPTVGNSYAQ | 12491 | PTVGNSY | 0.234983 | 0.010187 |
| SyS1444 | 3314 | GCCCAAAGCAGCGACATCATGAAAGCCGCACAG | 7903 | AQSSDIMKAAQ | 12492 | SSDIMKA | 0.234776 | -0.13314 |
| GS816 | 3315 | GCCCAACTGATGACTAGTAGTGCTGGTCGTGCACAG | 7904 | AQLMTSAGRAQ | 12493 | LMTSAGR | 0.234691 | -0.17829 |
| SyS1447 | 3316 | GCCCAACCCGCCATGAGCAGCAGCAGAGCACAG | 7905 | AQPAMSSSRAQ | 12494 | PAMSSSR | 0.234552 | 0.036927 |
| GS817 | 3317 | GCCCAACGTGATAAGGCGATTTCGACGGCACAG | 7906 | AQRDKAISTAQ | 12495 | RDKAIST | 0.234493 | -0.08025 |
| GS818 | 3318 | GCCCAATTGACTTTGAAGCAGGGGATTGCACAG | 7907 | AQLTLKQGIAQ | 12496 | LTLKQGI | 0.234404 | -0.1433 |
| GS819 | 3319 | GCCCAATCTCATGCTAATGGGTTTAGTGCACAG | 7908 | AQSHANGFSAQ | 12497 | SHANGFS | 0.234293 | -0.18099 |
| SyS1449 | 3320 | GCCCAACCGAATTGAAGGCTCCGCAGGCACAG | 7909 | AQPNLKAPQAQ | 12498 | PNLKAPQ | 0.233974 | -0.18769 |
| SyS1450 | 3321 | GCCCAAAGCTACGGCAGAGAAGTCAGAGCACAG | 7910 | AQSYGREVRAQ | 12499 | SYGREVR | 0.233931 | -0.18284 |
| SyS1451 | 3322 | GCCCAAAACGACACCCAAAGCCCCAAAGCACAG | 7911 | AQNDTQSPKAQ | 12500 | NDTQSPK | 0.233816 | -0.16829 |
| SyS1452 | 3323 | GCCCAAGACGAAAGAGCCCCAAACACGCACAG | 7912 | AQDERAPKHAQ | 12501 | DERAPKH | 0.233748 | -0.15859 |
| GS820 | 3324 | GCCCAAAACGGCAGACCCATGGGCATGGCACAG | 7913 | AQNGRPMGMAQ | 12502 | NGRPMGM | 0.233736 | -0.12617 |
| GS821 | 3325 | GCCCAACATACTCAGTCTGTGACTATGGCACAG | 7914 | AQHTQSVTMAQ | 12503 | HTQSVTM | 0.233699 | -0.16125 |
| SyS1453 | 3326 | GCCCAAAACAACTTCAACGCCAGCCTCGCACAG | 7915 | AQNNFNASLAQ | 12504 | NNFNASL | 0.23358 | -0.1295 |
| SyS1454 | 3327 | GCCCAAGAATACCTCAAAGGCAGCGCGCACAG | 7916 | AQEYLKGSAAQ | 12505 | EYLKGSA | 0.23358 | -0.1295 |
| GS822 | 3328 | GCCCAATCTAAGACGCCTGATATGTTGGCACAG | 7917 | AQSKTPDMLAQ | 12506 | SKTPDML | 0.233472 | -0.15138 |
| SyS1455 | 3329 | GCCCAAGTCAACACCGGCCACGTCAGAGCACAG | 7918 | AQVNTGHVRAQ | 12507 | VNTGHVR | 0.23344 | -0.13454 |
| GS823 | 3330 | GCCCAAGGTTCTCAGTCGGATGCGGTGCACAG | 7919 | AQGSQSDARAQ | 12508 | GSQSDAR | 0.233353 | -0.0985 |
| SyS1456 | 3331 | GCCCAATCTTTGACTTTTCTAAGGATGCACAG | 7920 | AQSLTFSKDAQ | 12509 | SLTFSKD | 0.233165 | -0.15904 |
| SyS1457 | 3332 | GCCCAAAACGCCCTCGAAAGCAGAATGGCACAG | 7921 | AQNALESRMAQ | 12510 | NALESRM | 0.233165 | -0.18121 |
| SyS1458 | 3333 | GCCCAAAACGGCATCGCCAGAGAACCCGCACAG | 7922 | AQNGIAREPAQ | 12511 | NGIAREP | 0.233148 | 0.030787 |
| SyS1459 | 3334 | GCCCAAAACCTCGTCAGCGTCAGCACCGCACAG | 7923 | AQNLVSVSTAQ | 12512 | NLVSVST | 0.232787 | -0.21694 |
| SyS1461 | 3335 | GCCCAAGACATGCTCAGCTACAAACCCGCACAG | 7924 | AQDMLSYKPAQ | 12513 | DMLSYKP | 0.232747 | 0.049327 |
| SyS1463 | 3336 | GCCCAAAGAAGCACCGACAGCATGACCGCACAG | 7925 | AQRSTDSMTAQ | 12514 | RSTDSMT | 0.232649 | 0.12732 |
| SyS1464 | 3337 | GCCCAAGAGATGAATCATAGTCTTTCTGCACAG | 7926 | AQEMNHSLSAQ | 12515 | EMNHSLS | 0.232545 | -0.18614 |

FIG. 33 (Continued)

| | | | | | | | | |
|---|---|---|---|---|---|---|---|---|
| GS827 | 3338 | GCCCAAGCCCTCAGCAAAGAAGCCAGCGCACAG | 7927 | AQALSKEASAQ | 12516 | ALSKEAS | 0.232439 | -0.11949 |
| SyS1465 | 3339 | GCCCAAAACGGCCACACGCGGCCAAGCACAG | 7928 | AQNGHNMSQAQ | 12517 | NGHNMSQ | 0.232428 | -0.00948 |
| SyS1466 | 3340 | GCCCAAACACCGCGGAAGCCACCAGAGCACAG | 7929 | AQTTAEATRAQ | 12518 | TTAEATR | 0.232428 | -0.03372 |
| SyS1467 | 3341 | GCCCAAAGAGAAAGCGCCCACCACAACGCACAG | 7930 | AQRESAHHNAQ | 12519 | RESAHHN | 0.232428 | -0.12586 |
| SyS1469 | 3342 | GCCCAAATGTTACGGGGAATGGGCAGGCACAG | 7931 | AQMFTGNGQAQ | 12520 | MFTGNGQ | 0.232428 | -0.218 |
| SyS1470 | 3343 | GCCCAACATCTTCAGACGCGCCGGCTGCACAG | 7932 | AQHLQTPPAAQ | 12521 | HLQTPPA | 0.232331 | -0.2305 |
| SyS1471 | 3344 | GCCCAATCGCTTGTGGGTCAGGGTAAGGCACAG | 7933 | AQSLVGQGKAQ | 12522 | SLVGQGK | 0.232298 | -0.09584 |
| SyS1472 | 3345 | GCCCAACTCCCCTCACCCCATCGCCGCACAG | 7934 | AQIPLTPIAAQ | 12523 | LPLTPIA | 0.232279 | 0.019127 |
| GS828 | 3346 | GCCCAAGCTATGAAGCAGTCGTCTATTGCACAG | 7935 | AQAMKQSSIAQ | 12524 | AMKQSSI | 0.232051 | -0.12341 |
| GS829 | 3347 | GCCCAATATCCTACGAATGTGAAGTCGGCACAG | 7936 | AQYPTNVKSAQ | 12525 | YPTNVKS | 0.232018 | 0.099106 |
| SyS1473 | 3348 | GCCCAAAGCAACAGCCTCCCCAGCAGAGCACAG | 7937 | AQSNSLPSRAQ | 12526 | SNSLPSR | 0.231997 | -0.06106 |
| GS830 | 3349 | GCCCAACCGACGGCGGCTACTGGGACGGCACAG | 7938 | AQPTAATGTAQ | 12527 | PTAATGT | 0.231918 | -0.16528 |
| GS831 | 3350 | GCCCAAATCGCCCAAAACGGCCCCGGCGCACAG | 7939 | AQIAQNGPGAQ | 12528 | IAQNGPG | 0.231887 | -0.12998 |
| SyS1475 | 3351 | GCCCAAACTACTCATCAGCTTACTCCGGCACAG | 7940 | AQTTHQLTPAQ | 12529 | TTHQLTP | 0.231805 | 0.179914 |
| SyS1476 | 3352 | GCCCAACTTATTCCTGCGAGGGATGTGGCACAG | 7941 | AQLIPARDVAQ | 12530 | LIPARDV | 0.231788 | -0.0519 |
| SyS1477 | 3353 | GCCCAAAAAATCGCCCACGGCGACATCGCACAG | 7942 | AQKIAHGDIAQ | 12531 | KIAHGDI | 0.231565 | -0.05433 |
| SyS1478 | 3354 | GCCCAAGCCAGACCCCAAAGCGACAAAGCACAG | 7943 | AQARPQSDKAQ | 12532 | ARPQSDK | 0.231506 | 0.192363 |
| SyS1479 | 3355 | GCCCAACCCAGACCCAACGTCCTCGAGCACAG | 7944 | AQPRPNVLDAQ | 12533 | PRPNVLD | 0.231372 | 0.138428 |
| GS833 | 3356 | GCCCAACTCAACAAAGGCAGCAGCAACGCACAG | 7945 | AQLNKGSSNAQ | 12534 | LNKGSSN | 0.231355 | -0.0385 |
| GS834 | 3357 | GCCCAACGGGTTTATAATGGTGATCTGGCACAG | 7946 | AQRVYNGDLAQ | 12535 | RVYNGDL | 0.231254 | -0.14048 |
| SyS1481 | 3358 | GCCCAAACCGTCCCGCCAACAGCAGCGCACAG | 7947 | AQTVPANSSAQ | 12536 | TVPANSS | 0.231245 | -0.13677 |
| SyS1482 | 3359 | GCCCAACCAGACACACCAGCCTCACCGCACAG | 7948 | AQTRHTSLTAQ | 12537 | TRHTSLT | 0.231191 | -0.14647 |
| SS95 | 3360 | GCCCAAAATCATGCGGTGACGAATTCTGCACAG | 7949 | AQNHAVTNSAQ | 12538 | NHAVTNS | 0.231161 | -0.29794 |
| SyS1483 | 3361 | GCCCAATTGGCGTCGCATTCTACGCTTGCACAG | 7950 | AQLASHSTLAQ | 12539 | LASHSTL | 0.231132 | -0.15617 |
| GS836 | 3362 | GCCCAAGTGCGCCTTCAAAAGCGGCATCGCACAG | 7951 | AQVAFKSGIAQ | 12540 | VAFKSGI | 0.231125 | -0.13792 |
| SyS1484 | 3363 | GCCCAAAGAGTCGGCCCGAAAGCAGCGGCACAG | 7952 | AQRVGPESSAQ | 12541 | RVGPESS | 0.231067 | -0.16587 |
| GS838 | 3364 | GCCCAAGCCCCAGCAACGTCCACCGCACAG | 7953 | AQAPSNVHTAQ | 12542 | APSNVHT | 0.231055 | -0.05067 |
| SyS1485 | 3365 | GCCCAAACTAGGTCGGAGGTGATGAAGGCACAG | 7954 | AQTRSEVMKAQ | 12543 | TRSEVMK | 0.230872 | -0.19011 |
| GS839 | 3366 | GCCCAATTGAAGGAGCAGCATGGTGGGGCACAG | 7955 | AQLKEQHGGAQ | 12544 | LKEQHGG | 0.230779 | -0.18009 |
| SP37 | 3367 | GCCCAAAAGGCGGAGTCGCATGCGACGGCACAG | 7956 | AQKAESHATAQ | 12545 | KAESHAT | 0.230702 | -0.0491 |
| SyS1486 | 3368 | GCCCAATATAGGACGGATATGCTGAGTGCACAG | 7957 | AQYRTDMLSAQ | 12546 | YRTDMLS | 0.230667 | -0.20955 |
| GS841 | 3369 | GCCCAAGATACGCAGGGGAGGAGGATGCGGGCACAG | 7958 | AQDTQGRMRAQ | 12547 | DTQGRMR | 0.230611 | -0.10327 |

FIG. 33 (Continued)

| | | | | | | | | |
|---|---|---|---|---|---|---|---|---|
| GS842 | 3370 | GCCCAATGTCTTCCTAAGGGTTGTACGGCACAG | 7959 | AQCLPKGCTAQ | 12548 | CLPKGCT | 0.230518 | -0.15097 |
| SyS1487 | 3371 | GCCCAAGGCAGCCCACCGTCGTCCACGCACAG | 7960 | AQGSPTVVHAQ | 12549 | GSPTVVH | 0.230363 | -0.07403 |
| SyS1488 | 3372 | GCCCAATTGTCGCTTTCTACGCAGAGGGCACAG | 7961 | AQLSLSTQRAQ | 12550 | LSLSTQR | 0.230358 | -0.10005 |
| GS843 | 3373 | GCCCAAAAACATGGCCCAAAACGCCAGAGCACAG | 7962 | AQNMAQNARAQ | 12551 | NMAQNAR | 0.230121 | -0.1462 |
| GS845 | 3374 | GCCCAACTCAGCACCAACGTCCTCCTCGCACAG | 7963 | AQLSTNVLLAQ | 12552 | LSTNVLL | 0.229919 | -0.16573 |
| GS846 | 3375 | GCCCAAACTTCGCCTGTTATTCGTACTGCACAG | 7964 | AQTSPVIRTAQ | 12553 | TSPVIRT | 0.229823 | -0.17386 |
| SyS1490 | 3376 | GCCCAACCTAGTGCTGGTCATGTTTGGCACAG | 7965 | AQPSAGHVLAQ | 12554 | PSAGHVL | 0.229391 | -0.18648 |
| GS849 | 3377 | GCCCAACTGTCTGGTACGGCTACTTCGGCACAG | 7966 | AQLSGTATSAQ | 12555 | LSGTATS | 0.229374 | -0.16909 |
| SyS1491 | 3378 | GCCCAAACGGGTAATCGAATCGGACTGCACAG | 7967 | AQTGNPNPTAQ | 12556 | TGNPNPT | 0.229306 | -0.17998 |
| SyS1492 | 3379 | GCCCAACAATTCGAACACAGCCTCCCCGCACAG | 7968 | AQQFEHSLPAQ | 12557 | QFEHSLP | 0.229163 | -0.03857 |
| SyS1493 | 3380 | GCCCAACTCACCCGGCCAAATCAGAGCACAG | 7969 | AQLTPGQIRAQ | 12558 | LTPGQIR | 0.229124 | 0.08066 |
| GS850 | 3381 | GCCCAACTGATGAATGCGAAGACGACGGCACAG | 7970 | AQLMNAKTTAQ | 12559 | LMNAKTT | 0.22906 | -0.06983 |
| SyS1494 | 3382 | GCCCAACAAAGAGACACCAACATGGCCGCACAG | 7971 | AQQRDTNMAAQ | 12560 | QRDTNMA | 0.228811 | 0.109343 |
| SyS1495 | 3383 | GCCCAAAACCTCCTCGAAATCGGCAGAGCACAG | 7972 | AQNILEIGRAQ | 12561 | NILEIGR | 0.228652 | -0.22042 |
| SyS1496 | 3384 | GCCCAAGACGTCAAAGACAAACAAATCGCACAG | 7973 | AQDVKDKQIAQ | 12562 | DVKDKQI | 0.228561 | -0.08214 |
| GS851 | 3385 | GCCCAAGTGACTATTTCGAATAAGCCTGCACAG | 7974 | AQVTISNKPAQ | 12563 | VTISNKP | 0.228495 | -0.06638 |
| SyS1497 | 3386 | GCCCAAAGCACCCCCATCAACAGCAGAGCACAG | 7975 | AQSTPINSRAQ | 12564 | STPINSR | 0.228369 | -0.10161 |
| SyS1499 | 3387 | GCCCAAGGCACCCACGGCCTCACCAGCGCACAG | 7976 | AQGTHGLTSAQ | 12565 | GTHGLTS | 0.228217 | 0.021364 |
| SyS1500 | 3388 | GCCCAACAGTCTCCGGGGATGATTCATGCACAG | 7977 | AQQSPGMIHAQ | 12566 | QSPGMIH | 0.228178 | -0.10536 |
| SyS1501 | 3389 | GCCCAACAAAACCGGCCCGTTCCTCAGCGCACAG | 7978 | AQQTGPVLSAQ | 12567 | QTGPVLS | 0.2281 | -0.17799 |
| GS853 | 3390 | GCCCAAACTTATGTGTCGTCGGTCCGGCACAG | 7979 | AQTYVSSGPAQ | 12568 | TYVSSGP | 0.228034 | -0.07561 |
| SyS1502 | 3391 | GCCCAAACCAGCACCCTCCCAGACTCGCACAG | 7980 | AQTSTLPRLAQ | 12569 | TSTLPRL | 0.227986 | -0.21571 |
| SyS1503 | 3392 | GCCCAATACACCCACAAAGACAACGACGCACAG | 7981 | AQYTHKDNDAQ | 12570 | YTHKDND | 0.227932 | -0.20709 |
| SyS1504 | 3393 | GCCCAACTCGGCGCCCAAAGCACCCTCGCACAG | 7982 | AQLGAQSTLAQ | 12571 | LGAQSTL | 0.227857 | -0.18769 |
| SyS1505 | 3394 | GCCCAATTGGCGCAGGTTAGGCTGCTGCACAG | 7983 | AQLAQVRPAAQ | 12572 | LAQVRPA | 0.227792 | -0.01727 |
| GS854 | 3395 | GCCCAAGGCAGGAGAGTCGTCGCCAGCAACGCACAG | 7984 | AQGRVVASNAQ | 12573 | GRVVASN | 0.227751 | -0.11202 |
| TS165 | 3396 | GCCCAAAGTAATCGGGTTAGGGATCTTGCACAG | 7985 | AQSNRVRDLAQ | 12574 | SNRVRDL | 0.227718 | -0.09285 |
| SyS1506 | 3397 | GCCCAAGAGAAAGAGACAGAGAGAAAAACTCGCACAG | 7986 | AQERDREKLAQ | 12575 | ERDREKL | 0.227632 | -0.12947 |
| GS855 | 3398 | GCCCAAAAGTCTGGACGAGTTCTACTGCACAG | 7987 | AQKSGTSSTAQ | 12576 | KSGTSST | 0.227463 | -0.16214 |
| SyS1507 | 3399 | GCCCAAGCTGGTCAGAGTACTATTTATGCACAG | 7988 | AQAGQSTIYAQ | 12577 | AGQSTIY | 0.227436 | -0.20224 |
| GS856 | 3400 | GCCCAAGAGTTTTCGCAGCCGAGGCTGGCACAG | 7989 | AQEFSQPRLAQ | 12578 | EFSQPRL | 0.22738 | -0.18245 |
| GS857 | 3401 | GCCCAAAACGTATGCGAGGTCGGATAAGGCACAG | 7990 | AQTYARSDKAQ | 12579 | TYARSDK | 0.227253 | -0.11091 |

FIG. 33 (Continued)

| | | | | | | | | |
|---|---|---|---|---|---|---|---|---|
| GS859 | 3402 | GCCCAAGGCAAATTCAACGGCCACACCGCACAG | 7991 | AQGKFNGHTAQ | 12580 | GKFNGHT | 0.227141 | -0.07202 |
| GS860 | 3403 | GCCCAACGGTTGATTAGTAGTAATGGGAATGCACAG | 7992 | AQRLISNGNAQ | 12581 | RLISNGN | 0.227083 | -0.13571 |
| GS861 | 3404 | GCCCAATTGAAGGAGTCGTTGGGGCCTGCACAG | 7993 | AQLKESLGPAQ | 12582 | LKESLGP | 0.226974 | -0.14811 |
| GS862 | 3405 | GCCCAAAACAGACACACCCTGCCGTCGCACAG | 7994 | AQNRHTLAVAQ | 12583 | NRHTLAV | 0.226794 | -0.18188 |
| GS863 | 3406 | GCCCAAAGAGACACCAGACTCAGCGCCGCACAG | 7995 | AQRDTRLSAAQ | 12584 | RDTRLSA | 0.226714 | -0.14334 |
| GS864 | 3407 | GCCCAAGTCAGCAGCAGACTCGGCAGCATCGCACAG | 7996 | AQVSRLGSIAQ | 12585 | VSRLGSI | 0.226686 | -0.12988 |
| GS865 | 3408 | GCCCAATTGACTACGTCGGTGATTTCGGCACAG | 7997 | AQLTTSVISAQ | 12586 | LTTSVIS | 0.226678 | -0.17291 |
| SyS1509 | 3409 | GCCCAATTTAAGGGGGTGGCTCATATTGCACAG | 7998 | AQFKGVAHIAQ | 12587 | FKGVAHI | 0.226637 | -0.1792 |
| GS866 | 3410 | GCCCAAAAGACGACGGAGGCTCTTCCTGCACAG | 7999 | AQKTTEALPAQ | 12588 | KTTEALP | 0.226561 | -0.15574 |
| SyS1510 | 3411 | GCCCAACGTAATCAGCATGATACTACTGCACAG | 8000 | AQRNQHDTTAQ | 12589 | RNQHDTT | 0.226461 | -0.1307 |
| SyS1511 | 3412 | GCCCAAAATAAGCTTCTGCCTCGTAGTGCACAG | 8001 | AQNKLLPRSAQ | 12590 | NKLLPRS | 0.226387 | -0.15657 |
| GS867 | 3413 | GCCCAAGTCAACAGCCACGAAAGAGCCGCACAG | 8002 | AQVNSHERAAQ | 12591 | VNSHERA | 0.226374 | -0.16814 |
| GS868 | 3414 | GCCCAAGCGAAGGGTAGTCTGAAATATGGCACAG | 8003 | AQAKGSLNMAQ | 12592 | AKGSLNM | 0.22628 | -0.08549 |
| SyS1512 | 3415 | GCCCAAGTTAAGACTAAGACTGATCGGGTTCTGGCACAG | 8004 | AQVKTDRVLAQ | 12593 | VKTDRVL | 0.226235 | -0.04586 |
| SyS1513 | 3416 | GCCCAACCGGTTCGGATCAGATTAGGGCACAG | 8005 | AQPRSDQIRAQ | 12594 | PRSDQIR | 0.226105 | -0.21694 |
| GS869 | 3417 | GCCCAAAACAGAGTCGGCACCGAAAGAGCACAG | 8006 | AQNRVGTERAQ | 12595 | NRVGTER | 0.226048 | -0.00622 |
| SyS1514 | 3418 | GCCCAAGGCGTCCCCACCGCACCGCACAG | 8007 | AQGVPTAGTAQ | 12596 | GVPTAGT | 0.226045 | -0.22557 |
| GS870 | 3419 | GCCCAAAGCCTCATGAAACAAAGCCACGCACAG | 8008 | AQSLMKQSHAQ | 12597 | SLMKQSH | 0.225961 | -0.13881 |
| GS871 | 3420 | GCCCAAGGCACCAGCAACATCATGGCACAG | 8009 | AQGTSSNIMAQ | 12598 | GTSSNIM | 0.225838 | -0.14143 |
| SyS1515 | 3421 | GCCCAACTTCGGAGTGATATTAGTACTGCACAG | 8010 | AQLRSDISTAQ | 12599 | LRSDIST | 0.225835 | -0.09082 |
| GS872 | 3422 | GCCCAAATGACCACCGCAGAGACCTCGCACAG | 8011 | AQMTTGRDLAQ | 12600 | MTTGRDL | 0.225564 | -0.06321 |
| SyS1516 | 3423 | GCCCAAAGTGGTTGCGAATAGTTATGCACAG | 8012 | AQSGVANSYAQ | 12601 | SGVANSY | 0.225464 | -0.10606 |
| SyS1517 | 3424 | GCCCAAGCGGTTCCGTCTTATAATAATGCACAG | 8013 | AQAVPSYNNAQ | 12602 | AVPSYNN | 0.225384 | -0.18728 |
| GS873 | 3425 | GCCCAACTCAACGGCGGCAACAGCCCCGCACAG | 8014 | AQLNGGNSPAQ | 12603 | LNGGNSP | 0.225327 | -0.11997 |
| GS874 | 3426 | GCCCAAAACAGCAGCACCAGCAGTGGGCACAG | 8015 | AQNSHSTSWAQ | 12604 | NSHSTSW | 0.225327 | -0.17291 |
| GS875 | 3427 | GCCCAAATGTATCATACGGGGCAGGTGGCACAG | 8016 | AQMYHTGQVAQ | 12605 | MYHTGQV | 0.22518 | -0.15855 |
| GS876 | 3428 | GCCCAAAGAGACAAAACTCTACATCGCCGCACAG | 8017 | AQRDKLYIAAQ | 12606 | RDKLYIA | 0.225179 | -0.14429 |
| SyS1518 | 3429 | GCCCAAAGGAAGTCGGAGGCGGTTCTTGCACAG | 8018 | AQRKSEAVLAQ | 12607 | RKSEAVL | 0.225067 | -0.14768 |
| SyP53 | 3430 | GCCCAACATAAGGGTATTCAGGTGATTGCACAG | 8019 | AQHKGIQVIAQ | 12608 | HKGIQVI | 0.224991 | -0.04221 |
| GP146 | 3431 | GCCCAAATTGGGAAGGATGCTCCGAAGGCACAG | 8020 | AQIGKDAPKAQ | 12609 | IGKDAPK | 0.224985 | -0.06655 |
| SyS1519 | 3432 | GCCCAAAGCCTCGCCGGCCTCCAAGACGCACAG | 8021 | AQSLAGLQDAQ | 12610 | SLAGLQD | 0.22498 | 0.118922 |
| SyS1520 | 3433 | GCCCAATTTAGGGTGTCTGTTGCTGAGGCACAG | 8022 | AQFRVSVAEAQ | 12611 | FRVSVAE | 0.22497 | -0.2305 |

FIG. 33 (Continued)

| | | | | | | | | |
|---|---|---|---|---|---|---|---|---|
| SyS1521 | 3434 | GCCCAAACCCACACAAAGAACACAGCATCGCACAG | 8023 | AQTHKEHSIAQ | 12612 | THKEHSI | 0.2249 | -0.06105 |
| SyS1522 | 3435 | GCCCAAAACAGCAACCACCACTACAGAGCACACAG | 8024 | AQNSNHTYRAQ | 12613 | NSNHTYR | 0.224808 | -0.22285 |
| SyS1523 | 3436 | GCCCAATTTAATGGGGTTCGTACGGTGGCACAG | 8025 | AQFNGVRTVAQ | 12614 | FNGVRTV | 0.224692 | -0.12465 |
| GS878 | 3437 | GCCCAACACATGGGCATGAGAGACGGCGCACAG | 8026 | AQHMGMRDGAQ | 12615 | HMGMRDG | 0.22465 | -0.16125 |
| SyS1524 | 3438 | GCCCAAGGGCAGCAGTCTATGGCGGTGGCACAG | 8027 | AQGQQSMAVAQ | 12616 | GQQSMAV | 0.224648 | -0.1923 |
| GS879 | 3439 | GCCCAATGGTGCGAGTCAGGTTAATCGTGCACAG | 8028 | AQWSSQVNRAQ | 12617 | WSSQVNR | 0.224293 | -0.16432 |
| SyS1525 | 3440 | GCCCAAGGTTGCCATGTTGGGGATGCCGGCACAG | 8029 | AQGSHVGMPAQ | 12618 | GSHVGMP | 0.224189 | -0.1392 |
| GP147 | 3441 | GCCCAAAAGGGGTCGTTGACTGCTAGTGCACAG | 8030 | AQKGSLTASAQ | 12619 | KGSLTAS | 0.224166 | -0.06794 |
| SyS1526 | 3442 | GCCCAAGGCGCCCAAAGCAACATCGTCGCACAG | 8031 | AQGAQSNIVAQ | 12620 | GAQSNIV | 0.224129 | -0.07858 |
| GS880 | 3443 | GCCCAAAATGATTATAATCATACGCGTGCACAG | 8032 | AQNDYNHTRAQ | 12621 | NDYNHTR | 0.224097 | -0.18547 |
| GS881 | 3444 | GCCCAACAAATCAACCCAGCAGCGTCGCACAG | 8033 | AQQINPSSVAQ | 12622 | QINPSSV | 0.224097 | -0.17829 |
| GS882 | 3445 | GCCCAAGCGTTGCGTGGTGCGTCTAATGCACAG | 8034 | AQALRGASNAQ | 12623 | ALRGASN | 0.224097 | -0.17112 |
| SyS1527 | 3446 | GCCCAAAGTGCTTCGACTATGTCGTTTGCACAG | 8035 | AQSASTMSFAQ | 12624 | SASTMSF | 0.223975 | -0.13887 |
| GS883 | 3447 | GCCCAACTCAGCAGCAACAACAACGCACACAG | 8036 | AQLSSNNNNAQ | 12625 | LSSNNNN | 0.223961 | -0.10614 |
| GS884 | 3448 | GCCCAATCTACGACGCTGGCGTCGAAGGCACAG | 8037 | AQSTTLASKAQ | 12626 | STTLASK | 0.223954 | -0.1411 |
| GS885 | 3449 | GCCCAACACAGAATGCTCGACGGCGTCGCACAG | 8038 | AQHRMLDGVAQ | 12627 | HRMLDGV | 0.223938 | -0.15478 |
| SyS1528 | 3450 | GCCCAAAGCAGCGAAAGCAGCACCCCGCACAG | 8039 | AQSSESSTPAQ | 12628 | SSESSTP | 0.223912 | -0.17678 |
| GS886 | 3451 | GCCCAATTGTATGATTCTAGTCATAGTGCACAG | 8040 | AQLYDSSHSAQ | 12629 | LYDSSHS | 0.223828 | -0.13594 |
| SyS1529 | 3452 | GCCCAAGGTAATTATAATTTGAGTGTGGCACAG | 8041 | AQGNYNLSVAQ | 12630 | GNYNLSV | 0.223824 | -0.18808 |
| GS887 | 3453 | GCCCAAATGCATAATGTTGCTACGGTGGCACAG | 8042 | AQMHNVATVAQ | 12631 | MHNVATV | 0.223778 | -0.12132 |
| SyS1530 | 3454 | GCCCAAACCAACTACGGCGACAGCGTCGCACAG | 8043 | AQTNYGDSVAQ | 12632 | TNYGDSV | 0.223637 | -0.06038 |
| SyS1531 | 3455 | GCCCAAAATCGTGGGGAGGATGCGCGGGCACAG | 8044 | AQNRGEDARAQ | 12633 | NRGEDAR | 0.223622 | 0.017796 |
| GS889 | 3456 | GCCCAATTTGGTAAGACGGCGGCTACTGCACAG | 8045 | AQFGKTAATAQ | 12634 | FGKTAAT | 0.223612 | -0.1451 |
| GS890 | 3457 | GCCCAAAATACGAAGGTTAATACTGAGGCACAG | 8046 | AQNTKVNTEAQ | 12635 | NTKVNTE | 0.223612 | -0.1451 |
| GS891 | 3458 | GCCCAAGTCACCGGCCACCTCAGCAGCGCACAG | 8047 | AQVTGHLSSAQ | 12636 | VTGHLSS | 0.223553 | -0.15945 |
| SyS1532 | 3459 | GCCCAAGTGGCTACTTCGCATTTGAAGGCACAG | 8048 | AQVATSHLKAQ | 12637 | VATSHLK | 0.223491 | -0.21436 |
| SyS1533 | 3460 | GCCCAATACACACCCCGGCAGCGACAGAGCACAG | 8049 | AQYTPGSDRAQ | 12638 | YTPGSDR | 0.223431 | -0.03541 |
| SyS1534 | 3461 | GCCCAAGGCTTCACCAGCCGTCACCCAGCGCACAG | 8050 | AQGFTVTHAQ | 12639 | GFTVTH | 0.223406 | -0.15859 |
| SyS1535 | 3462 | GCCCAAGCCGCGCCACCAGCACCACCGCACAG | 8051 | AQAAATSTTAQ | 12640 | AAATSTT | 0.223334 | -0.08247 |
| SyS1536 | 3463 | GCCCAAGCGAATATTCATGTTCATGGTGCACAG | 8052 | AQANIHVHGAQ | 12641 | ANIHVHG | 0.223187 | -0.13556 |
| SyS1537 | 3464 | GCCCAATATAGTTTGCGGGGTAATGATGCACAG | 8053 | AQYSLRGNDAQ | 12642 | YSLRGND | 0.223187 | -0.16344 |
| SyS1538 | 3465 | GCCCAAATTGATCAGATTGTGCAGCGTGCACAG | 8054 | AQIDQIVQRAQ | 12643 | IDQIVQR | 0.223187 | -0.19133 |

FIG. 33 (Continued)

| ID | No. | DNA Sequence | No. | Peptide | No. | Peptide | Value | Value |
|---|---|---|---|---|---|---|---|---|
| SyS1539 | 3466 | GCCCAATTCAACAGCGACCTCGCCATGGCACAG | 8055 | AQFNSDLAMAQ | 12644 | FNSDLAM | 0.223187 | -0.19133 |
| SyS1540 | 3467 | GCCCAAAATATGGAGTGCGCAGCGTTATGCACAG | 8056 | AQNMESQRYAQ | 12645 | NMESQRY | 0.223135 | -0.2231 |
| SyP54 | 3468 | GCCCAACCGCTTCTAGTTCGGCTTTCGGCACAG | 8057 | AQPLSSSLSAQ | 12646 | PLSSSLS | 0.222938 | -0.04335 |
| SyS1541 | 3469 | GCCCAACAGGGTACGCTTCATGCTGAGGCACAG | 8058 | AQQGTLHAEAQ | 12647 | QGTLHAE | 0.222917 | -0.19618 |
| SyS1542 | 3470 | GCCCAACCGACAGAGCCACGCCCTCGCACAG | 8059 | AQPDRATALAQ | 12648 | PDRATAL | 0.222911 | -0.1344 |
| SyS1543 | 3471 | GCCCAAGCCAACGGCAAAATCCAACTCGCACAG | 8060 | AQANGKIQLAQ | 12649 | ANGKIQL | 0.22286 | 0.163533 |
| SyS1545 | 3472 | GCCCAATACAGCAAAGACAGAGCACGACGGCACAG | 8061 | AQYSKDRHDAQ | 12650 | YSKDRHD | 0.22263 | 0.135905 |
| SyS1546 | 3473 | GCCCAAGACAGCACCAGCAGAGCCTGGGCACAG | 8062 | AQDSTSRAWAQ | 12651 | DSTSRAW | 0.222511 | -0.22891 |
| SyS1547 | 3474 | GCCCAAGGCCTCAGCGTCGCCATCCCGCACAG | 8063 | AQGLSVAIPAQ | 12652 | GLSVAIP | 0.222511 | -0.22891 |
| SyS1548 | 3475 | GCCCAATCGTATCTTACTAATCATGTGGCACAG | 8064 | AQSYLTNHVAQ | 12653 | SYLTNHV | 0.222327 | -0.20588 |
| SyS1550 | 3476 | GCCCAAGTTATTACGCATAATATGCCTGCACAG | 8065 | AQVITHNMPAQ | 12654 | VITHNMP | 0.222221 | -0.13192 |
| GS894 | 3477 | GCCCAAAACAGAACCCACGTCCCCAAGCACAG | 8066 | AQNRTHVPQAQ | 12655 | NRTHVPQ | 0.222189 | -0.10995 |
| GS895 | 3478 | GCCCAACTCCAAACCACCAGAGCCGTCGCACAG | 8067 | AQLQTTRAVAQ | 12656 | LQTTRAV | 0.222058 | 0.00505 |
| SyS1551 | 3479 | GCCCAAGCCCCAAGCGTCGACGTCGCACAG | 8068 | AQAPNAIDVAQ | 12657 | APNAIDV | 0.222003 | -0.13677 |
| GS896 | 3480 | GCCCAAGTCAGAGACAACACCGTCTACGCACAG | 8069 | AQVRDNTVYAQ | 12658 | VRDNTVY | 0.221995 | -0.14143 |
| SyS1552 | 3481 | GCCCAAACTCGTATTGGGACGTCGTTGGCACAG | 8070 | AQTRIGTSLAQ | 12659 | TRIGTSL | 0.221747 | -0.01731 |
| SyS1553 | 3482 | GCCCAAACCCTCACCAGCGGCAACGTCGCACAG | 8071 | AQTLTSGNVAQ | 12660 | TLTSGNV | 0.221657 | 0.075338 |
| GS897 | 3483 | GCCCAACATCTTGATACTATGCGGGGTGCACAG | 8072 | AQHLDTMRGAQ | 12661 | HLDTMRG | 0.221624 | -0.14743 |
| GS898 | 3484 | GCCCAACTCAGCAGCACCACCCTCAACGCACAG | 8073 | AQLSSTTLNAQ | 12662 | LSSTTLN | 0.221499 | -0.10327 |
| TS166 | 3485 | GCCCAAGTTCAGAGTAATAATATTACGACGTCTCGCACAG | 8074 | AQVQSNRTNAQ | 12663 | VQSNRTN | 0.221422 | -0.26117 |
| SyS1554 | 3486 | GCCCAAAATAATAATATTACGACGTCTTGGCACAG | 8075 | AQNNNITTSAQ | 12664 | NNNITTS | 0.221339 | -0.15304 |
| GS899 | 3487 | GCCCAAGTCGGCACCGCGCCGGCAAACTCGCACAG | 8076 | AQVGTAGKLAQ | 12665 | VGTAGKL | 0.221334 | -0.1471 |
| SyS1555 | 3488 | GCCCAACCCGCCATCAGCACCGACCACGCACAG | 8077 | AQPAISTDHAQ | 12666 | PAISTDH | 0.22129 | -0.17435 |
| GP148 | 3489 | GCCCAAAGTAATCTGGGTAATGTGCCGGCACAG | 8078 | AQSNLGNVPAQ | 12667 | SNLGNVP | 0.22117 | -0.04186 |
| SyS1556 | 3490 | GCCCAACAACAAAACCAAAGCAGATTCACCGCACAG | 8079 | AQQNQSRFTAQ | 12668 | QNQSRFT | 0.221076 | 0.133629 |
| GS900 | 3491 | GCCCAAGCTTCTAAGGGTATGACGTTGGCACAG | 8080 | AQASKGMTLAQ | 12669 | ASKGMTL | 0.221024 | -0.11947 |
| SyS1557 | 3492 | GCCCAAGCCACCGCGCCAAGACAAAACCGCACAG | 8081 | AQATAQDKTAQ | 12670 | ATAQDKT | 0.220998 | -0.14056 |
| SS100 | 3493 | GCCCAATGGGACAGCAGCAGCGTCAGAGCACAG | 8082 | AQWDSSSVRAQ | 12671 | WDSSSVR | 0.220864 | -0.36436 |
| SyS1558 | 3494 | GCCCAAACGAATGGTAGTGAGAAGAAGTGCACAG | 8083 | AQTNGSEKSAQ | 12672 | TNGSEKS | 0.220858 | -0.11495 |
| SyS1560 | 3495 | GCCCAATCTGCTGAGAATCATACGTATGCACAG | 8084 | AQSAENHTYAQ | 12673 | SAENHTY | 0.220753 | -0.21202 |
| SyS1561 | 3496 | GCCCAAAGCGTCCCCAAGCCTACCAAGCACAG | 8085 | AQSVPQAYQAQ | 12674 | SVPQAYQ | 0.220753 | -0.23296 |
| SyS1562 | 3497 | GCCCAAAAAGACTACGTCGTCACCAACGCACAG | 8086 | AQKDYVVTNAQ | 12675 | KDYVVTN | 0.220753 | -0.23296 |

FIG. 33 (Continued)

| | | | | | | | | |
|---|---|---|---|---|---|---|---|---|
| SyS1563 | 3498 | GCCCAAGTCGTCCAAATGAAACAAACCGCACAG | 8087 | AQVVQMKQTAQ | 12676 | VVQMKQT | 0.220688 | -0.18405 |
| GS901 | 3499 | GCCCAAGAGAACCCTCAGCCTCACCGCCGCACAG | 8088 | AQRTLSLTAAQ | 12677 | RTLSLTA | 0.220684 | -0.171 |
| GS902 | 3500 | GCCCAAAACACCGTCGTCGGCAGCAGCGCACAG | 8089 | AQNTVVGSSAQ | 12678 | NTVVGSS | 0.220539 | -0.15192 |
| GS903 | 3501 | GCCCAATCTTTGAATAGTCCGACGACTGCACAG | 8090 | AQSLNSPTTAQ | 12679 | SLNSPTT | 0.220388 | -0.12331 |
| SyS1564 | 3502 | GCCCAAACCACCGGCATGGACGTCAAAGCACAG | 8091 | AQTTGMDVKAQ | 12680 | TTGMDVK | 0.220289 | -0.06566 |
| GS907 | 3503 | GCCCAAAACAACAGAGACACCACCAACGCACAG | 8092 | AQNNRDTTNAQ | 12681 | NNRDTTN | 0.220068 | -0.11907 |
| GS908 | 3504 | GCCCAATGGGGCAACTACACCCCACCGCACAG | 8093 | AQWGNYTPTAQ | 12682 | WGNYTPT | 0.220016 | -0.16842 |
| SyS1565 | 3505 | GCCCAAGGGATTACGGCGTTCTGATACTGCACAG | 8094 | AQGITRSDTAQ | 12683 | GITRSDT | 0.219828 | -0.01242 |
| GS910 | 3506 | GCCCAACACATCCTCAGAACCCCGAAGCACAG | 8095 | AQHILRTPEAQ | 12684 | HILRTPE | 0.219735 | -0.1756 |
| GS911 | 3507 | GCCCAACGTTCTGCTAGTGTGGAGAATGCACAG | 8096 | AQRSASVENAQ | 12685 | RSASVEN | 0.219721 | -0.14524 |
| SyS1568 | 3508 | GCCCAAAGCCTCAGCCTCGGCAAAGGCGCACAG | 8097 | AQSLSLGKGAQ | 12686 | SLSLGKG | 0.219525 | -0.0022 |
| SyS1570 | 3509 | GCCCAAAAAGAGAAGTCGTCGGCGACGCACAG | 8098 | AQKREVVGDAQ | 12687 | KREVVGD | 0.219431 | -0.0561 |
| SyS1571 | 3510 | GCCCAAATCCAACCAGCAACCACGAAGCACAG | 8099 | AQIQPSNHEAQ | 12688 | IQPSNHE | 0.219421 | -0.16223 |
| GS912 | 3511 | GCCCAAATGAATCTGGGTAATGCGCCGGCACAG | 8100 | AQMNLGNAPAQ | 12689 | MNLGNAP | 0.219412 | -0.18278 |
| SyS1572 | 3512 | GCCCAACAGCCGAATAATACTAATAGTGCACAG | 8101 | AQQPNNTNSAQ | 12690 | QPNNTNS | 0.219392 | -0.15739 |
| GS914 | 3513 | GCCCAACTCCAAAGCATGGTCCAAGGCGCACAG | 8102 | AQLQSMVQGAQ | 12691 | LQSMVQG | 0.219195 | -0.14779 |
| SyS1573 | 3514 | GCCCAACATGGTAATACTACTTCGACTGCACAG | 8103 | AQHGNTTSTAQ | 12692 | HGNTTST | 0.219043 | -0.04692 |
| SyS1576 | 3515 | GCCCAAATCCAAAGCACCGTCACCCTGCACAG | 8104 | AQIQSTVTLAQ | 12693 | IQSTVTL | 0.218993 | -0.14672 |
| SyS1577 | 3516 | GCCCAAGACGACAGACAAGGCCCCAGAGCACAG | 8105 | AQDDRQGPRAQ | 12694 | DDRQGPR | 0.218992 | -0.13071 |
| SyS1578 | 3517 | GCCCAACAGACGGCTACGAATATTCTGGCACAG | 8106 | AQQTATNILAQ | 12695 | QTATNIL | 0.218912 | -0.22649 |
| GS915 | 3518 | GCCCAACGGCAGCATGCGGATACTGTTGCACAG | 8107 | AQRQHADTVAQ | 12696 | RQHADTV | 0.218828 | -0.10831 |
| GS916 | 3519 | GCCCAAACTAGGTCGGAGAGTTCTCTGGCACAG | 8108 | AQTRSESSLAQ | 12697 | TRSESSL | 0.218795 | -0.16718 |
| GS917 | 3520 | GCCCAACGTGGGCATGATGATCCGGCTGTGGCACAG | 8109 | AQRGHDPAVAQ | 12698 | RGHDPAV | 0.218795 | -0.16718 |
| SyS1579 | 3521 | GCCCAAAGCACCAGCCAAACGACCTCGCACAG | 8110 | AQSTSQTDLAQ | 12699 | STSQTDL | 0.218784 | -0.10958 |
| SyS1580 | 3522 | GCCCAAGTCAGCACCAGCGCCGTCCTCGCACAG | 8111 | AQVSTSAVLAQ | 12700 | VSTSAVL | 0.218614 | -0.10842 |
| SyS1581 | 3523 | GCCCAAAGCATGCCCCCGGAAAGATTCGCACAG | 8112 | AQSMPPERFAQ | 12701 | SMPPERF | 0.218531 | -0.14302 |
| SS104 | 3524 | GCCCAAGTCACCAGCGCGCCACCCGTCGCACAG | 8113 | AQVTSAHPVAQ | 12702 | VTSAHPV | 0.218414 | -0.35519 |
| SyS1582 | 3525 | GCCCAAACCAGCAGACAGTCGGCCTGCACAG | 8114 | AQTSRQVGLAQ | 12703 | TSRQVGL | 0.218414 | -0.08585 |
| SyS1583 | 3526 | GCCCAAACTCCGAAGTTTCTTATGAGGCACAG | 8115 | AQTPKFSYEAQ | 12704 | TPKFSYE | 0.218414 | -0.23133 |
| GS918 | 3527 | GCCCAAAACAGAATGGCCAGCACCATGGCACAG | 8116 | AQNRMASTMAQ | 12705 | NRMASTM | 0.218278 | -0.15766 |
| SyS1584 | 3528 | GCCCAACTCCTCGACAACACCAGACCCGCACAG | 8117 | AQLLDNTRPAQ | 12706 | LLDNTRP | 0.218247 | 0.036592 |
| GS919 | 3529 | GCCCAATTGACGACTATTCCTAGTACTGCACAG | 8118 | AQLTTIPSTAQ | 12707 | LTTIPST | 0.218243 | -0.16932 |

FIG. 33 (Continued)

| | | | | | | | |
|---|---|---|---|---|---|---|---|
| TS168 | 3530 | GCCCAAGCCAACAGAATCAGAGACAACGCACAG | 8119 | AQANRIRDNAQ | 12708 | ANRIRDN | 0.218215 | -0.03931 |
| SyS1585 | 3531 | GCCCAACCCAGAGACATCCAAAGAACCGCACAG | 8120 | AQPRDIQRTAQ | 12709 | PRDIQRT | 0.218142 | -0.00772 |
| GP149 | 3532 | GCCCAAATGCCTCATGGGCTTAAGAATGCACAG | 8121 | AQMPHGLKNAQ | 12710 | MPHGLKN | 0.218113 | -0.06725 |
| SyS1586 | 3533 | GCCCAACCTTTTACGCAGAATCATCTTGCACAG | 8122 | AQPFTQNHLAQ | 12711 | PFTQNHL | 0.218077 | -0.16344 |
| SyS1587 | 3534 | GCCCAAAATGCGAATGGTAATACTCGTGCACAG | 8123 | AQNANGNTRAQ | 12712 | NANGNTR | 0.218042 | -0.18163 |
| GS920 | 3535 | GCCCAACTGGCTTATTCTACGTCGGCGGCACAG | 8124 | AQLAYSTSAAQ | 12713 | LAYSTSA | 0.217974 | 0.000834 |
| GS921 | 3536 | GCCCAAACCGACAGATACAACATCAAAGCACAG | 8125 | AQTDRYNIKAQ | 12714 | TDRYNIK | 0.217916 | -0.16484 |
| GS922 | 3537 | GCCCAATATGTTACTAGTGCTGAGCATGCACAG | 8126 | AQYVTSAEHAQ | 12715 | YVTSAEH | 0.217839 | -0.1765 |
| GS923 | 3538 | GCCCAAAGTCATCAGCAGACTACGGTTGCACAG | 8127 | AQSHQQTTVAQ | 12716 | SHQQTTV | 0.217682 | -0.10921 |
| SyS1588 | 3539 | GCCCAACTTAATATGCAGACGAGGGGGCACAG | 8128 | AQLNMQTRGAQ | 12717 | LNMQTRG | 0.217651 | -0.01433 |
| GS925 | 3540 | GCCCAATACACCCCCAACTCAAAAGCGCACAG | 8129 | AQYTPQLKSAQ | 12718 | YTPQLKS | 0.217643 | -0.17958 |
| SyS1589 | 3541 | GCCCAACAGATTAATGGTCAGGTTATTGCACAG | 8130 | AQQINGQVIAQ | 12719 | QINGQVI | 0.217561 | -0.20466 |
| GS926 | 3542 | GCCCAAACGCGTGAGGGTGTGTTGCCTGCACAG | 8131 | AQTREGVLPAQ | 12720 | TREGVLP | 0.217502 | -0.13952 |
| SyS1591 | 3543 | GCCCAAGTTCATCAGTCGGTGCCGCTGGCACAG | 8132 | AQVHQSVPLAQ | 12721 | VHQSVPL | 0.217352 | -0.17314 |
| SyS1592 | 3544 | GCCCAACCGTATTCGATGGGGCATCCTGCACAG | 8133 | AQPYSMGHPAQ | 12722 | PYSMGHP | 0.217352 | -0.17314 |
| GS927 | 3545 | GCCCAAGGCACCAAAACCCACAGCCTCGCACAG | 8134 | AQGTKTHSLAQ | 12723 | GTKTHSL | 0.217339 | -0.14906 |
| SyS1595 | 3546 | GCCCAAACGCTGACTACGGGGTCGAAGGCACAG | 8135 | AQTLTTGSKAQ | 12724 | TLTTGSK | 0.217166 | -0.04194 |
| GS928 | 3547 | GCCCAATTTACGATTGGTGTTACGGGGGCACAG | 8136 | AQFTIGVTGAQ | 12725 | FTIGVTG | 0.21713 | -0.0827 |
| GS930 | 3548 | GCCCAACTCAGCAGCCACAACCACAACGCACAG | 8137 | AQLSSHNHNAQ | 12726 | LSSHNHN | 0.216901 | -0.13284 |
| SyS1596 | 3549 | GCCCAAACGGCAAAATGCCCCTCGAAGCACAG | 8138 | AQTGKMPLEAQ | 12727 | TGKMPLE | 0.216862 | -0.14056 |
| GS931 | 3550 | GCCCAAACTGCGAATCCTCATGCGACTGCACAG | 8139 | AQTANPHATAQ | 12728 | TANPHAT | 0.216859 | -0.04999 |
| SyS1597 | 3551 | GCCCAACACGACAGCGTCGCCAGCGCACAG | 8140 | AQHDSVASSAQ | 12729 | HDSVASS | 0.216844 | -0.154 |
| GS932 | 3552 | GCCCAAACGCGTGCGGATGTGTTGATGGCACAG | 8141 | AQTRADVLMAQ | 12730 | TRADVLM | 0.216806 | -0.13761 |
| GS933 | 3553 | GCCCAAGCTAATCATGCTTCTAATGCGGCACAG | 8142 | AQANHASNAAQ | 12731 | ANHASNA | 0.216449 | -0.09199 |
| SyS1599 | 3554 | GCCCAAAGCCACACATCGTCGGCGTCGAAGCACAG | 8143 | AQSHIVGVEAQ | 12732 | SHIVGVE | 0.216347 | 0.074638 |
| GS934 | 3555 | GCCCAATACACCGCCCAAAAAACCAGGCACAG | 8144 | AQYTAQKTSAQ | 12733 | YTAQKTS | 0.2162 | -0.16573 |
| SyS1600 | 3556 | GCCCAATTGCCTGCTGTGCAGAAGATGGCACAG | 8145 | AQLPAVQKMAQ | 12734 | LPAVQKM | 0.216175 | -0.12465 |
| SyS1601 | 3557 | GCCCAATCTGGTATTCAGACGGCTAAGGCACAG | 8146 | AQSGIQTAKAQ | 12735 | SGIQTAK | 0.215988 | -0.14283 |
| GS935 | 3558 | GCCCAAGATCCGGTGAAGATTGGTCATGCACAG | 8147 | AQDPVKIGHAQ | 12736 | DPVKIGH | 0.215963 | -0.16125 |
| GS936 | 3559 | GCCCAAAGTCAGACTATGAGTAAGAGTGCACAG | 8148 | AQSQTMSKSAQ | 12737 | SQTMSKS | 0.215809 | -0.07639 |
| SyS1602 | 3560 | GCCCAAAGCCTCACCCCACCAAACATCGCACAG | 8149 | AQSLTPTNIAQ | 12738 | SLTPTNI | 0.215809 | -0.0396 |
| GS937 | 3561 | GCCCAATATCTTAATAATACGAATTCTGCACAG | 8150 | AQYLNNTNSAQ | 12739 | YLNNTNS | 0.215545 | -0.18054 |

FIG. 33 (Continued)

| | | | | | | | |
|---|---|---|---|---|---|---|---|
| GS938 | 3562 | GCCCAAATGACCAGAATGAGCCAAAACGCACAG | AQMTRMSQNAQ | 12740 | MTRMSQN | 0.215545 | -0.18054 |
| GS939 | 3563 | GCCCAAGTCAACCAAAGCCTCAGCAGAGCACAG | AQVNQSLSRAQ | 12741 | VNQSLSR | 0.215514 | -0.03828 |
| GS940 | 3564 | GCCCAAGAACCGTCACCGAACAGAGAGCACAG | AQRTVTDNRAQ | 12742 | RTVTDNR | 0.21543 | -0.10655 |
| SyS1603 | 3565 | GCCCAAATTACTGGGGTGTTTGCTAATGCACAG | AQITGVFANAQ | 12743 | ITGVFAN | 0.215212 | -0.05959 |
| SyS1604 | 3566 | GCCCAATCGCTGGGCTGAGTAGGGTTGCACAG | AQSPGLSRVAQ | 12744 | SPGLSRV | 0.215048 | -0.09636 |
| GP151 | 3567 | GCCCAAGTGGTGAATCCTCAGACTAGGGCACAG | AQVVNPQTRAQ | 12745 | VVNPQTR | 0.214905 | -0.06586 |
| SyS1606 | 3568 | GCCCAATGGAGCCAAAGCCTCAGCGCCGCACAG | AQWSQSLSAAQ | 12746 | WSQSLSA | 0.214764 | -0.14405 |
| SyS1607 | 3569 | GCCCAACCCAGAGACGCCAGCAACGACGCACAG | AQPRDASNDAQ | 12747 | PRDASND | 0.214659 | -0.20224 |
| GS942 | 3570 | GCCCAATACACCAGCATGACGAATTCGCACAG | AQYTSMTEFAQ | 12748 | YTSMTEF | 0.214654 | -0.17112 |
| SS106 | 3571 | GCCCAAAACAACAGCCCCAGCCCAGAGCACAG | AQNNSPSPRAQ | 12749 | NNSPSPR | 0.214625 | -0.35665 |
| SyS1608 | 3572 | GCCCAAAAACAGCCTCAGCCACGGCGACGCACAG | AQNSLSHGDAQ | 12750 | NSLSHGD | 0.21457 | -0.10404 |
| SyS1609 | 3573 | GCCCAAAGAGTCGCCGGCGAAATGGCCGCACAG | AQRVAGEMAAQ | 12751 | RVAGEMA | 0.214459 | 0.040653 |
| GS943 | 3574 | GCCCAAGGTATTGGGTCTAGGGAGCTTGCACAG | AQGIGSRELAQ | 12752 | GIGSREL | 0.214321 | -0.1462 |
| SyS1610 | 3575 | GCCCAATATGTTAGTCGTATTCGTGATGCACAG | AQYVSRIRDAQ | 12753 | YVSRIRD | 0.214067 | -0.19375 |
| SyS1611 | 3576 | GCCCAATACCCCAGCCCAACGACAACGCACAG | AQYPSPNDNAQ | 12754 | YPSPNDN | 0.213993 | -0.16708 |
| SyS1612 | 3577 | GCCCAACTTCAGAGGACGGGCATAATGCACAG | AQLQRTAHNAQ | 12755 | LQRTAHN | 0.213963 | -0.15374 |
| SyS1613 | 3578 | GCCCAACTCGACAGCCTCAGCAGACACGCACAG | AQLDSLSRHAQ | 12756 | LDSLSRH | 0.213963 | -0.15374 |
| GS945 | 3579 | GCCCAAACCAAAATCAGCGCGGAGCGCACAG | AQTKISAGSAQ | 12757 | TKISAGS | 0.21391 | -0.10628 |
| SyS1614 | 3580 | GCCCAAAAAGACAACAGCCCCGTCGTCGCACAG | AQKDNSPVVAQ | 12758 | KDNSPVV | 0.213893 | -0.11374 |
| SyS1615 | 3581 | GCCCAAACCGGCCAAGGCAGCAGCCTCGCACAG | AQTGQGSSLAQ | 12759 | TGQGSSL | 0.213721 | -0.16397 |
| SyS1617 | 3582 | GCCCAAGATACGCATCTGAGTCGTCATGCACAG | AQDTHLSRHAQ | 12760 | DTHLSRH | 0.213534 | -0.21194 |
| SyS1618 | 3583 | GCCCAAGATATTGTTAGGAGGCAGGCTGCACAG | AQDIVRRQAAQ | 12761 | DIVRRQA | 0.213267 | -0.03009 |
| SyS1619 | 3584 | GCCCAAGCTATGAAGTATGCGCAGACTGCACAG | AQAMKYAQTAQ | 12762 | AMKYAQT | 0.213114 | -0.15011 |
| SyS1620 | 3585 | GCCCAAAGGCTGGCTGATCAGCATCCGGCACAG | AQRLADQHPAQ | 12763 | RLADQHP | 0.213086 | -0.20093 |
| SyS1621 | 3586 | GCCCAAGCTCCTGATAGTACTCGGATGGCACAG | AQAPDSTRMAQ | 12764 | APDSTRM | 0.213044 | 0.014524 |
| SyS1622 | 3587 | GCCCAAAGTCGGGTTTCTTCCTTCTTCGGCACAG | AQSRVSPSSAQ | 12765 | SRVSPSS | 0.213013 | 0.008275 |
| GS949 | 3588 | GCCCAAGTGCATGGTCAGGGTGAGCCTGCACAG | AQVHGQGEPAQ | 12766 | VHGQGEP | 0.212959 | -0.1765 |
| SyS1623 | 3589 | GCCCAAATGAGAGACAGCAGCAGCAGAGCACAG | AQMRDSSTRAQ | 12767 | MRDSSTR | 0.21283 | 0.073268 |
| GS951 | 3590 | GCCCAATGGCCCAACACCAACACCGCACAG | AQWPQHTNTAQ | 12768 | WPQHTNT | 0.212527 | -0.15855 |
| GS952 | 3591 | GCCCAAGTCGGCAGCTACCCGTCACCGCACAG | AQVGSYPVTAQ | 12769 | VGSYPVT | 0.21252 | 0.007456 |
| SyS1625 | 3592 | GCCCAAACTGCGACTCAGGGGCTAATGCACAG | AQTATQGANAQ | 12770 | TATQGAN | 0.212372 | -0.07076 |
| SyS1626 | 3593 | GCCCAAAAGAATAATAAGTATGGATAGTGCACAG | AQKNNSMDSAQ | 12771 | KNNSMDS | 0.212366 | -0.12084 |

FIG. 33 (Continued)

| | | | | | | | | |
|---|---|---|---|---|---|---|---|---|
| SyS1628 | 3594 | GCCCAACACACCAACGCCGTCAAAGAGAGCACAG | 8183 | AQHTNAVKEAQ | 12772 | HTNAVKE | 0.212319 | 0.211829 |
| GS953 | 3595 | GCCCAACTTCATTCGGTGACTACGCCGGCACAG | 8184 | AQLHSVTTPAQ | 12773 | LHSVTTP | 0.212166 | -0.0828 |
| SyS1629 | 3596 | GCCCAAGCCCGCGGCAACAAAACTTCGCACAG | 8185 | AQAPGQQNFAQ | 12774 | APGQQNF | 0.212026 | 0.059715 |
| GS955 | 3597 | GCCCAATCTTATACTAATCGTACTATGGCACAG | 8186 | AQSYTNRTMAQ | 12775 | SYTNRTM | 0.211833 | -0.0714 |
| SyS1632 | 3598 | GCCCAATCGGGTCAGAGTAATACGAAGGCACAG | 8187 | AQSGQSNTKAQ | 12776 | SGQSNTK | 0.211749 | -0.18984 |
| SyS1633 | 3599 | GCCCAAGACAGCTACAGAGCCCAAAGCGCACAG | 8188 | AQDSYRAQSAQ | 12777 | DSYRAQS | 0.211749 | -0.02105 |
| SyS1634 | 3600 | GCCCAAATGTATAAGCATAATTCTGATGCACAG | 8189 | AQMYKHNSDAQ | 12778 | MYKHNSD | 0.211732 | -0.06767 |
| GS957 | 3601 | GCCCAAAGCCTCGCCATGGTCAACCCCGCACAG | 8190 | AQSLAMVNPAQ | 12779 | SLAMVNP | 0.211678 | -0.17768 |
| SyS1635 | 3602 | GCCCAACCCTCACCAGCAAAAGCATGGCACAG | 8191 | AQPLTSKSMAQ | 12780 | PLTSKSM | 0.211599 | 0.023996 |
| GS958 | 3603 | GCCCAACTCGGCGCCCAACCCACCCCGCACAG | 8192 | AQLGAQPTPAQ | 12781 | LGAQPTP | 0.211205 | -0.15955 |
| GS959 | 3604 | GCCCAAGAAGGCAACCAAAAAACCCAAGCACAG | 8193 | AQEGNQKPQAQ | 12782 | EGNQKPQ | 0.211139 | -0.18637 |
| SyP56 | 3605 | GCCCAACAGGTTCGGCCGGGTGCTCATGCACAG | 8194 | AQQVRPGAHAQ | 12783 | QVRPGAH | 0.211056 | -0.04396 |
| GS962 | 3606 | GCCCAAAGCGGCAACATCACCGCCATGGCACAG | 8195 | AQSGNITAMAQ | 12784 | SGNITAM | 0.210967 | -0.16842 |
| SyS1637 | 3607 | GCCCAAAAACGACACAGCAAAATCGCCGAAGCACAG | 8196 | AQNDSKIAEAQ | 12785 | NDSKIAE | 0.210955 | -0.2305 |
| SyS1638 | 3608 | GCCCAAATCATGAAAAACGAACACAACGCACAG | 8197 | AQIMKNEHNAQ | 12786 | IMKNEHN | 0.210886 | -0.16102 |
| GS963 | 3609 | GCCCAACTTTGACGAATACTGATCGGGCACAG | 8198 | AQLLTNTDRAQ | 12787 | LLTNTDR | 0.210857 | -0.16432 |
| SyS1640 | 3610 | GCCCAAGATACGGCGCAGAGTCGTAATGCACAG | 8199 | AQDTAQSRNAQ | 12788 | DTAQSRN | 0.210588 | 0.341933 |
| SyS1641 | 3611 | GCCCAAATTGATCATGGTAAGACGAATGCACAG | 8200 | AQIDHGKTNAQ | 12789 | IDHGKTN | 0.210574 | -0.15253 |
| GS964 | 3612 | GCCCAAACCAGCCCAGAAGCCTCCTCGCACAG | 8201 | AQTSPRSLLAQ | 12790 | TSPRSLL | 0.210515 | -0.15764 |
| GS965 | 3613 | GCCCAATCGAATCCTCGGGATTCTAGTGCACAG | 8202 | AQSNPRDSSAQ | 12791 | SNPRDSS | 0.210308 | -0.12807 |
| SyS1643 | 3614 | GCCCAAATCATGCAAAGCATCCAAAACGCACAG | 8203 | AQIMQSIQNAQ | 12792 | IMQSIQN | 0.210287 | -0.14405 |
| GS966 | 3615 | GCCCAAAAAGTCAGCCCCAGCACCGCACAG | 8204 | AQKVSPSSTAQ | 12793 | KVSPSST | 0.210279 | -0.06417 |
| SyS1645 | 3616 | GCCCAAACCGGCCCCAGCCTCGCACAG | 8205 | AQTGPSPSLAQ | 12794 | TGPSPSL | 0.210228 | -0.17505 |
| SyS1646 | 3617 | GCCCAAGGCGGCGCCGCAGAGCCCAAGCCGCACAG | 8206 | AQGAARAQAAAQ | 12795 | GAARAQA | 0.210219 | 0.035379 |
| GS967 | 3618 | GCCCAAAAGTTTCAGTCTCCTGAGCCTGCACAG | 8207 | AQKFQSPEPAQ | 12796 | KFQSPEP | 0.210082 | -0.18009 |
| SyS1647 | 3619 | GCCCAAATGGCGACGAATTCGACGGAGGCACAG | 8208 | AQMATNSTEAQ | 12797 | MATNSTE | 0.210073 | -0.15738 |
| GS968 | 3620 | GCCCAAAACGTCCTCACCAACATCAGCGCACAG | 8209 | AQNVLTNISAQ | 12798 | NVLTNIS | 0.210069 | -0.17386 |
| SS112 | 3621 | GCCCAAAAGAATGGTATGAATTTGGTGGCACAG | 8210 | AQKNGMNLVAQ | 12799 | KNGMNLV | 0.210013 | -0.32377 |
| SyS1649 | 3622 | GCCCAAACTCTACGCAGCCTTCTAGTGCACAG | 8211 | AQTPTQPSSAQ | 12800 | TPTQPSS | 0.209867 | -0.19254 |
| SyS1650 | 3623 | GCCCAAACTAAGGAGCTTGTTATTCATGCACAG | 8212 | AQTKELVIHAQ | 12801 | TKELVIH | 0.209867 | -0.19254 |
| SyS1651 | 3624 | GCCCAAATCATGAACCAAAGCGTCCAAGCACAG | 8213 | AQIMNQSVQAQ | 12802 | IMNQSVQ | 0.209715 | -0.03979 |
| SyS1653 | 3625 | GCCCAAGTGTCTAATGCTAGGGATAAGGCACAG | 8214 | AQVSNARDKAQ | 12803 | VSNARDK | 0.209549 | -0.14041 |

FIG. 33 (Continued)

| | | | | | | | | |
|---|---|---|---|---|---|---|---|---|
| TS169 | 3626 | GCCCAAAGTAATCATACGCGGTCGTATGCACAG | 8215 | AQSNHTRSYAQ | 12804 | SNHTRSY | 0.20947 | -0.21368 |
| GS971 | 3627 | GCCCAACACCACGACAGACTCAACCCGCACAG | 8216 | AQHTDRLNPAQ | 12805 | HTDRLNP | 0.209344 | -0.14238 |
| SyS1654 | 3628 | GCCCAAGCGCCCCAGCATGAGCGACGGCACAG | 8217 | AQAAPSMSDAQ | 12806 | AAPSMSD | 0.209262 | -0.17557 |
| GS972 | 3629 | GCCCAATTTCGAATACGCATGCTTGGCACAG | 8218 | AQFSNTHALAQ | 12807 | FSNTHAL | 0.209156 | -0.17381 |
| SyS1655 | 3630 | GCCCAAGCTCATGATCTGCATCGTGTGGCACAG | 8219 | AQAHDLHRVAQ | 12808 | AHDLHRV | 0.209091 | -0.17998 |
| SyS1656 | 3631 | GCCCAACTTCAGGTTAATCATGTGGCGGCACAG | 8220 | AQLQVNHVAAQ | 12809 | LQVNHVA | 0.209057 | -0.14526 |
| SyS1657 | 3632 | GCCCAAAGCGGCCCCAACCTCAGCAGAGCACAG | 8221 | AQSGPNLSRAQ | 12810 | SGPNLSR | 0.209039 | 0.179343 |
| GS974 | 3633 | GCCCAAACTTATACGTGCGACGCCTGGTGCACAG | 8222 | AQTYTSTPGAQ | 12811 | TYTSTPG | 0.209033 | -0.13253 |
| GS975 | 3634 | GCCCAATATGGTACTCCTCCTTCGACGGCACAG | 8223 | AQYGTPPSTAQ | 12812 | YGTPPST | 0.209029 | -0.11621 |
| SyS1658 | 3635 | GCCCAATATGGTGTGAGTTCGGGTAGTGCACAG | 8224 | AQYGVSSGSAQ | 12813 | YGVSSGS | 0.209 | -0.07131 |
| SyS1659 | 3636 | GCCCAACCCACCAGAGACCTCATGAGCGCACAG | 8225 | AQPTRDLMSAQ | 12814 | PTRDLMS | 0.209 | -0.16708 |
| SyS1660 | 3637 | GCCCAAAAGATTGATGCGATGACGCAGGCACAG | 8226 | AQKIDAMTQAQ | 12815 | KIDAMTQ | 0.208964 | -0.12454 |
| GS976 | 3638 | GCCCAAAGAATCGGCACCAGCGAAGTCGCACAG | 8227 | AQRIGTSEVAQ | 12816 | RIGTSEV | 0.208937 | -0.10921 |
| GS977 | 3639 | GCCCAATTTGATCCTCCTTCAGTCGTCGGCACAG | 8228 | AQFDPLQSSAQ | 12817 | FDPLQSS | 0.208624 | -0.13472 |
| SyS1662 | 3640 | GCCCAACTCCTCCACCACGTCGAAGTCGCACAG | 8229 | AQLLHHVEVAQ | 12818 | LLHHVEV | 0.208542 | -0.15011 |
| GS978 | 3641 | GCCCAAGTCACCCTCGGCAACAGCGTCGCACAG | 8230 | AQVTLGNSVAQ | 12819 | VTLGNSV | 0.208389 | -0.14524 |
| SyS1663 | 3642 | GCCCAACTCCTCAACGACAGAAGCGTCGCACAG | 8231 | AQLLNDRSVAQ | 12820 | LLNDRSV | 0.208296 | -0.09749 |
| GS979 | 3643 | GCCCAATTCGTCGACAGAGAGACCCCAAGCACAG | 8232 | AQFVDRRPQAQ | 12821 | FVDRRPQ | 0.207955 | -0.00471 |
| SyS1664 | 3644 | GCCCAAACGAATGTGACTACGACGACGGCACAG | 8233 | AQTNVTTTTAQ | 12822 | TNVTTTT | 0.207819 | -0.05555 |
| SyS1665 | 3645 | GCCCAAGACGAAACCAACAACAAAGATGGGCACAG | 8234 | AQDETNKRWAQ | 12823 | DETNKRW | 0.207819 | -0.20709 |
| SyS1666 | 3646 | GCCCAAACGTCGACGTCTGCTATTCGGGCACAG | 8235 | AQTSTSAIRAQ | 12824 | TSTSAIR | 0.207608 | -0.1626 |
| SyS1668 | 3647 | GCCCAAGGCACCAGAGAGTCCAAGGCGCACAG | 8236 | AQGTSRVQGAQ | 12825 | GTSRVQG | 0.207468 | 0.069325 |
| SyS1669 | 3648 | GCCCAACTCAACACCATGGCCCTCCCGCACAG | 8237 | AQLNTMALPAQ | 12826 | LNTMALP | 0.207441 | -0.15981 |
| SyS1671 | 3649 | GCCCAAAGTACTCATGCGACTGATAGGGCACAG | 8238 | AQSTHATDRAQ | 12827 | STHATDR | 0.207437 | 0.052678 |
| SyS1672 | 3650 | GCCCAACACCACGGCGTCACCAGCGGCGCACAG | 8239 | AQHHGVTSGAQ | 12828 | HHGVTSG | 0.207346 | -0.13809 |
| SyS1674 | 3651 | GCCCAAGGCCTCATGGCCAACAACCCGCACAG | 8240 | AQGLMANNPAQ | 12829 | GLMANNP | 0.207257 | -0.19723 |
| SyS1675 | 3652 | GCCCAAGGGTCTTCGTCTAATTCGTTTGCACAG | 8241 | AQGSSSNSFAQ | 12830 | GSSSNSF | 0.207096 | -0.03155 |
| GS985 | 3653 | GCCCAAAGAGAAAAAATGACCCTCCTCGCACAG | 8242 | AQREKMTLLAQ | 12831 | REKMTLL | 0.207031 | -0.18368 |
| SyS1676 | 3654 | GCCCAAAGCCCCGTCAGCAGCGACAGCGCACAG | 8243 | AQSPVSSDSAQ | 12832 | SPVSSDS | 0.206943 | -0.18954 |
| SyS1679 | 3655 | GCCCAAGACGTCGCCCACAAAGACAGAGCACAG | 8244 | AQDVAHKDRAQ | 12833 | DVAHKDR | 0.206739 | -0.10729 |
| SyS1680 | 3656 | GCCCAAAGTATGGTTTCTAATATTGCGGCACAG | 8245 | AQSMVSNIAAQ | 12834 | SMVSNIA | 0.206728 | -0.08096 |
| GS986 | 3657 | GCCCAAAATGATGCATAATATGCAGTCTGCACAG | 8246 | AQMMHNMMQSAQ | 12835 | MMHNMQS | 0.20664 | -0.13284 |

FIG. 33 (Continued)

| | | | | | | | | |
|---|---|---|---|---|---|---|---|---|
| GS987 | 3658 | GCCCAAGTGTGTGAATTCTTCTCGGATGGCACAG | 8247 | AQVSNSSRMAQ | 12836 | VSNSSRM | 0.206658 | -0.16842 |
| GS988 | 3659 | GCCCAATATACGGCTACTAAGGCGAGTGCACAG | 8248 | AQYTATKASAQ | 12837 | YTATKAS | 0.206493 | -0.1442 |
| GS989 | 3660 | GCCCAAAGCACCAGCGGCGGCGTCAGAGCACAG | 8249 | AQSTSGGVRAQ | 12838 | STSGGVR | 0.206367 | -0.11215 |
| SyS1681 | 3661 | GCCCAATTTACTAGGGCTGAGCCTGCGGCACAG | 8250 | AQFTRAEPAAQ | 12839 | FTRAEPA | 0.206339 | -0.13071 |
| SyS1682 | 3662 | GCCCAACCTATTACGAGGGGTACTATTGCACAG | 8251 | AQPITRGTIAQ | 12840 | PITRGTI | 0.206234 | -0.16951 |
| SyS1683 | 3663 | GCCCAATACCACAACAGCATGCTCGGCGCACAG | 8252 | AQYHNSMLGAQ | 12841 | YHNSMLG | 0.206136 | -0.11374 |
| GP153 | 3664 | GCCCAAAGTAATAGTCGGGTAATGCTGCACAG | 8253 | AQSNSPGNAAQ | 12842 | SNSPGNA | 0.205916 | -0.06579 |
| GS990 | 3665 | GCCCAACAAAAAGGCGTCCAACTCCCCGCACAG | 8254 | AQQKGVQLPAQ | 12843 | QKGVQLP | 0.205912 | -0.01992 |
| GS991 | 3666 | GCCCAACGTAGTGAGACTAATAATACTGCACAG | 8255 | AQRSETNNTAQ | 12844 | RSETNNT | 0.205906 | -0.18637 |
| SyS1685 | 3667 | GCCCAAGTGGATCAGATGCTGGCTCCTGCACAG | 8256 | AQVDQMLAPAQ | 12845 | VDQMLAP | 0.205805 | -0.19133 |
| GS992 | 3668 | GCCCAACAACAAACCAGACACCAGCATGGCACAG | 8257 | AQQTRHTSMAQ | 12846 | QTRHTSM | 0.205758 | -0.12266 |
| SyS1686 | 3669 | GCCCAAATGCACGCCGACAGAGCCCTGCACAG | 8258 | AQMHADRALAQ | 12847 | MHADRAL | 0.205735 | -0.12963 |
| GS994 | 3670 | GCCCAATGCGACTACGCATGCTCCTAAGGCACAG | 8259 | AQSTTHAPKAQ | 12848 | STTHAPK | 0.205535 | -0.12148 |
| SyS1687 | 3671 | GCCCAATCTAATCAGACTATTATGACGGCACAG | 8260 | AQSNQTIMTAQ | 12849 | SNQTIMT | 0.205491 | -0.16587 |
| GS995 | 3672 | GCCCAAGTTTCTTCGCCTTCTGGTCTGGCACAG | 8261 | AQVSSPSGLAQ | 12850 | VSSPSGL | 0.205479 | -0.14665 |
| SyS1689 | 3673 | GCCCAAAAAGAGGGCGAAGAAATGGTCGCACAG | 8262 | AQKRGEEMVAQ | 12851 | KRGEEMV | 0.205315 | -0.19477 |
| SyS1690 | 3674 | GCCCAACAGGATAGTGGGAATAGTTATGCACAG | 8263 | AQQDSGNSYAQ | 12852 | QDSGNSY | 0.205249 | -0.21315 |
| SyS1691 | 3675 | GCCCAAAGCCACGCCACCACCGGCGGCCACAG | 8264 | AQSHATTGGAQ | 12853 | SHATTGG | 0.205059 | -0.19618 |
| SyS1693 | 3676 | GCCCAAAAGTCGAGTGAGACGTCTCATGCACAG | 8265 | AQKLSETSHAQ | 12854 | KLSETSH | 0.205006 | -0.21448 |
| SyS1694 | 3677 | GCCCAACTTAATTATAAGGAGGGCGCCGGCACAG | 8266 | AQLNYKEAPAQ | 12855 | LNYKEAP | 0.204978 | -0.18769 |
| SyS1695 | 3678 | GCCCAAAGCGTCGACAGCGTCAGACTCGCACAG | 8267 | AQSVDSVRLAQ | 12856 | SVDSVRL | 0.20496 | -0.08842 |
| SyS1697 | 3679 | GCCCAACAACCAAGTCATCCAAACGCACAG | 8268 | AQQPNVIQTAQ | 12857 | QPNVIQT | 0.204872 | 0.059518 |
| GS996 | 3680 | GCCCAACGTATGACTAATTTGCAGACTGCACAG | 8269 | AQRMTNLQTAQ | 12858 | RMTNLQT | 0.20474 | -0.17863 |
| SyS1698 | 3681 | GCCCAAGCCACCCCGGCGGCAGCGGGCACAG | 8270 | AQATPGGSGAQ | 12859 | ATPGGSG | 0.204721 | -0.15374 |
| SyS1699 | 3682 | GCCCAAGACGTCAACAGCATGAGCAGCACAG | 8271 | AQDVNSMSSAQ | 12860 | DVNSMSS | 0.204599 | -0.23419 |
| SyS1700 | 3683 | GCCCAATTGCCTCGTAGTCATCTTGATGCACAG | 8272 | AQLPRSHLDAQ | 12861 | LPRSHLD | 0.204525 | -0.13316 |
| SyS1701 | 3684 | GCCCAACCCGCCCCCAGATACGACAAAGCACAG | 8273 | AQPAPRYDKAQ | 12862 | PAPRYDK | 0.204501 | -0.09014 |
| SyS1703 | 3685 | GCCCAAAGAAACTACAGCGACAAAGACGCACAG | 8274 | AQRNYSDKDAQ | 12863 | RNYSDKD | 0.204317 | 0.088722 |
| SyS1704 | 3686 | GCCCAAAGTGAGAATCTTTGAGTCGTGCACAG | 8275 | AQSENLLSRAQ | 12864 | SENLLSR | 0.204317 | -0.20951 |
| GS997 | 3687 | GCCCAAAGTAGTCTTAATATGAAGGATGCACAG | 8276 | AQSSLNMKDAQ | 12865 | SSLNMKD | 0.204292 | -0.11279 |
| GS998 | 3688 | GCCCAAAGCGACAAAGAATACGGCAGAGCACAG | 8277 | AQSDKEYGRAQ | 12866 | SDKEYGR | 0.204204 | -0.15001 |
| GS999 | 3689 | GCCCAATACGTCAGCCAAAGCGGCATGGCACAG | 8278 | AQYVSQSGMAQ | 12867 | YVSQSGM | 0.204064 | -0.17672 |

FIG. 33 (Continued)

| | | | | | | | | |
|---|---|---|---|---|---|---|---|---|
| GS1000 | 3690 | GCCCAAAACGTCGTCAGCGTCAGACAAGCACAG | 8279 | AQNVVSVRQAQ | 12868 | NVVSVRQ | 0.204038 | -0.16753 |
| SyS1705 | 3691 | GCCCAAACGGGTAAGGAGGGTCGGACTGCACAG | 8280 | AQTGKEGRTAQ | 12869 | TGKEGRT | 0.203988 | -0.05387 |
| GS1001 | 3692 | GCCCAATTTAAGAATACTGTGGCGACTGCACAG | 8281 | AQFKNTVATAQ | 12870 | FKNTVAT | 0.203984 | -0.13702 |
| SyS1706 | 3693 | GCCCAAGGCAGCAGAGAACCCAGCAGCGCACAG | 8282 | AQGSREPSSAQ | 12871 | GSREPSS | 0.203966 | -0.2268 |
| SyS1707 | 3694 | GCCCAAAGAGAAAAAGTCAGCACCCCGCACAG | 8283 | AQREKVSTPAQ | 12872 | REKVSTP | 0.20368 | 0.088388 |
| GP154 | 3695 | GCCCAACAGGAGCCTGCTAGGCATAATGCACAG | 8284 | AQQEPARHNAQ | 12873 | QEPARHN | 0.203631 | -0.07336 |
| GS1002 | 3696 | GCCCAAACTAGTCATTCGAATGGTCGTGCACAG | 8285 | AQTSHSNGRAQ | 12874 | TSHSNGR | 0.203484 | -0.09149 |
| SyS1708 | 3697 | GCCCAAGGACCTCAGCAGCCCCAAAATGGCACAG | 8286 | AQDLSSPKMAQ | 12875 | DLSSPKM | 0.203432 | -0.06161 |
| SyS1709 | 3698 | GCCCAACTGCCACCACCCCAAACCCGCACAG | 8287 | AQLATTPKPAQ | 12876 | LATTPKP | 0.203432 | -0.11253 |
| SyS1710 | 3699 | GCCCAAAGGCGCCCAACGTCAGCCTGCACAG | 8288 | AQSGPNVSLAQ | 12877 | SGPNVSL | 0.203432 | -0.16344 |
| SyS1711 | 3700 | GCCCAACCCGTCTACAACGCAGCCCGCACAG | 8289 | AQPVYNASPAQ | 12878 | PVYNASP | 0.203401 | -0.21941 |
| SyS1712 | 3701 | GCCCAAAATTCTACTACTTGGTGATGGCACAG | 8290 | AQNSTTLVMAQ | 12879 | NSTTLVM | 0.203291 | -0.10908 |
| SyS1713 | 3702 | GCCCAAAGAAACGCCGTCGTCAGCATGGCACAG | 8291 | AQRNAVVSMAQ | 12880 | RNAVVSM | 0.203173 | -0.1307 |
| SP38 | 3703 | GCCCAAAAGGATCTTCTGGCTAAGCTTGCACAG | 8292 | AQKDILAKLAQ | 12881 | KDILAKL | 0.203052 | -0.0513 |
| SyS1715 | 3704 | GCCCAACCCCACGAAGGCAGCAGCAGAGCACAG | 8293 | AQPHEGSSRAQ | 12882 | PHEGSSR | 0.202954 | -0.08343 |
| SyS1716 | 3705 | GCCCAACGGGATACGGTTTCGCGTTATGCACAG | 8294 | AQRDTVSRYAQ | 12883 | RDTVSRY | 0.20293 | -0.15411 |
| SyS1717 | 3706 | GCCCAAGGCCAAGCCGCGCCAAGGCCACGCACAG | 8295 | AQGQAAQGHAQ | 12884 | GQAAQGH | 0.202823 | -0.14283 |
| SyS1718 | 3707 | GCCCAAGGGCTGAGACTGCTCATGTGGCACAG | 8296 | AQRAETAHVAQ | 12885 | RAETAHV | 0.202798 | -0.15132 |
| SyS1720 | 3708 | GCCCAAGAAAACAGAACCGTCCCACCGCACAG | 8297 | AQENRTVPTAQ | 12886 | ENRTVPT | 0.202755 | 0.23929 |
| GS1004 | 3709 | GCCCAAAGTAGTAATGATGCGAGGGTGGCACAG | 8298 | AQSSNDARVAQ | 12887 | SSNDARV | 0.202721 | -0.1747 |
| SyS1721 | 3710 | GCCCAACCCGGCCAAGTCGACAGAAGAGCACAG | 8299 | AQPGQVDRRAQ | 12888 | PGQVDRR | 0.202674 | -0.18527 |
| SyS1723 | 3711 | GCCCAAGGCCCGGCGCCAACACCGCACAG | 8300 | AQGPGANTTAQ | 12889 | GPGANTT | 0.202623 | -0.17752 |
| SyS1724 | 3712 | GCCCAAATGCCGAAAACCTCAAAGAAGCACAG | 8301 | AQMPENLKEAQ | 12890 | MPENLKE | 0.202544 | -0.21072 |
| GS1005 | 3713 | GCCCAAACGAATGCGGTGGCTTCTAATGCACAG | 8302 | AQTNAVASNAQ | 12891 | TNAVASN | 0.202544 | -0.12235 |
| GS1006 | 3714 | GCCCAATACGGCAAAATGCGAACTCTACGCACAG | 8303 | AQYGKIELYAQ | 12892 | YGKIELY | 0.202395 | -0.17919 |
| SyS1725 | 3715 | GCCCAAAAATCGAATGGTACGGGTTTTGCACAG | 8304 | AQNPNGTGFAQ | 12893 | NPNGTGF | 0.202346 | -0.1784 |
| GS1007 | 3716 | GCCCAATCTCGGAATACTATGGGTTCGGCACAG | 8305 | AQSRNTMGSAQ | 12894 | SRNTMGS | 0.202244 | -0.11377 |
| GS1008 | 3717 | GCCCAACCGAGTCATGGATTACGGCTGCACAG | 8306 | AQPSHGITAAQ | 12895 | PSHGITA | 0.202231 | -0.10748 |
| SyS1726 | 3718 | GCCCAATTGGAGACGCTGAGGGGGCCTGCACAG | 8307 | AQLETLRGPAQ | 12896 | LETLRGP | 0.202095 | -0.0594 |
| SyS1727 | 3719 | GCCCAAGATCGTTCTCCTGATATTAGGGCACAG | 8308 | AQDRSPDIRAQ | 12897 | DRSPDIR | 0.202025 | -0.19723 |
| SyS1728 | 3720 | GCCCAAAAGGATTTGGCGTCTGCGAAGGCACAG | 8309 | AQKDLASAKAQ | 12898 | KDLASAK | 0.201927 | -0.22803 |
| SyS1729 | 3721 | GCCCAAATCACCAGCCACGGCAACAGCGCACAG | 8310 | AQITSHGNSAQ | 12899 | ITSHGNS | 0.201888 | 0.12116 |

FIG. 33 (Continued)

| ID | Num | DNA Sequence | Num | Protein | Num | Peptide | Value 1 | Value 2 |
|---|---|---|---|---|---|---|---|---|
| GS1009 | 3722 | GCCCAACATTCTAAGATGCCTTCTACGGCACAG | 8311 | AQHSKMPSTAQ | 12900 | HSKMPST | 0.201887 | -0.16214 |
| GS1010 | 3723 | GCCCAAATTGCGACTTTTACGACGGCGGCACAG | 8312 | AQIATFTTAAQ | 12901 | IATFTTA | 0.201795 | -0.08442 |
| SyS1730 | 3724 | GCCCAAGCGGCGTCTGGGTATCTTAATGCACAG | 8313 | AQAASGYLNAQ | 12902 | AASGYLN | 0.201793 | -0.1986 |
| SyS1731 | 3725 | GCCCAAGATAGTGTTAGGCCGGCTATTGCACAG | 8314 | AQDSVRPAIAQ | 12903 | DSVRPAI | 0.201702 | -0.20709 |
| SyS1732 | 3726 | GCCCAAAGACTCAGCGAAGAAATGAGAGCACAG | 8315 | AQRLSEEMRAQ | 12904 | RLSEEMR | 0.201693 | -0.22434 |
| SyS1733 | 3727 | GCCCAACTCCCATCAGCGCCACCGAAGCACAG | 8316 | AQLPISATEAQ | 12905 | LPISATE | 0.201693 | -0.22434 |
| SyS1734 | 3728 | GCCCAATCTAATGTGGCGGCTCAGATGGCACAG | 8317 | AQSNVAAQMAQ | 12906 | SNVAAQM | 0.2016 | -0.21557 |
| SyS1735 | 3729 | GCCCAATATCAGTCGCTGATTTCTGAGGCACAG | 8318 | AQYQSLISEAQ | 12907 | YQSLISE | 0.2016 | -0.21557 |
| SyS1737 | 3730 | GCCCAATATCAGAGTGGGTATGATAAGGCACAG | 8319 | AQYQSGYDKAQ | 12908 | YQSGYDK | 0.201403 | -0.07145 |
| SyS1738 | 3731 | GCCCAACTCAGAACCGGCGAACTCACCGCACAG | 8320 | AQLRTGELTAQ | 12909 | LRTGELT | 0.201143 | -0.02579 |
| SyS1739 | 3732 | GCCCAACCGGCGACGAATAATATGCGGGCACAG | 8321 | AQPATNNMRAQ | 12910 | PATNNMR | 0.201063 | -0.21325 |
| SyS1740 | 3733 | GCCCAAGTCAGCAGCAGCAAATTCAGCGCACAG | 8322 | AQVSSSKFSAQ | 12911 | VSSSKFS | 0.201033 | -0.08585 |
| SyS1741 | 3734 | GCCCAAACTACGCTGCTTGATAAGGCTGCACAG | 8323 | AQTTLLDKAAQ | 12912 | TTLLDKA | 0.201033 | -0.19496 |
| SyS1742 | 3735 | GCCCAAAGCCCGCCCTCCACCCAGCGACACAG | 8324 | AQSPALHPSAQ | 12913 | SPALHPS | 0.201033 | -0.19496 |
| SyS1743 | 3736 | GCCCAATTCAACCACCACAGAACCGACGCACAG | 8325 | AQFNHNRTDAQ | 12914 | FNHNRTD | 0.200936 | -0.13686 |
| GS1013 | 3737 | GCCCAAGCCGAAAAAACCGCCAACGGCGCACAG | 8326 | AQAEKTANGAQ | 12915 | AEKTANG | 0.200841 | -0.1756 |
| GS1014 | 3738 | GCCCAAAATCTGCGTGTGACGGCTTCGGCACAG | 8327 | AQNLRVTASAQ | 12916 | NLRVTAS | 0.200801 | -0.08207 |
| GS1015 | 3739 | GCCCAAATGAAGGATGGGTCGCGGATTGCACAG | 8328 | AQMKDGSRIAQ | 12917 | MKDGSRI | 0.200699 | -0.14334 |
| SyS1744 | 3740 | GCCCAAAGAATCGGCGCCAACGCACCGCACAG | 8329 | AQRIGANATAQ | 12918 | RIGANAT | 0.200534 | 0.065728 |
| GS1018 | 3741 | GCCCAAGCCAACCTCACCCCAACAGAGCACAG | 8330 | AQANLTPNRAQ | 12919 | ANLTPNR | 0.20043 | -0.18009 |
| SyP58 | 3742 | GCCCAATCGGTGTCTGTGATAAGAGTCATGCACAG | 8331 | AQSVSDKSHAQ | 12920 | SVSDKSH | 0.200325 | -0.03907 |
| SyS1745 | 3743 | GCCCAATACAGCACCCTCCACCGCCGCACAG | 8332 | AQYSTLHTAAQ | 12921 | YSTLHTA | 0.200268 | 0.146915 |
| SyS1747 | 3744 | GCCCAAACGAAGTTTGGTGGTATTCAGGCACAG | 8333 | AQTKFGGIQAQ | 12922 | TKFGGIQ | 0.200153 | 0.040003 |
| GS1019 | 3745 | GCCCAAGACATCCCCAAAGGCAGCAGCGCACAG | 8334 | AQDIPKGSSAQ | 12923 | DIPKGSS | 0.200135 | -0.13523 |
| SyS1748 | 3746 | GCCCAAATCTCCCCAGCAGCAGCCAAGCACAG | 8335 | AQILPSSSQAQ | 12924 | ILPSSSQ | 0.200107 | 0.034167 |
| GS1020 | 3747 | GCCCAAGTCAGCCAAACCACCAGCAGCGCACAG | 8336 | AQVSQTTSSAQ | 12925 | VSQTTSS | 0.200008 | -0.11818 |
| SyS1750 | 3748 | GCCCAAACGATTCATCTGCATAAGGATGCACAG | 8337 | AQTIHLHKDAQ | 12926 | TIHLHKD | 0.199958 | -0.13314 |
| SyS1754 | 3749 | GCCCAAGTCACCGACAGAGTCGGCAACGGCACAG | 8338 | AQVTDRVGNAQ | 12927 | VTDRVGN | 0.199795 | -0.1792 |
| SyP59 | 3750 | GCCCAACTGCCTGCTCGCGGCTGTAATGCACAG | 8339 | AQLPARAANAQ | 12928 | LPARAAN | 0.199763 | -0.04316 |
| SyS1755 | 3751 | GCCCAACAACACCCAAAGCATGACCGTCGCACAG | 8340 | AQHTQSMTVAQ | 12929 | HTQSMTV | 0.199748 | 0.113433 |
| SyS1756 | 3752 | GCCCAACTCCTCAACAGCAGCCAACTCGCACAG | 8341 | AQLLNSSQLAQ | 12930 | LLNSSQL | 0.199713 | -0.01322 |
| SyS1757 | 3753 | GCCCAAAGAAACAGCGAACTCAGAGCCGCACAG | 8342 | AQRNSELRAAQ | 12931 | RNSELRA | 0.199623 | -0.1344 |

FIG. 33 (Continued)

| | | | | | | | | |
|---|---|---|---|---|---|---|---|---|
| SyS1758 | 3754 | GCCCAACAGAAGTCTCCGAATGGTCTGGCACAG | 8343 | AQQKSPNGLAQ | 12932 | QKSPNGL | 0.199418 | -0.01019 |
| SyS1759 | 3755 | GCCCAAAAAGCGGCGACCACCTCACCGCACAG | 8344 | AQKSGDHLTAQ | 12933 | KSGDHLT | 0.199256 | -0.10889 |
| TS171 | 3756 | GCCCAAGGGAATCGGACTACGAGTAGTGCACAG | 8345 | AQGNRTTSSAQ | 12934 | GNRTTSS | 0.199229 | -0.1942 |
| SyS1760 | 3757 | GCCCAAATGGTCGCCCTCACCGTCGGCGCACAG | 8346 | AQMVALTVGAQ | 12935 | MVALTVG | 0.19916 | -0.17557 |
| SyS1761 | 3758 | GCCCAACTCAGCAGCAACAGCCCCAGAGCACAG | 8347 | AQLSSNSPRAQ | 12936 | LSSNSPR | 0.199055 | 0.023543 |
| SyS1762 | 3759 | GCCCAAGCTTCGAATAATCAGACGTATGCACAG | 8348 | AQASNNQTYAQ | 12937 | ASNNQTY | 0.199003 | -0.05924 |
| GS1025 | 3760 | GCCCAAAAACAACATCGTCACCAGCGCACAG | 8349 | AQNNIVTTSAQ | 12938 | NNIVTTS | 0.19875 | -0.15317 |
| GS1026 | 3761 | GCCCAACACGACACCAAAAAACCCATGGCACAG | 8350 | AQHDTKKPMAQ | 12939 | HDTKKPM | 0.198636 | -0.1338 |
| SyS1765 | 3762 | GCCCAAATTAATACGGCTAGTTATAAGGCACAG | 8351 | AQINTASYKAQ | 12940 | INTASYK | 0.198495 | -0.10647 |
| SyS1766 | 3763 | GCCCAAAGTGGTATGGTTAGTATGTCGGCACAG | 8352 | AQSGMVSMSAQ | 12941 | SGMVSMS | 0.19837 | -0.10161 |
| SyS1768 | 3764 | GCCCAACTCGTCACCGCCAGCGCCAGAGCACAG | 8353 | AQLVTASARAQ | 12942 | LVTASAR | 0.198271 | -0.12079 |
| GS1028 | 3765 | GCCCAAAGCAGAGCCCCAGCGCCATGGCACAG | 8354 | AQSRAPSAMAQ | 12943 | SRAPSAM | 0.198243 | -0.1747 |
| SyS1769 | 3766 | GCCCAAAACAACAACAACCAAAAAGTCTACGCACAG | 8355 | AQNNNQKVYAQ | 12944 | NNNQKVY | 0.197983 | -0.11345 |
| SyS1770 | 3767 | GCCCAAACTAGTGTGGTTGCTAATCCTGCACAG | 8356 | AQTSVVANPAQ | 12945 | TSVVANP | 0.197975 | -0.02461 |
| SyS1771 | 3768 | GCCCAAGGCAACGCCGGCCCCAGCCTCGCACAG | 8357 | AQGNAGPSLAQ | 12946 | GNAGPSL | 0.197961 | -0.17382 |
| SyS1772 | 3769 | GCCCAATACAGCACCAGCTCGAACTCGCACAG | 8358 | AQYSTSLELAQ | 12947 | YSTSLEL | 0.197917 | -0.23419 |
| SyS1773 | 3770 | GCCCAACCGTCTAATCCGCCTAAGGAGGCACAG | 8359 | AQPSNPPKEAQ | 12948 | PSNPPKE | 0.197834 | -0.10324 |
| SyS1774 | 3771 | GCCCAAACTAATTCTAAGCCTTCGTGGGCACAG | 8360 | AQTNSKPSWAQ | 12949 | TNSKPSW | 0.197791 | -0.2305 |
| SyS1775 | 3772 | GCCCAATCGATTGATCGGCAGCAGCTTGCACAG | 8361 | AQSIDRQQLAQ | 12950 | SIDRQQL | 0.19771 | -0.16273 |
| GS1030 | 3773 | GCCCAAAACAAAGCGGCCCGCCAGCGCACAG | 8362 | AQNKAGPASAQ | 12951 | NKAGPAS | 0.197681 | -0.08173 |
| GS1031 | 3774 | GCCCAAAGCATGACCAACAGAGAGCGCACAG | 8363 | AQSMTTNRSAQ | 12952 | SMTTNRS | 0.197629 | -0.14958 |
| SyS1776 | 3775 | GCCCAAGGCAACAGCGCCGTCAACTCGCACAG | 8364 | AQGNSAVQLAQ | 12953 | GNSAVQL | 0.197614 | -0.09127 |
| GS1032 | 3776 | GCCCAAAGAAGCAGCGACGTCAACACCGCACAG | 8365 | AQRSSDVNTAQ | 12954 | RSSDVNT | 0.197531 | -0.12807 |
| SyS1777 | 3777 | GCCCAACACACAACGGCGTCCAAAGCGTCGCACAG | 8366 | AQHNGVQSVAQ | 12955 | HNGVQSV | 0.197468 | 0.173685 |
| SyS1778 | 3778 | GCCCAAGAAAAAGACCACGGCATGGCCGCACAG | 8367 | AQEKDHGMAAQ | 12956 | EKDHGMA | 0.197362 | -0.12344 |
| SyS1779 | 3779 | GCCCAATACAGACTCCCGACGGGCAGAGCACAG | 8368 | AQYRLPDGRAQ | 12957 | YRLPDGR | 0.197255 | -0.21202 |
| SyS1780 | 3780 | GCCCAAAGCAGCAGAGAACTCAGACTCGCACAG | 8369 | AQSSRELRLAQ | 12958 | SSRELRL | 0.197138 | -0.13192 |
| SyS1782 | 3781 | GCCCAAAACCAAGTCGAAAGCAGAGTCGCACAG | 8370 | AQNQVESRVAQ | 12959 | NQVESRV | 0.196941 | -0.11838 |
| SyS1783 | 3782 | GCCCAAGCCCTCCACAGCGTCCCCAAAGCACAG | 8371 | AQALHSVPKAQ | 12960 | ALHSVPK | 0.196939 | -0.11574 |
| SyS1784 | 3783 | GCCCAAACTGGTCCTAGTACGGTGCCGGCACAG | 8372 | AQTGPSTVPAQ | 12961 | TGPSTVP | 0.196935 | -0.09919 |
| SyS1785 | 3784 | GCCCAAGAGAACCCCTCGGCGTCCACCCCGCACAG | 8373 | AQEPLGVHPAQ | 12962 | EPLGVHP | 0.196915 | -0.19723 |
| GS1036 | 3785 | GCCCAAAACCAGAACCGACACCACCAACGCACAG | 8374 | AQTRTDTTNAQ | 12963 | TRTDTTN | 0.196745 | -0.08049 |

FIG. 33 (Continued)

| | | | | | | | |
|---|---|---|---|---|---|---|---|
| GS1037 | 3786 | GCCCAAAGGCCACAACCTCACCGCCGACGCACAG | 8375 | AQSHNLTADAQ | 12964 | SHNLTAD | 0.196727 | -0.15855 |
| SyS1787 | 3787 | GCCCAAAACGTCAGAAGAGAGACGACACCGCACAG | 8376 | AQNVRRDDTAQ | 12965 | NVRRDDT | 0.196487 | -0.11616 |
| SyS1788 | 3788 | GCCCAATTCGCCGCCAACCTCGTCGCCGCACAG | 8377 | AQFAANLVAAQ | 12966 | FAANLVA | 0.196427 | -0.13677 |
| SyS1790 | 3789 | GCCCAAATCGGCGCGCCAAGCCAGAATGGCACAG | 8378 | AQIGAQARMAQ | 12967 | IGAQARM | 0.19619 | -0.15288 |
| SyS1791 | 3790 | GCCCAAAATTCTATGTCTAAGGCTTATGCACAG | 8379 | AQNSMSKAYAQ | 12968 | NSMSKAY | 0.196153 | -0.1986 |
| GS1039 | 3791 | GCCCAAAACGTCAACAAAGACAGAGTCGCACAG | 8380 | AQNVNKDRVAQ | 12969 | NVNKDRV | 0.196068 | -0.1442 |
| GS1040 | 3792 | GCCCAATCTTTCAGGGTTCGGCTAGGGCACAG | 8381 | AQSFQGSARAQ | 12970 | SFQGSAR | 0.196025 | -0.06362 |
| GS1041 | 3793 | GCCCAAGCCAACAGCGACCACATCCACGCACAG | 8382 | AQANSDHIHAQ | 12971 | ANSDHIH | 0.196025 | -0.13792 |
| GS1042 | 3794 | GCCCAAGTCAGCCTCGCCAGCAAAAGGCACAG | 8383 | AQVSLASKSAQ | 12972 | VSLASKS | 0.195985 | -0.13164 |
| SyS1793 | 3795 | GCCCAACCCAAAGACAGAGCCACCAGCGCACAG | 8384 | AQPKDRATSAQ | 12973 | PKDRATS | 0.195973 | -0.13314 |
| SyS1794 | 3796 | GCCCAAGTTCGGTCGCAGAGTGATTCGGCACAG | 8385 | AQVRSQSDSAQ | 12974 | VRSQSDS | 0.195812 | -0.12101 |
| SyS1795 | 3797 | GCCCAACTTGGTAATTCGGTGTTAAGGCACAG | 8386 | AQLGNSVFKAQ | 12975 | LGNSVFK | 0.195693 | -0.10483 |
| SyS1796 | 3798 | GCCCAAAGCACCAAAGAAAGCCCAAAGCACAG | 8387 | AQSTKESPKAQ | 12976 | STKESPK | 0.195693 | -0.23173 |
| SyS1797 | 3799 | GCCCAACTCCAACCACCACCTTCAGCGCACAG | 8388 | AQLQPTTFSAQ | 12977 | LQPTTFS | 0.195693 | -0.23173 |
| SyS1798 | 3800 | GCCCAACCCATGCACACCGCCATGGTCGCACAG | 8389 | AQPMHTAMVAQ | 12978 | PMHTAMV | 0.195687 | -0.14162 |
| SyS1799 | 3801 | GCCCAAGTGTTTGCTCATATGGTCTTGCACAG | 8390 | AQVFAHTGLAQ | 12979 | VFAHTGL | 0.195535 | -0.2277 |
| GS1044 | 3802 | GCCCAACAAAAGCCACCAGCATCCACGCACAG | 8391 | AQQKATSIHAQ | 12980 | QKATSIH | 0.195419 | -0.1338 |
| SyS1800 | 3803 | GCCCAAGGTTCTAAGTGTCGGATAATCTGGCACAG | 8392 | AQGSKSDNLAQ | 12981 | GSKSDNL | 0.195377 | -0.15011 |
| SyS1801 | 3804 | GCCCAAAGCGGCCACCAACGTCGTCAGCGCACAG | 8393 | AQSGTNVVSAQ | 12982 | SGTNVVS | 0.195376 | -0.20955 |
| SyS1802 | 3805 | GCCCAAACCAAACTCACCACCCTCAGCGCACAG | 8394 | AQTKLTTLSAQ | 12983 | TKLTTLS | 0.195251 | -0.19846 |
| SyS1803 | 3806 | GCCCAACCCATCCTCCACCAAATCGCACAG | 8395 | AQPILHNQIAQ | 12984 | PILHNQI | 0.195237 | -0.13798 |
| SyS1804 | 3807 | GCCCAAGTCACCAACACCCATCAAACCCGCACAG | 8396 | AQVTNPIKPAQ | 12985 | VTNPIKP | 0.195213 | -0.19477 |
| SyS1805 | 3808 | GCCCAAACCAACCGCCCTCCACATGAAAGCACAG | 8397 | AQTNALHMKAQ | 12986 | TNALHMK | 0.195213 | -0.19477 |
| SyS1806 | 3809 | GCCCAAGTCGCCCACGCCTACCCGCGCACAG | 8398 | AQVAHAYPAAQ | 12987 | VAHAYPA | 0.195206 | 0.067049 |
| SyS1807 | 3810 | GCCCAAGCTGAGCATGTGTCTTGGTCCTGCACAG | 8399 | AQAEHGLGPAQ | 12988 | AEHGLGP | 0.195111 | -0.20345 |
| GS1045 | 3811 | GCCCAAATGAACAAATACAGCCCGCGCACAG | 8400 | AQMNKYSPAAQ | 12989 | MNKYSPA | 0.195101 | -0.14689 |
| SyS1808 | 3812 | GCCCAACCATGCAAGACAGACTCACCGCACAG | 8401 | AQTMQDRLTAQ | 12990 | TMQDRLT | 0.19501 | -0.12978 |
| SyS1809 | 3813 | GCCCAAGGCGTCAAAATCCTCAACAGCGCACAG | 8402 | AQGVKILNSAQ | 12991 | GVKILNS | 0.194998 | -0.11374 |
| GS1046 | 3814 | GCCCAAGCGCAGAATAAGATGACGAGTGCACAG | 8403 | AQAQNKMTSAQ | 12992 | AQNKMTS | 0.194978 | -0.14048 |
| SyS1810 | 3815 | GCCCAAACCAGCGCCCTCACCGACATCGCACAG | 8404 | AQTSALTDIAQ | 12993 | TSALTDI | 0.194946 | -0.19133 |
| SyS1811 | 3816 | GCCCAAGACCTCAGACACGCCGACATCGCACAG | 8405 | AQDLRHADIAQ | 12994 | DLRHADI | 0.194916 | -0.14647 |
| GP158 | 3817 | GCCCAACAGAATAAGGCGTTGACGGTGGCACAG | 8406 | AQQNKALTVAQ | 12995 | QNKALTV | 0.194813 | -0.07426 |

FIG. 33 (Continued)

| | | | | | | | |
|---|---|---|---|---|---|---|---|
| SyS1812 | 3818 | GCCCAAACTCAGGGGATTACGATTGTGGCACAG | 8407 | AQTQGITIVAQ | 12996 | TQGITIV | 0.194803 | -0.1792 |
| GS1047 | 3819 | GCCCAAACGGCGACTATTCTTGTCGTGGGGCACAG | 8408 | AQTATILSGAQ | 12997 | TATILSG | 0.194742 | -0.11376 |
| GP159 | 3820 | GCCCAATTTGCGGGCGAGTAATATTTCTGCACAG | 8409 | AQFAASNISAQ | 12998 | FAASNIS | 0.194572 | -0.07232 |
| SyS1814 | 3821 | GCCCAACGTAATACTATGGAGACTATGGCACAG | 8410 | AQRNTMETMAQ | 12999 | RNTMETM | 0.194502 | -0.19981 |
| GS1049 | 3822 | GCCCAAAGTTCTGGTACTAGTTATAGTGCACAG | 8411 | AQSSGTSYSAQ | 13000 | SSGTSYS | 0.194467 | -0.1765 |
| SyS1815 | 3823 | GCCCAAGCCAACCACGGCCTCAACGCCGCACAG | 8412 | AQANHGLNAAQ | 13001 | ANHGLNA | 0.194455 | 0.086643 |
| GS1050 | 3824 | GCCCAAATGCTGTCGAATTCGCGTAGTGCACAG | 8413 | AQMLSNSRSAQ | 13002 | MLSNSRS | 0.194307 | -0.13666 |
| SyS1816 | 3825 | GCCCAAGCTGCGATTCATGCGACGCCTGCACAG | 8414 | AQAAIHATPAQ | 13003 | AAIHATP | 0.194234 | -0.23255 |
| SyS1817 | 3826 | GCCCAATGGCAGTCGTTTGCGTCGGCGGGCACAG | 8415 | AQWQSFASAAQ | 13004 | WQSFASA | 0.194234 | -0.23255 |
| SyS1818 | 3827 | GCCCAAATGGGTGGGAATTCGAGTACGGCACAG | 8416 | AQMGGNSSTAQ | 13005 | MGGNSST | 0.194111 | -0.01311 |
| SyS1819 | 3828 | GCCCAAAAGACGGATTTGGGCGCAGCATGCACAG | 8417 | AQKTDLAQHAQ | 13006 | KTDLAQH | 0.194111 | -0.15132 |
| TS172 | 3829 | GCCCAAGTCAACACCACCAGATTCAGCGCACAG | 8418 | AQVNTTRFSAQ | 13007 | VNTTRFS | 0.19409 | -0.31218 |
| SyS1821 | 3830 | GCCCAAAATGTGCATGCTCATCAGGCTGCACAG | 8419 | AQNVHAHQAAQ | 13008 | NVHAHQA | 0.193921 | -0.11495 |
| GS1051 | 3831 | GCCCAAGGCGCCATGAGCATCCAAACCGCACAG | 8420 | AQGAMSIQTAQ | 13009 | GAMSIQT | 0.193889 | -0.10282 |
| GS1052 | 3832 | GCCCAAGCTCGGGGTCCGACGATTGTTGCACAG | 8421 | AQARGPTIVAQ | 13010 | ARGPTIV | 0.193777 | -0.18099 |
| GS1055 | 3833 | GCCCAAACGATGCATAGTAAGTCGGATGCACAG | 8422 | AQTMHSKSDAQ | 13011 | TMHSKSD | 0.193462 | -0.16035 |
| GS1056 | 3834 | GCCCAAACGGTTACGCAGACTACTCAGGCACAG | 8423 | AQTVTQTTQAQ | 13012 | TVTQTTQ | 0.193371 | -0.16663 |
| GS1057 | 3835 | GCCCAAGGCAACAACAACAGCCTCACCGCACAG | 8424 | AQGNTNSLTAQ | 13013 | GNTNSLT | 0.193295 | -0.04686 |
| GS1058 | 3836 | GCCCAAAGAGTCATCGCCAGCGTCAACGCACAG | 8425 | AQRVIASVNAQ | 13014 | RVIASVN | 0.193253 | -0.15001 |
| SyS1823 | 3837 | GCCCAACCCAGCAGCGGCAACAGCGAAGCACAG | 8426 | AQPSSGNSEAQ | 13015 | PSSGNSE | 0.193165 | -0.03781 |
| GS1059 | 3838 | GCCCAACAGCCGCATGGTTTTACGGCTGCACAG | 8427 | AQQPHGFTAAQ | 13016 | QPHGFTA | 0.19311 | -0.08893 |
| GS1060 | 3839 | GCCCAAACGACTGGTACCAACATGAGAGCACAG | 8428 | AQTTGTNMRAQ | 13017 | TTGTNMR | 0.192999 | -0.1586 |
| SyS1825 | 3840 | GCCCAATTCACCAGACTCGAAGACAGAGCACAG | 8429 | AQFTRLEDRAQ | 13018 | FTRLEDR | 0.192838 | -0.12829 |
| GS1061 | 3841 | GCCCAAGACAGAGAGCCCGCCCACACCGCACAG | 8430 | AQDRSPAHTAQ | 13019 | DRSPAHT | 0.192801 | -0.06749 |
| SyS1827 | 3842 | GCCCAACACGTCCACAACACCGTCCCGCACAG | 8431 | AQHVHNTVPAQ | 13020 | HVHNTVP | 0.192711 | -0.04938 |
| SS118 | 3843 | GCCCAAATGAACACCGGCACCAAAGCACAG | 8432 | AQMNTTGTKAQ | 13021 | MNTTGTK | 0.192667 | -0.30576 |
| SyS1828 | 3844 | GCCCAATTCGCCACCCAAACCATCGCCGCACAG | 8433 | AQFATQTIAAQ | 13022 | FATQTIA | 0.192606 | 0.020831 |
| GS1062 | 3845 | GCCCAAGTCAGCGGCAACATCCCCGTCGCACAG | 8434 | AQVSGNIPVAQ | 13023 | VSGNIPV | 0.192554 | -0.1774 |
| GS1063 | 3846 | GCCCAAGACGGCAGAAACATCGCCCCGCACAG | 8435 | AQDGRNIAPAQ | 13024 | DGRNIAP | 0.192531 | -0.10292 |
| SyS1829 | 3847 | GCCCAAATGCTCCCCACCGTCAACAGAGCACAG | 8436 | AQMLPTVNRAQ | 13025 | MLPTVNR | 0.192494 | -0.11361 |
| GS1064 | 3848 | GCCCAACCTACTACTAATGTGCTTGGTGCACAG | 8437 | AQPTTNVLGAQ | 13026 | PTTNVLG | 0.192456 | -0.15676 |
| SyS1830 | 3849 | GCCCAACGGGAGATGCATGGTACTCTTGCACAG | 8438 | AQREMHGTLAQ | 13027 | REMHGTL | 0.192442 | -0.13677 |

FIG. 33 (Continued)

| | | | | | | | | |
|---|---|---|---|---|---|---|---|---|
| GS1066 | 3850 | GCCCAATCTCCGTATTCGACTCGTCCGGCACAG | 8439 | AQSPYSTRPAQ | 13028 | SPYSTRP | 0.192371 | -0.15517 |
| SyS1832 | 3851 | GCCCAATACAACATGAACACCGAAATGGCACAG | 8440 | AQYNMNTEMAQ | 13029 | YNMNTEM | 0.192365 | -0.17314 |
| SyS1833 | 3852 | GCCCAAGGGGCGGCGTATGGGTCATTCGGCACAG | 8441 | AQGARMGHSAQ | 13030 | GARMGHS | 0.192225 | -0.07252 |
| SyS1834 | 3853 | GCCCAATTCAGCCCCGGCTACGTCCCCGCACAG | 8442 | AQFSPGYVPAQ | 13031 | FSPGYVP | 0.192168 | -0.09677 |
| SyS1835 | 3854 | GCCCAACAGCAGCATATTCCTCCTTCTGCACAG | 8443 | AQQQHIPPSAQ | 13032 | QQHIPPS | 0.191995 | -0.18984 |
| GS1067 | 3855 | GCCCAACTCAGCACCAGCCTCAGCCCCGCACAG | 8444 | AQLSTSLSPAQ | 13033 | LSTSLSP | 0.191963 | -0.10041 |
| SyS1836 | 3856 | GCCCAAGTTAATGGGATTAAGGAGTATGCACAG | 8445 | AQVNGIKEYAQ | 13034 | VNGIKEY | 0.191891 | -0.081 |
| SyP60 | 3857 | GCCCAAGGTGTGCGGACTGAGCCGATGGCACAG | 8446 | AQGVRTEPMAQ | 13035 | GVRTEPM | 0.191789 | -0.0406 |
| SyS1837 | 3858 | GCCCAAAGAAACAACGACAGCCTCACCGCACAG | 8447 | AQRNNDSLTAQ | 13036 | RNNDSLT | 0.191786 | 0.1054 |
| SyS1838 | 3859 | GCCCAATTTAATGCGTCTCCTAAGTTGGCACAG | 8448 | AQFNASPKLAQ | 13037 | FNASPKL | 0.191776 | -0.19375 |
| SyS1839 | 3860 | GCCCAAGGCCTCACCAGCACCACCGCACAG | 8449 | AQGLTTSTTAQ | 13038 | GLTTSTT | 0.191776 | -0.19375 |
| SyS1840 | 3861 | GCCCAAATGATCAGAGGCACCAGCAGCGCACAG | 8450 | AQMIRGTSSAQ | 13039 | MIRGTSS | 0.191749 | -0.11737 |
| SyS1841 | 3862 | GCCCAAACTAAGCTTGTGGCTACTGTGGCACAG | 8451 | AQTKLVATVAQ | 13040 | TKLVATV | 0.191661 | -0.21941 |
| SyS1842 | 3863 | GCCCAAGTGAGTCGGCAGTTTGAGCCGGCACAG | 8452 | AQVSRQFEPAQ | 13041 | VSRQFEP | 0.191661 | -0.21941 |
| SyS1843 | 3864 | GCCCAAAATGGTGATAGTTTGCGTCCTGCACAG | 8453 | AQNGDSLRPAQ | 13042 | NGDSLRP | 0.191643 | -0.05025 |
| SyS1844 | 3865 | GCCCAAACCCAAAACCTCAGCAGCCACGCACAG | 8454 | AQTQNLSSHAQ | 13043 | TQNLSSH | 0.191633 | 0.003465 |
| SyS1845 | 3866 | GCCCAAACCGTCACCGGCAGCCTCGTCGCACAG | 8455 | AQTVTGSLVAQ | 13044 | TVTGSLV | 0.191556 | -0.15374 |
| SyS1846 | 3867 | GCCCAAGGCAGAGGCCCCGAAGCCCAAGCACAG | 8456 | AQGRGPEAQAQ | 13045 | GRGPEAQ | 0.191398 | 0.062377 |
| GS1068 | 3868 | GCCCAACCCAGAAACGTCGGCCTCGAAGCACAG | 8457 | AQPRNVGLEAQ | 13046 | PRNVGLE | 0.191325 | -0.0842 |
| SyS1847 | 3869 | GCCCAATTCAACAGCAGCATCCCCACCGCACAG | 8458 | AQFNSSIPTAQ | 13047 | FNSSIPT | 0.191319 | 0.002066 |
| SyS1848 | 3870 | GCCCAAGGTAATCAGCAGCATTCTTCTGCACAG | 8459 | AQGNQQHSSAQ | 13048 | GNQQHSS | 0.191216 | 0.020615 |
| GS1069 | 3871 | GCCCAACCCATCACCAACGGCAGCTTCGGCACAG | 8460 | AQPITNGSFAQ | 13049 | PITNGSF | 0.191188 | -0.13074 |
| GS1070 | 3872 | GCCCAAGTTCAGCGTACTCCGCTTACTGCACAG | 8461 | AQVQRTPLTAQ | 13050 | VQRTPLT | 0.191121 | -0.18054 |
| GS1071 | 3873 | GCCCAAACGCCTTATGCTGGTAGGGCTGCACAG | 8462 | AQTPYAGRAAQ | 13051 | TPYAGRA | 0.19095 | -0.10831 |
| SyS1849 | 3874 | GCCCAACTGGCTCTGTCTAATCGTACGGCACAG | 8463 | AQLALSNRTAQ | 13052 | LALSNRT | 0.190717 | -0.17259 |
| SyS1850 | 3875 | GCCCAAGGTCAGATGGCTACTGGTCTGGCACAG | 8464 | AQGQMATGLAQ | 13053 | GQMATGL | 0.190704 | -0.13866 |
| SyS1852 | 3876 | GCCCAATCTAATCCTGCGACTACTACTGCACAG | 8465 | AQSNPATTTAQ | 13054 | SNPATTT | 0.190655 | -0.11859 |
| GS1074 | 3877 | GCCCAAGGGCGGACTACTAGTGATAGTGCACAG | 8466 | AQGRTTSDSAQ | 13055 | GRTTSDS | 0.190613 | -0.09357 |
| GS1075 | 3878 | GCCCAAAGCAGAGCTCACCAGCCTGGGCACAG | 8467 | AQSRLTSLGAQ | 13056 | SRLTSLG | 0.19049 | -0.12819 |
| SyS1853 | 3879 | GCCCAACACATCTTTCTACGCCGGATTTGGCACAG | 8468 | AQHLSTPDLAQ | 13057 | HLSTPDL | 0.190472 | -0.18737 |
| SyS1854 | 3880 | GCCCAAATGCCTCATGCTCCGACTTCGGCACAG | 8469 | AQMPHAPTSAQ | 13058 | MPHAPTS | 0.190411 | -0.14283 |
| GS1076 | 3881 | GCCCAAGTTGCGGGGTATGTTGACGCATGCACAG | 8470 | AQVAGMLTHAQ | 13059 | VAGMLTH | 0.190345 | -0.17672 |

FIG. 33 (Continued)

| | | | | | | | | |
|---|---|---|---|---|---|---|---|---|
| GS1077 | 3882 | GCCCAAGTCGCCAGCCAAAAACTCAAGCGCACAG | 8471 | AQVASQKLNAQ | 13060 | VASQKLN | 0.190288 | -0.13094 |
| SyS1856 | 3883 | GCCCAAACCCAAAGCATGACCAGCAGAGCACAG | 8472 | AQTQSMTSRAQ | 13061 | TQSMTSR | 0.190241 | -0.02852 |
| GS1079 | 3884 | GCCCAACCCATCAGCACCATGAGCCTCGCACAG | 8473 | AQPISTMSLAQ | 13062 | PISTMSL | 0.19008 | -0.1765 |
| SyS1857 | 3885 | GCCCAAGCCCAACTCAACAGCGCCGGCGCACAG | 8474 | AQAQLNSAGAQ | 13063 | AQLNSAG | 0.190056 | -0.1392 |
| SyS1858 | 3886 | GCCCAACACCTCCCAAATACGAACACGCACAG | 8475 | AQHLPKYEHAQ | 13064 | HLPKYEH | 0.190056 | -0.1392 |
| GS1080 | 3887 | GCCCAAGGGGTGCAGGCTGTTGTTGGGTGCACAG | 8476 | AQGVQAVVGAQ | 13065 | GVQAVVG | 0.189947 | -0.15647 |
| SyS1859 | 3888 | GCCCAAGGCGACACCCAATACGCCAGAGCACAG | 8477 | AQGDTQYARAQ | 13066 | GDTQYAR | 0.189923 | -0.1792 |
| SyS1860 | 3889 | GCCCAAGCCAGCCAGCCCCCTCGTCATGAGCGCACAG | 8478 | AQASPLVMSAQ | 13067 | ASPLVMS | 0.189788 | -0.033 |
| SyS1861 | 3890 | GCCCAAAGCAACGCCGGCATGAGCAAAGCACAG | 8479 | AQSNAGMSKAQ | 13068 | SNAGMSK | 0.189781 | -0.07895 |
| SyS1862 | 3891 | GCCCAAAGAAGCGTCAGCGCCGTCCCCGCACAG | 8480 | AQRSVSAVPAQ | 13069 | RSVSAVP | 0.189731 | -0.22064 |
| SyS1863 | 3892 | GCCCAACCCAGCTACCACAAAAGCCCCGCACAG | 8481 | AQPSYHKSPAQ | 13070 | PSYHKSP | 0.189731 | -0.15164 |
| GS1081 | 3893 | GCCCAACATCAGTTTACTAGTTCTGCGGCACAG | 8482 | AQHQFTSSAAQ | 13071 | HQFTSSA | 0.189638 | -0.13792 |
| SyS1865 | 3894 | GCCCAAAACCAAAGCCCCATCGGCGCCGCACAG | 8483 | AQNQSPIGAAQ | 13072 | NQSPIGA | 0.189626 | -0.22434 |
| SyS1866 | 3895 | GCCCAAGGTGCGGCTGGGATGTGCGGGGGCACAG | 8484 | AQGAAGMSRAQ | 13073 | GAAGMSR | 0.189609 | -0.04299 |
| GS1082 | 3896 | GCCCAAACGGTGAAGACGTATAGTGCGGGCACAG | 8485 | AQTVKTYSAAQ | 13074 | TVKTYSA | 0.189603 | 0.055302 |
| SyS1867 | 3897 | GCCCAACTCAGCATGACCAGCCAAATGGCACAG | 8486 | AQLSMTSQMAQ | 13075 | LSMTSQM | 0.189571 | -0.09374 |
| SyS1868 | 3898 | GCCCAAGGCCTCAGCCCCACCTTCGGCGCACAG | 8487 | AQGLSPTFGAQ | 13076 | GLSPTFG | 0.189515 | -0.16273 |
| GS1083 | 3899 | GCCCAAATGGACACCGTCATGAAAGGCGCACAG | 8488 | AQMDTVMKGAQ | 13077 | MDTVMKG | 0.189386 | -0.16663 |
| GS1085 | 3900 | GCCCAACGTGATAAGATTTCTACGTATGCACAG | 8489 | AQRDKISTYAQ | 13078 | RDKISTY | 0.189205 | -0.18099 |
| SyS1870 | 3901 | GCCCAAGACAGCAACAGCTACGTCAGAGCACAG | 8490 | AQDSNSYVRAQ | 13079 | DSNSYVR | 0.189097 | -0.18121 |
| SyS1872 | 3902 | GCCCAAAGCCTCAAAAGCAGCCCCTTCGCACAG | 8491 | AQSLKSSPFAQ | 13080 | SLKSSPF | 0.189004 | -0.19981 |
| GS1088 | 3903 | GCCCAACTTGATCGTACTGCGAAGCCTGCACAG | 8492 | AQLDRTAKPAQ | 13081 | LDRTAKP | 0.188806 | -0.15676 |
| SyS1873 | 3904 | GCCCAACCGTCGAGGGCTCCGGATCCTGCACAG | 8493 | AQPSRAPDPAQ | 13082 | PSRAPDP | 0.188784 | -0.10614 |
| SyS1874 | 3905 | GCCCAATACCTCAACCAAATCAGAAGCGCACAG | 8494 | AQYLNQIRSAQ | 13083 | YLNQIRS | 0.188662 | -0.10889 |
| GS1090 | 3906 | GCCCAACAAAACAGAAGCGTCGTCGAAGCACAG | 8495 | AQQNRSVVEAQ | 13084 | QNRSVVE | 0.188647 | -0.14238 |
| GS1091 | 3907 | GCCCAACAGGAGTCTATGGTTAAGTATGCACAG | 8496 | AQQESMVKYAQ | 13085 | QESMVKY | 0.188647 | -0.17958 |
| GS1092 | 3908 | GCCCAAAAGCTGTCGCAGGAGAGTAATGCACAG | 8497 | AQKLSQESNAQ | 13086 | KLSQESN | 0.18854 | -0.13253 |
| SyS1875 | 3909 | GCCCAACGTGGTACTATGGAGCATGATGCACAG | 8498 | AQRGTMEHDAQ | 13087 | RGTMEHD | 0.188451 | -0.18042 |
| SyS1878 | 3910 | GCCCAACAGTCGGGTCCTGGGATTGTGGCACAG | 8499 | AQQSGPGIVAQ | 13088 | QSGPGIV | 0.188217 | -0.2083 |
| SyS1879 | 3911 | GCCCAACTCAACCAAGGCGACCTCCTCGCACAG | 8500 | AQLNQGDLLAQ | 13089 | LNQGDLL | 0.188212 | -0.21078 |
| SyS1880 | 3912 | GCCCAAGCCCAAAACCATCGGCACCGCACAG | 8501 | AQAKTIGSTAQ | 13090 | AKTIGST | 0.188109 | -0.10161 |
| SyS1881 | 3913 | GCCCAAGACAGCGGCAACAGAACCAGCGCACAG | 8502 | AQDSGNRTSAQ | 13091 | DSGNRTS | 0.187878 | -0.11374 |

FIG. 33 (Continued)

| | | | | | | | | |
|---|---|---|---|---|---|---|---|---|
| SyS1882 | 3914 | GCCCAACTCAGCCACCAGCTTCGCACAG | 8503 | AQLSHSTSFAQ | 13092 | LSHSTSF | 0.187878 | -0.11374 |
| GS1094 | 3915 | GCCCAAGGTGATTTTTCGTCGAAGCAGGCACAG | 8504 | AQGDFSSKQAQ | 13093 | GDFSSKQ | 0.187866 | -0.03656 |
| GP160 | 3916 | GCCCAAGATCATAGTAATGCGTATCGTGCACAG | 8505 | AQDHSNAYRAQ | 13094 | DHSNAYR | 0.187845 | -0.07058 |
| SyS1883 | 3917 | GCCCAAGTTCCGACTGATCGTCCTCGTGCACAG | 8506 | AQVPTDRPRAQ | 13095 | VPTDRPR | 0.187817 | -0.22042 |
| SyS1884 | 3918 | GCCCAAAGCATGCAACTCATCAACGAAGCACAG | 8507 | AQSMQLINEAQ | 13096 | SMQLINE | 0.187817 | -0.22042 |
| GS1095 | 3919 | GCCCAATACGCCAACAGCGTCGGCCTCGCACAG | 8508 | AQYANSVGLAQ | 13097 | YANSVGL | 0.187791 | -0.11279 |
| SyS1885 | 3920 | GCCCAAGTCTACCTCGCCAGCGGCGGCGCACAG | 8509 | AQVYLASGGAQ | 13098 | VYLASGG | 0.187783 | -0.22187 |
| SyS1886 | 3921 | GCCCAACTCATCCCCGTCACCAGCGTCGCACAG | 8510 | AQLIPVTSVAQ | 13099 | LIPVTSV | 0.187768 | -0.20466 |
| SyS1888 | 3922 | GCCCAAGGCAACATGAACAGCAGAACCGCACAG | 8511 | AQGNMNSRTAQ | 13100 | GNMNSRT | 0.18734 | -0.07494 |
| SyS1889 | 3923 | GCCCAAAGCCACAACGACAGCAGAAGCCTCGCACAG | 8512 | AQSHNDRSLAQ | 13101 | SHNDRSL | 0.18734 | -0.13798 |
| SyS1890 | 3924 | GCCCAACATAGGATTCCTACGGCTGGGGCACAG | 8513 | AQHRIPTAGAQ | 13102 | HRIPTAG | 0.18734 | -0.18527 |
| SyS1891 | 3925 | GCCCAAATGGGCAAAGACTACACCCACGCACAG | 8514 | AQMGKDYTHAQ | 13103 | MGKDYTH | 0.187325 | -0.18984 |
| SyS1893 | 3926 | GCCCAATCTCATGCGAGTACTCCTATTGCACAG | 8515 | AQSHASTPIAQ | 13104 | SHASTPI | 0.18723 | -0.16041 |
| GS1098 | 3927 | GCCCAACTCAACAGCCAAACCAGAAGCGCACAG | 8516 | AQLNSQTRSAQ | 13105 | LNSQTRS | 0.18719 | -0.08992 |
| SyS1894 | 3928 | GCCCAACGGACGCTGAGTGATAGTGTGGCACAG | 8517 | AQRTLSDSVAQ | 13106 | RTLSDSV | 0.187066 | -0.11859 |
| SyS1895 | 3929 | GCCCAACTTACGACTGCTAAGACGTTTGCACAG | 8518 | AQLTTAKTFAQ | 13107 | LTTAKTF | 0.187043 | -0.19723 |
| GS1099 | 3930 | GCCCAAAGAATCGTCGGCAGCCAGCGCACAG | 8519 | AQRIVGSTSAQ | 13108 | RIVGSTS | 0.187032 | -0.05357 |
| SyS1897 | 3931 | GCCCAAACCAAAACCCTGCCCCTCCACGCACAG | 8520 | AQTKTLALHAQ | 13109 | TKTLALH | 0.187025 | -0.15011 |
| SyS1898 | 3932 | GCCCAATGGGAAGTCCCCGCCAGAAACGCACAG | 8521 | AQWEVPARNAQ | 13110 | WEVPARN | 0.186968 | -0.18163 |
| SyS1899 | 3933 | GCCCAAATTTCTAATCCGGCGATTGCTGCACAG | 8522 | AQISNPAIAAQ | 13111 | ISNPAIA | 0.186968 | -0.18163 |
| GS1101 | 3934 | GCCCAATTGGGGGCTTCGCAGACTTCTGCACAG | 8523 | AQLGASQTSAQ | 13112 | LGASQTS | 0.186895 | -0.14143 |
| GS1103 | 3935 | GCCCAACTCAGCACCAACAGCGTCGCACAG | 8524 | AQLSTHNSVAQ | 13113 | LSTHNSV | 0.186848 | -0.02926 |
| GS1104 | 3936 | GCCCAAAGACACACCGACATGCGACACCGCACAG | 8525 | AQRHTDIDTAQ | 13114 | RHTDIDT | 0.186832 | -0.14779 |
| SyP61 | 3937 | GCCCAAGGGAGGCCGGTTATTGCGGCGGCACAG | 8526 | AQGRPVIAAAQ | 13115 | GRPVIAA | 0.186825 | -0.04411 |
| SyS1900 | 3938 | GCCCAAGCCAACCTCAGAGACGGCGTCGCACAG | 8527 | AQANLRDGVAQ | 13116 | ANLRDGV | 0.186763 | -0.13071 |
| GS1105 | 3939 | GCCCAAGTTCAGTCTCCGTCGATTACGGCACAG | 8528 | AQVQSPSITAQ | 13117 | VQSPSIT | 0.186748 | -0.17201 |
| SyS1901 | 3940 | GCCCAATTCACCAGCGGCAGCCACCTCGCACAG | 8529 | AQFTSGSHLAQ | 13118 | FTSGSHL | 0.18672 | -0.14647 |
| GS1106 | 3941 | GCCCAACCTCTTCAGCAGTCGGGTCATGCACAG | 8530 | AQPLQQSGHAQ | 13119 | PLQQSGH | 0.186526 | -0.09792 |
| SyS1902 | 3942 | GCCCAAGCCAGAGTCGCCACCACCCTCGCACAG | 8531 | AQARVATTLAQ | 13120 | ARVATTL | 0.186427 | -0.14283 |
| GS1108 | 3943 | GCCCAACCCGGCAGACAAAACGACGCCGCACAG | 8532 | AQPGRQNDAAQ | 13121 | PGRQNDA | 0.186248 | -0.1214 |
| SyS1905 | 3944 | GCCCAAAAATACAGCACCACCCATCGCACAG | 8533 | AQKYSSTAIAQ | 13122 | KYSSTAI | 0.186114 | -0.03736 |
| SyS1906 | 3945 | GCCCAACACAGCACCCACTACATCGCCGCACAG | 8534 | AQHSTHYIAAQ | 13123 | HSTHYIA | 0.186051 | -0.15496 |

FIG. 33 (Continued)

| | | | | | | | | |
|---|---|---|---|---|---|---|---|---|
| SyS1907 | 3946 | GCCCAACACCCCTCAACGCCCTCCCGCACAG | 8535 | AQQPLINALPAQ | 13124 | QPLINALP | 0.185989 | 0.064654 |
| GS1109 | 3947 | GCCCAAAAACCCAAGAAACCGGCAACGCACAG | 8536 | AQKTQETGNAQ | 13125 | KTQETGN | 0.185973 | -0.16035 |
| SyS1908 | 3948 | GCCCAAGTGAGTTGTCTGGCCATGCGGCACAG | 8537 | AQSELSRHAAQ | 13126 | SELSRHA | 0.18587 | 0.08751 |
| GS1110 | 3949 | GCCCAAGGCCCCAAAACCATCAGCACCGCACAG | 8538 | AQGPKTISTAQ | 13127 | GPKTIST | 0.18578 | -0.09587 |
| GS1111 | 3950 | GCCCAAGTCATAGTATTGTGAATCCGGCACAG | 8539 | AQSHSIVNPAQ | 13128 | SHSIVNP | 0.18578 | -0.1765 |
| SyS1909 | 3951 | GCCCAACATTCGAATACTGTGAGTTCGGCACAG | 8540 | AQHSNTVSSAQ | 13129 | HSNTVSS | 0.18577 | 0.232173 |
| SyS1910 | 3952 | GCCCAAGTCGCCGGCCTCACCGTCCAAGCACAG | 8541 | AQVAGLTVQAQ | 13130 | VAGLTVQ | 0.185758 | 0.055989 |
| GS1112 | 3953 | GCCCAAGCCAACCCGGCCTGCCAACGCACAG | 8542 | AQANPGLANAQ | 13131 | ANPGLAN | 0.185473 | -0.16663 |
| SyS1912 | 3954 | GCCCAAGCAGCGGTCAAATGACCCTCGCACAG | 8543 | AQASVQMTLAQ | 13132 | ASVQMTL | 0.185379 | -0.2305 |
| SyS1913 | 3955 | GCCCAACTCGTCACCGCCCAAGGCCCCGCACAG | 8544 | AQLVTAQGPAQ | 13133 | LVTAQGP | 0.185303 | -0.10115 |
| GP161 | 3956 | GCCCAAACTACGCGGTTATACTTCGCGGCACAG | 8545 | AQTTRYTSPAQ | 13134 | TTRYTSP | 0.185249 | -0.07433 |
| SyS1914 | 3957 | GCCCAAATGGACACCGACAAACCCAGAGCACAG | 8546 | AQMDTDKPRAQ | 13135 | MDTDKPR | 0.185204 | -0.14405 |
| SS121 | 3958 | GCCCAAGGCACCCAGCGTCCAAGACAGAGCACAG | 8547 | AQGTSVQDRAQ | 13136 | GTSVQDR | 0.185176 | -0.37486 |
| GS1113 | 3959 | GCCCAAAGAGCCAGCCCCAACAATACGCACAG | 8548 | AQRASPQQYAQ | 13137 | RASPQQY | 0.185058 | -0.15478 |
| SyS1915 | 3960 | GCCCAAGTCAGCAGCGAACACAGAATCGCACAG | 8549 | AQVSSEHRIAQ | 13138 | VSSEHRI | 0.184992 | 0.003859 |
| GS1114 | 3961 | GCCCAAAGCAACATGAAAATCCAACCGCACAG | 8550 | AQSNMKIQPAQ | 13139 | SNMKIQP | 0.184985 | -0.09183 |
| SyS1916 | 3962 | GCCCAAAACCTCAGAATCGAACCCATGGCACAG | 8551 | AQNLRIEPMAQ | 13140 | NLRIEPM | 0.18494 | -0.08585 |
| SyS1917 | 3963 | GCCCAACCCACCGAAAGCCTCAGAGTCGCACAG | 8552 | AQPTESLRVAQ | 13141 | PTESLRV | 0.184782 | -0.20955 |
| GP162 | 3964 | GCCCAAACTAATAGGGGTCTTGCTCTTGCACAG | 8553 | AQTNRGLALAQ | 13142 | TNRGLAL | 0.184678 | -0.05599 |
| SyS1920 | 3965 | GCCCAACATGAGAAGACGGCGTATATTGCACAG | 8554 | AQHEKTAYIAQ | 13143 | HEKTAYI | 0.184498 | -0.15657 |
| SyS1921 | 3966 | GCCCAAAATGTTATTTCTAAGAATTTGGCACAG | 8555 | AQNVISKNLAQ | 13144 | NVISKNL | 0.184372 | -0.22649 |
| SyP62 | 3967 | GCCCAAGGACGGCGGGGTTTCGTCGGCACAG | 8556 | AQGTAGFSSAQ | 13145 | GTAGFSS | 0.184333 | -0.04152 |
| SyS1922 | 3968 | GCCCAAATTGCGCAGATGGGGGTTAAGGCACAG | 8557 | AQIAQMGVKAQ | 13146 | IAQMGVK | 0.184332 | -0.18861 |
| SyS1923 | 3969 | GCCCAAACTTCTAAGGATGTGAAGGATGCACAG | 8558 | AQTSKDVKDAQ | 13147 | TSKDVKD | 0.184281 | -0.18769 |
| SyS1924 | 3970 | GCCCAAATCATCGGCGCCAGAGACATCGCACAG | 8559 | AQIIGARDIAQ | 13148 | IIGARDI | 0.18425 | -0.16829 |
| SyS1925 | 3971 | GCCCAACTTAGGGATACGGGTCTTGGGGCACAG | 8560 | AQLRDTGLGAQ | 13149 | LRDTGLG | 0.184224 | -0.1489 |
| SyS1926 | 3972 | GCCCAACTCAGCAACAGCCTCGGCCAAGCACAG | 8561 | AQLSNSLGQAQ | 13150 | LSNSLGQ | 0.184171 | 0.126572 |
| GS1116 | 3973 | GCCCAAAACGTCCTCAACAGCAGAGGCGCACAG | 8562 | AQNVLNSRGAQ | 13151 | NVLNSRG | 0.18417 | -0.17958 |
| GS1117 | 3974 | GCCCAATTTAGGGGTAGTGGTAGTCCGGCACAG | 8563 | AQFRGSGSPAQ | 13152 | FRGSGSP | 0.18417 | -0.17958 |
| GS1118 | 3975 | GCCCAAAATCCGGAGTTGCCGCGTCAGGCACAG | 8564 | AQNPELPRQAQ | 13153 | NPELPRQ | 0.184111 | -0.16932 |
| GS1119 | 3976 | GCCCAAACGTCTAGTTCGTTTAAGGAGGCACAG | 8565 | AQTSSSFKEAQ | 13154 | TSSSFKE | 0.184043 | -0.14524 |
| SyS1928 | 3977 | GCCCAAAACAGAGAATACATGACCCACGCACAG | 8566 | AQNREYMTHAQ | 13155 | NREYMTH | 0.183973 | -0.18405 |

FIG. 33 (Continued)

| | | | | | | | | |
|---|---|---|---|---|---|---|---|---|
| SyP63 | 3978 | GCCCAAACGCCTGGTGTTGCGCATCCTGCACAG | 8567 | AQTPGVAHPAQ | 13156 | TPGVAHP | 0.183725 | -0.04392 |
| SyS1931 | 3979 | GCCCAAACGCAGTCTTCGGAGGGGCCTGCACAG | 8568 | AQTQSSEGPAQ | 13157 | TQSSEGP | 0.183702 | -0.19969 |
| GS1120 | 3980 | GCCCAAAGGGGTGAGCCGATTGTGTCGGCACAG | 8569 | AQRGEPIVSAQ | 13158 | RGEPIVS | 0.183678 | -0.17577 |
| GS1121 | 3981 | GCCCAATCGCTTACGTCTCTGAATTCTGCACAG | 8570 | AQSLTSLNSAQ | 13159 | SLTSLNS | 0.183678 | -0.14143 |
| SyS1933 | 3982 | GCCCAAACGGTGTTGCATACGAGGCAGGCACAG | 8571 | AQTVLHTRQAQ | 13160 | TVLHTRQ | 0.183603 | -0.06701 |
| SyS1934 | 3983 | GCCCAATTGTCGAAGTCGGGTGCGGATGCACAG | 8572 | AQLSKSGADAQ | 13161 | LSKSGAD | 0.183472 | -0.12577 |
| SyS1935 | 3984 | GCCCAAGCCAACGGCAACCAAAGCCTCGCACAG | 8573 | AQANGNQSLAQ | 13162 | ANGNQSL | 0.183416 | 0.105951 |
| SyS1936 | 3985 | GCCCAATTCGTCACCAGCAGCAGCGGCGCACAG | 8574 | AQFVTSSSGAQ | 13163 | FVTSSSG | 0.183382 | 0.086298 |
| SyP64 | 3986 | GCCCAAGGTGCGAATAATCATACGCGTGCACAG | 8575 | AQGANNHTRAQ | 13164 | GANNHTR | 0.183354 | -0.04236 |
| SyS1937 | 3987 | GCCCAACACGCCAGCGACGTCAACAACGCACAG | 8576 | AQHASDVNNAQ | 13165 | HASDVNN | 0.183281 | -0.23173 |
| GS1123 | 3988 | GCCCAAGGCCACCACACCAGCACCCGCACAG | 8577 | AQGHHTSDPAQ | 13166 | GHHTSDP | 0.183067 | -0.17381 |
| SyS1939 | 3989 | GCCCAAGACAAAAACCCGGCGTCCACGCACAG | 8578 | AQDKNPGVHAQ | 13167 | DKNPGVH | 0.182966 | -0.15011 |
| SyS1940 | 3990 | GCCCAATCGAGGAATTCGCATATTGAGGCACAG | 8579 | AQSRNSHIEAQ | 13168 | SRNSHIE | 0.182829 | -0.00548 |
| SyS1941 | 3991 | GCCCAACAGGCGAGTTCTGATCATGTTGCACAG | 8580 | AQQASSDHVAQ | 13169 | QASSDHV | 0.182736 | -0.1889 |
| GS1125 | 3992 | GCCCAACTCAGAGACACCCCTACAACGCACAG | 8581 | AQLRDTPYNAQ | 13170 | LRDTPYN | 0.182726 | -0.18188 |
| GS1126 | 3993 | GCCCAAAGTTGGCTGCGACGAGGGATGCACAG | 8582 | AQSLAATRDAQ | 13171 | SLAATRD | 0.182549 | -0.12807 |
| SyS1942 | 3994 | GCCCAAGGCCACGTCAACAACGCCGTCGCACAG | 8583 | AQGHVNNAVAQ | 13172 | GHVNNAV | 0.182493 | -0.12331 |
| SyS1943 | 3995 | GCCCAATTGGTGGGCTTACGACGCGGGGCACAG | 8584 | AQIGGLTTRAQ | 13173 | IGGLTTR | 0.18241 | -0.12143 |
| GS1127 | 3996 | GCCCAAAGCAAAGAAAGAAAACGGCCAAGCACAG | 8585 | AQSKERNGQAQ | 13174 | SKERNGQ | 0.182404 | -0.12617 |
| GS1128 | 3997 | GCCCAATTGAATAGTGGTTCTTCTGCACAG | 8586 | AQLNSGSSAAQ | 13175 | LNSGSSA | 0.182404 | -0.16432 |
| SyS1944 | 3998 | GCCCAAACCATGAGCACCACCTACGAAGCACAG | 8587 | AQTMSTTYEAQ | 13176 | TMSTTYE | 0.182396 | -0.10816 |
| GS1129 | 3999 | GCCCAAGGCGCCGACAACAGAGATCAGCGCACAG | 8588 | AQGADNRISAQ | 13177 | GADNRIS | 0.182324 | -0.17022 |
| SyS1945 | 4000 | GCCCAAACCCAAAACAACCAACGGCGACGTCGCACAG | 8589 | AQTQNNGDVAQ | 13178 | TQNNGDV | 0.18227 | -0.20466 |
| GP163 | 4001 | GCCCAAAATGGTCCGTCTGTGCTGAGTGCACAG | 8590 | AQNGPSVLSAQ | 13179 | NGPSVLS | 0.182231 | 0.090896 |
| SyS1946 | 4002 | GCCCAAACGGCTCTTCGGGATGTGGGTGCACAG | 8591 | AQTALRDVGAQ | 13180 | TALRDVG | 0.182226 | 0.09096 |
| SyS1947 | 4003 | GCCCAAAGGACTATGGGGACGACTATGGCACAG | 8592 | AQRTMGTTMAQ | 13181 | RTMGTTM | 0.182133 | 0.002686 |
| GS1131 | 4004 | GCCCAAACGAGGGGTACGACTGTGGAGGCACAG | 8593 | AQTRGTTVEAQ | 13182 | TRGTTVE | 0.182067 | 0.079797 |
| GS1132 | 4005 | GCCCAAACCGTCAGCAGAGTCCAAGTCGCACAG | 8594 | AQTVSRVQVAQ | 13183 | TVSRVQV | 0.181971 | -0.16842 |
| SyS1948 | 4006 | GCCCAAAGGCTGGAATACTAGTGCGGATGCACAG | 8595 | AQRLDTSADAQ | 13184 | RLDTSAD | 0.181959 | -0.1344 |
| GS1133 | 4007 | GCCCAACTCATGACCAAAGGCCTCGTCGCACAG | 8596 | AQLMTKGLVAQ | 13185 | LMTKGLV | 0.181936 | -0.17829 |
| SyS1949 | 4008 | GCCCAACCCATGAGAATGCAAACCGCCGCACAG | 8597 | AQPMRMQTAAQ | 13186 | PMRMQTA | 0.181912 | -0.17998 |
| SyS1950 | 4009 | GCCCAAGTGGTGCTGGGGAGTACTTTCTGCACAG | 8598 | AQVVLGSTSAQ | 13187 | VVLGSTS | 0.181893 | -0.13192 |

FIG. 33 (Continued)

| | | | | | | | | |
|---|---|---|---|---|---|---|---|---|
| GS1135 | 4010 | GCCCAATCTAATAATGGGAATGGTCATGCACAG | 8599 | AQSNNGNGHAQ | 13188 | SNNGNGH | 0.181861 | -0.17863 |
| SyS1951 | 4011 | GCCCAAAGAGGCCCGACCTCCTCAACGCACAG | 8600 | AQRGPDLLNAQ | 13189 | RGPDLLN | 0.181699 | -0.12829 |
| SyS1952 | 4012 | GCCCAAGGTTTAATAGTATGAAGCCTGCACAG | 8601 | AQGFNSMKPAQ | 13190 | GFNSMKP | 0.181699 | -0.17435 |
| SyS1953 | 4013 | GCCCAACTCAACAGCAACCCATGAACGCACAG | 8602 | AQLNSNPMNAQ | 13191 | LNSNPMN | 0.181699 | -0.17435 |
| GS1136 | 4014 | GCCCAACTCAGCAACAGAGTCAAAGCGCACAG | 8603 | AQLSNRVQSAQ | 13192 | LSNRVQS | 0.181602 | -0.07962 |
| GS1137 | 4015 | GCCCAAAGCAGAATGGAAGGCACCGTCGCACAG | 8604 | AQSRMEGTVAQ | 13193 | SRMEGTV | 0.181451 | -0.1451 |
| SyS1955 | 4016 | GCCCAAAGCGAACAATACGTCAGAGTCGCACAG | 8605 | AQSEQYVRVAQ | 13194 | SEQYVRV | 0.181394 | -0.16643 |
| GS1138 | 4017 | GCCCAAAGTAATCTTGCGAATCAGCCTGCACAG | 8606 | AQSNLANQPAQ | 13195 | SNLANQP | 0.1813 | -0.16484 |
| GP164 | 4018 | GCCCAAGTGAGTATGCAGAGGCCGACGGCACAG | 8607 | AQVSMQRPTAQ | 13196 | VSMQRPT | 0.181294 | -0.06864 |
| SyS1956 | 4019 | GCCCAATTTCATGGTCAGGGTATGTCTGCACAG | 8608 | AQFHGQGMSAQ | 13197 | FHGQGMS | 0.181291 | -0.14405 |
| SyS1959 | 4020 | GCCCAAACGGGCGCCATCAACGCCCCGCACAG | 8609 | AQTGAINAPAQ | 13198 | TGAINAP | 0.181162 | -0.21202 |
| SyS1960 | 4021 | GCCCAAAACGCTGTTTAAGAATGGTCCTGCACAG | 8610 | AQTLFKNGPAQ | 13199 | TLFKNGP | 0.181097 | -0.21315 |
| SyS1961 | 4022 | GCCCAAGTGGTGCCTATTTGACGAATGCACAG | 8611 | AQVVPISTNAQ | 13200 | VVPISTN | 0.181026 | -0.16344 |
| GS1140 | 4023 | GCCCAAGCAAAGGCACCGCCCTGTCGCACAG | 8612 | AQAKGTALVAQ | 13201 | AKGTALV | 0.180981 | -0.16304 |
| SyS1962 | 4024 | GCCCAAAGGGATACTGTGCAGGTGTATGCACAG | 8613 | AQRDTVQVYAQ | 13202 | RDTVQVY | 0.180851 | -0.21571 |
| GS1141 | 4025 | GCCCAACTCGGCACCAAAGCCACCCACGCACAG | 8614 | AQLGTKATHAQ | 13203 | LGTKATH | 0.180672 | -0.16125 |
| SyS1964 | 4026 | GCCCAAGACAACGTCAGAGTCACCGCCGCACAG | 8615 | AQDNVRVTAAQ | 13204 | DNVRVTA | 0.180658 | 0.019619 |
| SP40 | 4027 | GCCCAAACGAGGCCTGGGTCGCATACTGCACAG | 8616 | AQTRPGSHTAQ | 13205 | TRPGSHT | 0.180609 | -0.05314 |
| SyS1965 | 4028 | GCCCAAGCTCAGTTGGCTCCTCGTGCGGCACAG | 8617 | AQAQLAPRAAQ | 13206 | AQLAPRA | 0.180606 | -0.19846 |
| GP165 | 4029 | GCCCAATCTACTACTATGCGGACGTGCTGGCACAG | 8618 | AQSTMRTSLAQ | 13207 | STMRTSL | 0.1806 | 0.12275 |
| SP41 | 4030 | GCCCAAATGAATCAGACTTCTGCTAAGGCACAG | 8619 | AQMNQTSAKAQ | 13208 | MNQTSAK | 0.180557 | -0.05178 |
| SyS1966 | 4031 | GCCCAAAGCAGAAGCAGCCCACCATCGCACAG | 8620 | AQSRSSPTIAQ | 13209 | SRSSPTI | 0.180499 | -0.01734 |
| GS1142 | 4032 | GCCCAAAGCGCCCTCAACCAATACCCGCACAG | 8621 | AQSALNQYPAQ | 13210 | SALNQYP | 0.180451 | -0.08545 |
| GS1143 | 4033 | GCCCAAATCAGCAACCACCACCAGAAACGCACAG | 8622 | AQISTTTRNAQ | 13211 | ISTTTRN | 0.180379 | -0.13952 |
| GS1144 | 4034 | GCCCAATCTCGTGATACGCCGAGTGGTGCCACAG | 8623 | AQSRDTPSGAQ | 13212 | SRDTPSG | 0.18029 | -0.0879 |
| SyS1967 | 4035 | GCCCAAAAACTTCAACAACAAGGCCTCGCACAG | 8624 | AQNFNKQGLAQ | 13213 | NFNKQGL | 0.180248 | -0.06663 |
| SyS1968 | 4036 | GCCCAACCTAGTAATACGTCTTCGGTTGCACAG | 8625 | AQPSNTSSVAQ | 13214 | PSNTSSV | 0.180178 | -0.2231 |
| SS127 | 4037 | GCCCAAAACTGTTAGTACGAATGCGAGGGCACAG | 8626 | AQTVSTNARAQ | 13215 | TVSTNAR | 0.180153 | -0.35824 |
| GS1145 | 4038 | GCCCAAAAACATGAGCCAAACCGTCGCCGCACAG | 8627 | AQNMSQTVAAQ | 13216 | NMSQTVA | 0.180083 | -0.15766 |
| GS1146 | 4039 | GCCCAAATTGGGAAGAGTTCTACTCCTGCACAG | 8628 | AQIGKSSTPAQ | 13217 | IGKSSTP | 0.179902 | -0.11877 |
| GS1147 | 4040 | GCCCAAAGAGAGAAACCGAAACCGGCAGAGCACAG | 8629 | AQRETETGRAQ | 13218 | RETETGR | 0.179896 | -0.13189 |
| SyS1969 | 4041 | GCCCAACCTTATACTCCGCTGACTGGTGCACAG | 8630 | AQPYTPLTGAQ | 13219 | PYTPLTG | 0.179831 | -0.19496 |

FIG. 33 (Continued)

| | | | | | | | | |
|---|---|---|---|---|---|---|---|---|
| SyS1970 | 4042 | GCCCAAGCCGAATACAACACCGGCGGTCGCACAG | 8631 | AQAEYNTGVAQ | 13220 | AEYNTGV | 0.179673 | -0.16466 |
| SyS1971 | 4043 | GCCCAAGGCAGAAACGCCGAAACCAGAGCACAG | 8632 | AQGRNAETRAQ | 13221 | GRNAETR | 0.17963 | -0.04562 |
| GS1149 | 4044 | GCCCAAACGTTTAATCATACTACTGATGCACAG | 8633 | AQTFNHTTDAQ | 13222 | TFNHTTD | 0.179619 | -0.17768 |
| GS1150 | 4045 | GCCCAAACCCACCTCAGCACCCTCGGCGCACAG | 8634 | AQTHLSTLGAQ | 13223 | THLSTLG | 0.179495 | -0.06913 |
| GS1151 | 4046 | GCCCAACTTAAGGGTATTAGTCAGCATGCACAG | 8635 | AQLKGISQHAQ | 13224 | LKGISQH | 0.17936 | -0.12235 |
| SyS1974 | 4047 | GCCCAATATTCTAGTGGTATGGTATGACGGCACAG | 8636 | AQYSSGMTTAQ | 13225 | YSSGMTT | 0.17933 | -0.09037 |
| SyS1975 | 4048 | GCCCAAACGGCTATTACGATGACTAGTGCACAG | 8637 | AQTAITMTSAQ | 13226 | TAITMTS | 0.179201 | -0.00948 |
| SyS1976 | 4049 | GCCCAAAGAGGCAACGAACTCAACACCGCACAG | 8638 | AQRGNELNTAQ | 13227 | RGNELNT | 0.179161 | -0.06646 |
| SyS1977 | 4050 | GCCCAAGTCGTCAGCAGCCAAATGGCCGCACAG | 8639 | AQVVSSQMAAQ | 13228 | VVSSQMA | 0.179109 | -0.03159 |
| SyS1978 | 4051 | GCCCAACACCAACACGAAAACATGGTCGCACAG | 8640 | AQHQHENMVAQ | 13229 | HQHENMV | 0.179092 | -0.15927 |
| SyS1980 | 4052 | GCCCAAAGCTTCGGCGGCGTCCCAAAGCACAG | 8641 | AQSFGGVPKAQ | 13230 | SFGGVPK | 0.179027 | -0.08158 |
| GS1153 | 4053 | GCCCAATTGATGCGTGATAGTAAGTCTGCACAG | 8642 | AQLMRDSKSAQ | 13231 | LMRDSKS | 0.17901 | -0.11654 |
| GS1154 | 4054 | GCCCAAATGAGAAACCAACCTCAGCATGGCACAG | 8643 | AQMRTNLSMAQ | 13232 | MRTNLSM | 0.179008 | -0.17381 |
| SyS1981 | 4055 | GCCCAACCGAATAATCCTGTGGTGCCTGCACAG | 8644 | AQPNNPVVPAQ | 13233 | PNNPVVP | 0.179008 | -0.18042 |
| GP167 | 4056 | GCCCAAAGGGTTAGTCAGTCTATGGGTGCACAG | 8645 | AQRVSQSMGAQ | 13234 | RVSQSMG | 0.17897 | -0.07391 |
| SyS1982 | 4057 | GCCCAAGCTGAGGGTCCTCAGAAGACGGGCACAG | 8646 | AQAEGPQKTAQ | 13235 | AEGPQKT | 0.178923 | -0.05601 |
| SyS1983 | 4058 | GCCCAACTTAATTCTGTGGTTCATACGGCACAG | 8647 | AQLNSVVHTAQ | 13236 | LNSVVHT | 0.17892 | -0.01781 |
| GS1155 | 4059 | GCCCAACTGTTGACGTTGAATTCGGCTGCACAG | 8648 | AQLLTLNSAAQ | 13237 | LLTLNSA | 0.178886 | -0.16814 |
| SyS1985 | 4060 | GCCCAAACGCTTGCCTCCTCGGAGGGATGCACAG | 8649 | AQTLAPRRDAQ | 13238 | TLAPRRD | 0.178476 | -0.16951 |
| GS1159 | 4061 | GCCCAAAGAGTCGCCAACCCCGCCACCGCACAG | 8650 | AQRVANPATAQ | 13239 | RVANPAT | 0.178389 | -0.12177 |
| SyS1986 | 4062 | GCCCAATTGCCGGATCCTAGGTTGCAGGCACAG | 8651 | AQLPDPRLQAQ | 13240 | LPDPRLQ | 0.178351 | -0.1063 |
| SyS1987 | 4063 | GCCCAAAAAATGGACGTTCGGCGAAGCCGCACAG | 8652 | AQKMDVGEAAQ | 13241 | KMDVGEA | 0.178194 | -0.22434 |
| SyS1988 | 4064 | GCCCAAGGTCGTCTCTATGGTTATGGCACAG | 8653 | AQGPSPMVMAQ | 13242 | GPSPMVM | 0.178194 | -0.22434 |
| GS1160 | 4065 | GCCCAAGGCACCAACAAAGCCACCGCCGCACAG | 8654 | AQGTNKATAAQ | 13243 | GTNKATA | 0.178061 | -0.05206 |
| GS1161 | 4066 | GCCCAACTCAGCGCCCAGGCACCACCGCACAG | 8655 | AQLSAHGTTAQ | 13244 | LSAHGTT | 0.178024 | -0.18009 |
| GS1162 | 4067 | GCCCAAACAGCAGAGATACAACAGCCGCCGCACAG | 8656 | AQTSRYNSAAQ | 13245 | TSRYNSA | 0.177853 | -0.16663 |
| GS1989 | 4068 | GCCCAAGGCCCCAACAGCAGCTTCAAAGCACAG | 8657 | AQGPNSSFKAQ | 13246 | GPNSSFK | 0.177775 | -0.16273 |
| GS1163 | 4069 | GCCCAAAGTGTTGGGAGGGCTCCGATTGCACAG | 8658 | AQSVGRAPIAQ | 13247 | SVGRAPI | 0.177653 | -0.14715 |
| SyS1990 | 4070 | GCCCAATTTCAGGGTGAGAAGACGTGGGCACAG | 8659 | AQFQGEKTWAQ | 13248 | FQGEKTW | 0.177633 | -0.06462 |
| SyS1991 | 4071 | GCCCAAACCAGCAGCGCCAGAACCATCGCACAG | 8660 | AQTSSARTIAQ | 13249 | TSSARTI | 0.177546 | -0.07616 |
| SyS1992 | 4072 | GCCCAAGCTGAGCGTACTGGGACTGCGGCACAG | 8661 | AQAERTGTAAQ | 13250 | AERTGTA | 0.177482 | -0.16643 |
| GS1164 | 4073 | GCCCAACTCAACCTCGGCACCCCCAAAGCACAG | 8662 | AQLNLGTPKAQ | 13251 | LNLGTPK | 0.177441 | -0.17672 |

FIG. 33 (Continued)

| | | | | | | | | |
|---|---|---|---|---|---|---|---|---|
| GP168 | 4074 | GCCCAAGCTGCGCCGGTTGGGTCTAGGGCACAG | 8663 | AQAAPVGSRAQ | 13252 | AAPVGSR | 0.177438 | 0.019689 |
| GS1165 | 4075 | GCCCAAATGAGACAAGCCAACCACCCGCACAG | 8664 | AQMRQANHPAQ | 13253 | MRQANHP | 0.177418 | -0.10804 |
| SyS1993 | 4076 | GCCCAAGCAGCAGCAGGCGGTGATGTGCTGGCACAG | 8665 | AQEQQRDVLAQ | 13254 | EQQRDVL | 0.177373 | -0.18368 |
| SyS1994 | 4077 | GCCCAACCCAAAAGCGACGAACTCACCGCACAG | 8666 | AQPKSDELTAQ | 13255 | PKSDELT | 0.177331 | -0.23173 |
| SyS1995 | 4078 | GCCCAAAATGCTCGTGTTCAGGAGACTGCACAG | 8667 | AQNARVQETAQ | 13256 | NARVQET | 0.177294 | 0.036888 |
| SyS1996 | 4079 | GCCCAAACTACGGTTGCTACTCAGTCGGCACAG | 8668 | AQTTVATQSAQ | 13257 | TTVATQS | 0.177266 | -0.08132 |
| SyS1997 | 4080 | GCCCAAACCGAAGTCAGCCACAGACCGGCACAG | 8669 | AQTEVSHRPAQ | 13258 | TEVSHRP | 0.177079 | -0.13314 |
| SyS1998 | 4081 | GCCCAAAGCAGCACCGTCAAAAACGTCGGCACAG | 8670 | AQSSTVKNVAQ | 13259 | SSTVKNV | 0.177072 | 0.041757 |
| SyS1999 | 4082 | GCCCAAAATCGACAGCCACCTCAACAGAGCACAG | 8671 | AQIDSHLNRAQ | 13260 | IDSHLNR | 0.176954 | -0.05133 |
| SyS2000 | 4083 | GCCCAAGGTTCGACTCAGCTGAGTCTGGCACAG | 8672 | AQGSTQLSLAQ | 13261 | GSTQLSL | 0.17695 | -0.03737 |
| GS1170 | 4084 | GCCCAAGACGGGCAGCCCGCCACCAAAGCACAG | 8673 | AQDGSPATKAQ | 13262 | DGSPATK | 0.17691 | -0.18637 |
| SyS2001 | 4085 | GCCCAACAAACCGGCAACAGCCAAGCCGCACAG | 8674 | AQQTGNSQAAQ | 13263 | QTGNSQA | 0.176685 | -0.02351 |
| SyS2002 | 4086 | GCCCAAAGACAAGAGCGTCAACGTCAGCGCACAG | 8675 | AQRQDVNVSAQ | 13264 | RQDVNVS | 0.176645 | -0.22187 |
| GS1172 | 4087 | GCCCAACTCGACTACGGCGGTCAAAAGCGCACAG | 8676 | AQLDYGVKSAQ | 13265 | LDYGVKS | 0.176625 | -0.01607 |
| SyS2003 | 4088 | GCCCAAGGTTCTCGTCCTGAGGCGCCGGCACAG | 8677 | AQGSRPEAPAQ | 13266 | GSRPEAP | 0.176327 | -0.1489 |
| SyS2004 | 4089 | GCCCAATGGAGCAACATGACCGCCGCCGCACAG | 8678 | AQWSNMTAAAQ | 13267 | WSNMTAA | 0.176285 | 0.188706 |
| GP171 | 4090 | GCCCAAACTAATACTACTCGGATTTCTGCACAG | 8679 | AQTNTTRISAQ | 13268 | TNTTRIS | 0.176104 | 0.234131 |
| SyS2007 | 4091 | GCCCAACCTTATGCGGAGAGGCAGGCTGCACAG | 8680 | AQPYAERQAAQ | 13269 | PYAERQA | 0.175875 | -0.12869 |
| SyS2008 | 4092 | GCCCAAACCAGCAGCGCCACCGTCCTCGCACAG | 8681 | AQTSSATVLAQ | 13270 | TSSATVL | 0.175872 | -0.08332 |
| SyS2009 | 4093 | GCCCAAGCGCAGACTGATTTTAGGCAGGCACAG | 8682 | AQAQTDFRQAQ | 13271 | AQTDFRQ | 0.175789 | -0.17557 |
| GS1173 | 4094 | GCCCAAAACAGCGGCAACGAACAGCAGCGCACAG | 8683 | AQNSGNEHSAQ | 13272 | NSGNEHS | 0.175772 | -0.17919 |
| SyS2010 | 4095 | GCCCAAAAAGCCGCTGATTAATGCTACTGCACAG | 8684 | AQKPLINATAQ | 13273 | KPLINAT | 0.175674 | -0.17193 |
| SyS2011 | 4096 | GCCCAAATGGGGAGTTCGTCGGCGTTTGCACAG | 8685 | AQMGSSSAFAQ | 13274 | MGSSSAF | 0.175674 | -0.17193 |
| GS1174 | 4097 | GCCCAAATTGGTAATAAGACGAGTCTGGCACAG | 8686 | AQIGNKTSLAQ | 13275 | IGNKTSL | 0.175642 | -0.13523 |
| SyS2012 | 4098 | GCCCAAGCGCCACACCGCCCCAAAGCACAG | 8687 | AQAANTAPKAQ | 13276 | AANTAPK | 0.17558 | -0.10142 |
| GS1175 | 4099 | GCCCAACTCGTCGACCAAAGAGCCACGGCACAG | 8688 | AQLVDQRATAQ | 13277 | LVDQRAT | 0.175514 | -0.1774 |
| SyS2015 | 4100 | GCCCAACAAGTCAAACTCGGCAGCACCGCACAG | 8689 | AQQVKLGSTAQ | 13278 | QVKLGST | 0.175457 | -0.21315 |
| GS1176 | 4101 | GCCCAACTCACCAGCAACACCCACGTCGCACAG | 8690 | AQLTSNTHVAQ | 13279 | LTSNTHV | 0.175385 | -0.05777 |
| GS1177 | 4102 | GCCCAAGTCTACAGCGCCATCAACAAAGCACAG | 8691 | AQVYSAINKAQ | 13280 | VYSAINK | 0.175251 | -0.17386 |
| SyS2017 | 4103 | GCCCAAAGAGCCAACGGCAGCGACCTCGCACAG | 8692 | AQRANGSDLAQ | 13281 | RANGSDL | 0.17502 | 0.012701 |
| SyS2018 | 4104 | GCCCAAAACCTCAAAAGCCAAACCGAAGCACAG | 8693 | AQNLKSQTEAQ | 13282 | NLKSQTE | 0.174966 | -0.12454 |
| SyS2019 | 4105 | GCCCAAAGCTACGGCAACGAAATCAGAGAGCACAG | 8694 | AQSYGNEIRAQ | 13283 | SYGNEIR | 0.174809 | 0.068074 |

FIG. 33 (Continued)

| | | | | | | | | |
|---|---|---|---|---|---|---|---|---|
| SyS2020 | 4106 | GCCCAACTCACCAGAGGGCGGCCATCGGCGCACAG | 8695 | AQLTRGAIGAQ | 13284 | LTRGAIG | 0.174654 | -0.13192 |
| GS1178 | 4107 | GCCCAACCCATCAGAACCGTCGACACCGCACAG | 8696 | AQPIRTVDTAQ | 13285 | PIRTVDT | 0.174634 | -0.12446 |
| SyS2021 | 4108 | GCCCAACGGAGTATGCCTGATGGTTCGGCACAG | 8697 | AQRSMPDGSAQ | 13286 | RSMPDGS | 0.174629 | -0.18769 |
| GS1179 | 4109 | GCCCAAACCGCCCACACCGGCCCCCTCGCACAG | 8698 | AQTAHTGPLAQ | 13287 | TAHTGPL | 0.174581 | -0.15288 |
| SP42 | 4110 | GCCCAATCGCAGGGGAGTCCGCTTTCGGCACAG | 8699 | AQSQGSPLSAQ | 13288 | SQGSPLS | 0.174469 | -0.0526 |
| SyS2022 | 4111 | GCCCAACTCCAAGCCATCGCCCACAGCGCACAG | 8700 | AQLQAIAHSAQ | 13289 | LQAIAHS | 0.174346 | -0.17678 |
| SyS2024 | 4112 | GCCCAAGGCAACAGCCTCAGCACCAGCGCACAG | 8701 | AQGNSLSTSAQ | 13290 | GNSLSTS | 0.174173 | -0.2268 |
| GS1180 | 4113 | GCCCAACTCACCCACAGAGAAGCCGAAGCACAG | 8702 | AQLTHREAFAQ | 13291 | LTHREAF | 0.174167 | -0.06761 |
| GS1181 | 4114 | GCCCAAACGTTGCATCTGGCGAAGGAGGCACAG | 8703 | AQTLHLAKEAQ | 13292 | TLHLAKE | 0.174141 | -0.16663 |
| GS1182 | 4115 | GCCCAAAAACATCAGCAGCAGGGCAAAGCACAG | 8704 | AQNISSSGKAQ | 13293 | NISSSGK | 0.174056 | -0.08647 |
| SyS2026 | 4116 | GCCCAAGGCAGACACATGGTCATGGAAGCACAG | 8705 | AQGRHMVMEAQ | 13294 | GRHMVME | 0.173999 | -0.09555 |
| GS1183 | 4117 | GCCCAAGGTGAGAGGTTTGGGGGGCCTGCACAG | 8706 | AQGERFGGPAQ | 13295 | GERFGGP | 0.173807 | -0.18009 |
| SyS2027 | 4118 | GCCCAATATAGTGGGTCTTCTACTAAGGCACAG | 8707 | AQYSGSSTKAQ | 13296 | YSGSSTK | 0.173744 | -0.09789 |
| SyS2028 | 4119 | GCCCAAAAGGAGTCTGTTAGTGCGAATGCACAG | 8708 | AQKESVSANAQ | 13297 | KESVSAN | 0.173712 | -0.006 |
| SyS2030 | 4120 | GCCCAAATTACGAGTGATGGGAAGCCGGCACAG | 8709 | AQITSDGKPAQ | 13298 | ITSDGKP | 0.173449 | 0.031329 |
| SyS2031 | 4121 | GCCCAAGGTCATGATGCGCGTGTGGTTGCACAG | 8710 | AQGHDARVVAQ | 13299 | GHDARVV | 0.173427 | 0.011182 |
| SyS2032 | 4122 | GCCCAAACCAGCAGCAACGGCGTCAGAGCACAG | 8711 | AQTSSNGVRAQ | 13300 | TSSNGVR | 0.173427 | 0.042989 |
| GS1184 | 4123 | GCCCAAAATCATCAGAATCGGTCTTTGGCACAG | 8712 | AQNHQNRSLAQ | 13301 | NHQNRSL | 0.173427 | -0.18245 |
| GS1185 | 4124 | GCCCAACGGGTTCCGGAGCAGAATGTGGCACAG | 8713 | AQRVPEQNVAQ | 13302 | RVPEQNV | 0.173385 | -0.18054 |
| GS1186 | 4125 | GCCCAAAGCGCCCAACTCAGAAGCAGCGCACAG | 8714 | AQSAQLRSSAQ | 13303 | SAQLRSS | 0.173344 | -0.17863 |
| GS1187 | 4126 | GCCCAACACGCCAAAAGCGAAACCTACGCACAG | 8715 | AQHAKSETYAQ | 13304 | HAKSETY | 0.173305 | -0.17672 |
| SyS2033 | 4127 | GCCCAACTCCTCACCCAAGTCGAAACGCACAG | 8716 | AQLLTQVETAQ | 13305 | LLTQVET | 0.173298 | -0.12503 |
| SyS2034 | 4128 | GCCCAAACCAAACCGCCGACACCTACGCACAG | 8717 | AQTKTADTYAQ | 13306 | TKTADTY | 0.173226 | 0.171999 |
| SyS2035 | 4129 | GCCCAAGTTATGCCTGCTACGTTGAGTGCACAG | 8718 | AQVMPATLSAQ | 13307 | VMPATLS | 0.173152 | -0.19254 |
| GS1188 | 4130 | GCCCAATACCAAGCCAACAACCTCATCGCACAG | 8719 | AQYQANNLIAQ | 13308 | YQANNLI | 0.17301 | -0.15955 |
| SyS2036 | 4131 | GCCCAAGTCAGAGTCCCGACAGCAGCGCACAG | 8720 | AQVRVPDSSAQ | 13309 | VRVPDSS | 0.172979 | -0.09411 |
| SyS2037 | 4132 | GCCCAACACCAACCGGCAGCGGCTTCGCACAG | 8721 | AQHQTGSGFAQ | 13310 | HQTGSGF | 0.172861 | -0.04462 |
| SyS2038 | 4133 | GCCCAAAGTGCTACGTTGAGTGGGTATGCACAG | 8722 | AQSATLSGYAQ | 13311 | SATLSGY | 0.172673 | -0.16344 |
| GS1189 | 4134 | GCCCAAAATGGTTCTGCGACCACCTACGCACAG | 8723 | AQNGSATYSAQ | 13312 | NGSATYS | 0.172618 | 0.021489 |
| GS1190 | 4135 | GCCCAAAGCACCAGACCCTCACCGCACAG | 8724 | AQSTRPTLTAQ | 13313 | STRPTLT | 0.172526 | -0.15048 |
| SyS2039 | 4136 | GCCCAAAGACCCGCGACGTCAGCCAAGCACAG | 8725 | AQRPADVSQAQ | 13314 | RPADVSQ | 0.172441 | -0.14526 |
| GS1191 | 4137 | GCCCAAAGCCACCTCAGCAGCACCGGCGCACAG | 8726 | AQSHLSSTGAQ | 13315 | SHLSSTG | 0.172433 | -0.18637 |

FIG. 33 (Continued)

| | | | | | | | | |
|---|---|---|---|---|---|---|---|---|
| GS1192 | 4138 | GCCCAAGCTAATCAGTCTTATGATCGGGCACAG | 8727 | AQANQSYDRAQ | 13316 | ANQSYDR | 0.172433 | -0.18637 |
| SyS2040 | 4139 | GCCCAAAGCAGCGGCGACAGAACCGCGCACAG | 8728 | AQSSGDRTAAQ | 13317 | SSGDRTA | 0.172372 | -0.21448 |
| SyS2041 | 4140 | GCCCAAAGGCAGCGGTCCCGGCTCAACGCACAG | 8729 | AQGSVPGLNAQ | 13318 | GSVPGLN | 0.172134 | -0.22803 |
| SyS2043 | 4141 | GCCCAACTCGTCACCATCCACAGCGCCGCACAG | 8730 | AQLVTIHSAAQ | 13319 | LVTIHSA | 0.171906 | -0.22285 |
| SyS2044 | 4142 | GCCCAACCTCAGCATGAGACTACGCTGGCACAG | 8731 | AQPQHETTLAQ | 13320 | PQHETTL | 0.171807 | -0.21557 |
| SyS2046 | 4143 | GCCCAACCGACGAGAGTCGGCGCAGTATGCACAG | 8732 | AQPTKSAQYAQ | 13321 | PTKSAQY | 0.171667 | -0.11931 |
| GS1194 | 4144 | GCCCAAAAAAGACCCCGTCCTCGGCGCACACAG | 8733 | AQKKDPVLGAQ | 13322 | KKDPVLG | 0.171636 | -0.17919 |
| SyS2047 | 4145 | GCCCAATTTAGGGTTGGTCCGTCTGCTGCACAG | 8734 | AQFRVGPSAAQ | 13323 | FRVGPSA | 0.171598 | -0.19739 |
| SyS2048 | 4146 | GCCCAAACCAGCAGCGGCCACGCCGTCGCACAG | 8735 | AQTSSGHAVAQ | 13324 | TSSGHAV | 0.17151 | -0.12824 |
| SyS2049 | 4147 | GCCCAACGTGTTGGTGAGGCTAGGATGGCACAG | 8736 | AQRVGEARMAQ | 13325 | RVGEARM | 0.171462 | -0.18284 |
| SyS2050 | 4148 | GCCCAACGTGTTACGTCGCCTTCTAAGGCACAG | 8737 | AQRVTSPSKAQ | 13326 | RVTSPSK | 0.171402 | -0.17557 |
| SyS2051 | 4149 | GCCCAAGATAGGATGCCTTCTACGATTGCACAG | 8738 | AQDRMPSTIAQ | 13327 | DRMPSTI | 0.171373 | -0.17193 |
| SyS2052 | 4150 | GCCCAACAAGGGCGACACCAGCAGACACGCACAG | 8739 | AQQGDTSKHAQ | 13328 | QGDTSKH | 0.171295 | -0.16102 |
| GS1195 | 4151 | GCCCAAAGCACCAGCAGCAACAGAGCCGCACAG | 8740 | AQSTSSNRAAQ | 13329 | STSSNRA | 0.171266 | -0.12044 |
| GS1196 | 4152 | GCCCAAAAGGTGCCTACGGGTTATACGGCACAG | 8741 | AQKVPTGYTAQ | 13330 | KVPTGYT | 0.171266 | -0.14334 |
| SyS2053 | 4153 | GCCCAATTCAAAGGCCAAAGAAACGACGCACAG | 8742 | AQFKGQRNDAQ | 13331 | FKGQRND | 0.171225 | -0.15011 |
| SyS2055 | 4154 | GCCCAAGGTAATCATTTGGGGAATGAGGCACAG | 8743 | AQGNHLGNEAQ | 13332 | GNHLGNE | 0.170544 | -0.18245 |
| SyS2056 | 4155 | GCCCAAGCAGCAGCAAAGCTTCGAACTCGCACAG | 8744 | AQASKSFELAQ | 13333 | ASKSFEL | 0.170464 | -0.08466 |
| SyS2057 | 4156 | GCCCAAACCGTCAGAGACACCACCAGAGCACAG | 8745 | AQTVRDTTRAQ | 13334 | TVRDTTR | 0.170442 | 0.262057 |
| GS1199 | 4157 | GCCCAAAAGGTTAGTCGAATACTCTTGCACAG | 8746 | AQKVSPNTLAQ | 13335 | KVSPNTL | 0.170349 | -0.16484 |
| GS1201 | 4158 | GCCCAAGGCAGAACCCCGAAAGCTACGCACAG | 8747 | AQGRTPESYAQ | 13336 | GRTPESY | 0.16998 | -0.18368 |
| SyS2058 | 4159 | GCCCAACAGGTGTCGGGGGTTAGGACGGCACAG | 8748 | AQQVSGVRTAQ | 13337 | QVSGVRT | 0.169959 | -0.11859 |
| SyS2059 | 4160 | GCCCAATACACCGGCATCAGCACCAGCGCACAG | 8749 | AQYTGISTSAQ | 13338 | YTGISTS | 0.169959 | -0.13314 |
| SyS2060 | 4161 | GCCCAACAAACGCGAACCCACAAAGCACAG | 8750 | AQQTAEPHKAQ | 13339 | QTAEPHK | 0.169959 | -0.16223 |
| SyS2061 | 4162 | GCCCAACTTGGTCCTGTGGGTTCTCCGGCACAG | 8751 | AQLGPVGSPAQ | 13340 | LGPVGSP | 0.169959 | -0.16587 |
| SyS2062 | 4163 | GCCCAAGCCAGAGACGACGACACCGACGCACAG | 8752 | AQARDDSTDAQ | 13341 | ARDDSTD | 0.169959 | -0.22042 |
| SyS2063 | 4164 | GCCCAAAATTTTAAGCATAGTGAGGTGGCACAG | 8753 | AQNFKHSEVAQ | 13342 | NFKHSEV | 0.169959 | -0.22042 |
| GS1202 | 4165 | GCCCAAATTACTACTCCTCTGCAGGCGGCACAG | 8754 | AQITTPLQAAQ | 13343 | ITTPLQA | 0.169823 | -0.18188 |
| SyS2066 | 4166 | GCCCAACCCATGAGCAGCAGAGAAAGAGCACAG | 8755 | AQPMSSRERAQ | 13344 | PMSSRER | 0.169722 | -0.10113 |
| GS1204 | 4167 | GCCCAAGTCGAAAAACGGCAAAGGCCTCGCACAG | 8756 | AQVENGKGLAQ | 13345 | VENGKGL | 0.169651 | -0.13239 |
| SyS2067 | 4168 | GCCCAAACCAGCAACAGCCTCGCCGCACAG | 8757 | AQTSNSGLAAQ | 13346 | TSNSGLA | 0.169432 | -0.02428 |
| SyS2068 | 4169 | GCCCAAGGCAACAGCCTGCCAACCCCGCACAG | 8758 | AQGNSLANPAQ | 13347 | GNSLANP | 0.169287 | -0.15041 |

FIG. 33 (Continued)

| | | | | | | | | |
|---|---|---|---|---|---|---|---|---|
| SS131 | 4170 | GCCCAAGCCAGCAACGAAGCCCACGCCGCACAG | 8759 | AQASNEAHAAQ | 13348 | ASNEAHA | 0.169245 | -0.37022 |
| GS1207 | 4171 | GCCCAAGGCCTCGCCGCGCAGCACCCCGCACAG | 8760 | AQGLAGSTPAQ | 13349 | GLAGSTP | 0.169127 | -0.18245 |
| SyS2069 | 4172 | GCCCAAGTCCCGCCCCCGGCAGATACGCACAG | 8761 | AQVPAPGRYAQ | 13350 | VPAPGRY | 0.169081 | -0.19353 |
| GS1208 | 4173 | GCCCAAGCCAGCGACAGACTCATCGCCGCACAG | 8762 | AQASDRLIAAQ | 13351 | ASDRLIA | 0.168842 | -0.14151 |
| GS1209 | 4174 | GCCCAAATCAGCACCTGGCAAACCCAAGCACAG | 8763 | AQISTWQTQAQ | 13352 | ISTWQTQ | 0.168829 | -0.1447 |
| SyS2070 | 4175 | GCCCAAATCACCAGCGGCGCCACCGTCGCACAG | 8764 | AQITSGATVAQ | 13353 | ITSGATV | 0.168795 | -0.1344 |
| GS1210 | 4176 | GCCCAACTTGCGAAGGCGAGTAATGTTGCACAG | 8765 | AQLAKASNVAQ | 13354 | LAKASNV | 0.168765 | -0.10613 |
| SyS2071 | 4177 | GCCCAACCGCGAGGGGACGTTTGGGAGTGCACAG | 8766 | AQPQGTFGSAQ | 13355 | PQGTFGS | 0.168707 | -0.1489 |
| SyS2072 | 4178 | GCCCAAATTGTTCGGCGCCGAATAGTGCACAG | 8767 | AQIVRPPNSAQ | 13356 | IVRPPNS | 0.168685 | -0.15253 |
| SyS2073 | 4179 | GCCCAAACCAGCCACCTCACCAGCGCCGCACAG | 8768 | AQTSHLTSAAQ | 13357 | TSHLTSA | 0.16862 | -0.07746 |
| SyS2075 | 4180 | GCCCAACTCCACCCGAAACCATGAGAGCACAG | 8769 | AQLHPETMRAQ | 13358 | LHPETMR | 0.168589 | -0.16708 |
| SyS2076 | 4181 | GCCCAAGTCCTCCACGACACCAGATACGCACAG | 8770 | AQVLHDTRYAQ | 13359 | VLHDTRY | 0.168547 | -0.14967 |
| SS132 | 4182 | GCCCAAGTCAGCAACACCCCCCAGAGGCGCACAG | 8771 | AQVSNPPRGAQ | 13360 | VSNPPRG | 0.168542 | -0.36117 |
| GS1211 | 4183 | GCCCAAGAGCCTCTGATGACTAGGCCTGCACAG | 8772 | AQEPLMTRPAQ | 13361 | EPLMTRP | 0.168414 | -0.16214 |
| GS1212 | 4184 | GCCCAAGACAGAGTCAGCAGCCACGCACAG | 8773 | AQDRVSSSHAQ | 13362 | DRVSSSH | 0.168392 | 0.004781 |
| GP175 | 4185 | GCCCAAACTAAGACTGGTCATTCGAGTGCACAG | 8774 | AQTKTGHSSAQ | 13363 | TKTGHSS | 0.168367 | -0.07287 |
| GS1213 | 4186 | GCCCAATGCTGTCTATTCTCCTGTTACTGCACAG | 8775 | AQSSYSPVTAQ | 13364 | SSYSPVT | 0.168316 | -0.08904 |
| GS1214 | 4187 | GCCCAAAAACCAACCTCCAAAACAACGCACAG | 8776 | AQKPNLQNNAQ | 13365 | KPNLQNN | 0.168309 | -0.10113 |
| SyS2077 | 4188 | GCCCAACTCAAAAGCCCCCCGGCATCGCACAG | 8777 | AQLKSPPGIAQ | 13366 | LKSPPGI | 0.168269 | -0.20345 |
| SyS2078 | 4189 | GCCCAAGGGATGCAGCTGGGGATGCCGGCACAG | 8778 | AQGMQLGMPAQ | 13367 | GMQLGMP | 0.168244 | -0.00148 |
| SyS2079 | 4190 | GCCCACACATCAGGCGAATCTTACGTTGGCACAG | 8779 | AQHQANLTLAQ | 13368 | HQANLTL | 0.168142 | -0.21436 |
| GS1215 | 4191 | GCCCAAACTGGTCATCCTACGACTGCGGCACAG | 8780 | AQTGHPTTAAQ | 13369 | TGHPTTA | 0.168138 | -0.09841 |
| GS1216 | 4192 | GCCCAATTCATCGGCAGCCACCTCGGCGCACAG | 8781 | AQFIGSHLGAQ | 13370 | FIGSHLG | 0.168096 | -0.14906 |
| SyS2081 | 4193 | GCCCAAAGGAATGAGAGGAGTAATGGGCGGCACAG | 8782 | AQRNESNGPAQ | 13371 | RNESNGP | 0.167998 | -0.2305 |
| SyS2082 | 4194 | GCCCAAAAGATTGAGACGAATGGTAATGCACAG | 8783 | AQKIETNGNAQ | 13372 | KIETNGN | 0.167998 | -0.21078 |
| SyS2083 | 4195 | GCCCAATATCTTCAGAATGGTGTTGTTGCACAG | 8784 | AQYLQNGVVAQ | 13373 | YLQNGVV | 0.167795 | -0.04255 |
| SyS2084 | 4196 | GCCCAAAGACCCGGCATGCTCGGCACCGCACAG | 8785 | AQRPGMLGTAQ | 13374 | RPGMLGT | 0.167685 | -0.12829 |
| SyS2085 | 4197 | GCCCAATTGACGCAGATTGGGACTGCTGCACAG | 8786 | AQLTQIGTAAQ | 13375 | LTQIGTA | 0.167589 | -0.03508 |
| GS1218 | 4198 | GCCCAAAACGAAGACGTCCAAAGAGCCGCACAG | 8787 | AQNEDVQRAAQ | 13376 | NEDVQRA | 0.1675 | -0.13213 |
| SyS2086 | 4199 | GCCCAACATTTGGCTGATCAGAGTCGTGCACAG | 8788 | AQHLADQSRAQ | 13377 | HLADQSR | 0.167422 | -0.00573 |
| SyS2087 | 4200 | GCCCAATTGGGTAATGATACGGTGAGGGCACAG | 8789 | AQLGNDTVRAQ | 13378 | LGNDTVR | 0.167404 | -0.15374 |
| SyS2091 | 4201 | GCCCAAAAACAACCACCACGTCCCCCCGCACAG | 8790 | AQNNHHVPPAQ | 13379 | NNHHVPP | 0.167167 | 0.019492 |

FIG. 33 (Continued)

| | | | | | | | | |
|---|---|---|---|---|---|---|---|---|
| GS1220 | 4202 | GCCCAAGACAAAGCCGGCACCCTCAGCGGCACAG | 8791 | AQDKAGTLSAQ | 13380 | DKAGTLS | 0.167139 | -0.12171 |
| SyS2093 | 4203 | GCCCAACGTACTAAGAGAATGAGTCGATGGCACAG | 8792 | AQRTKNESMAQ | 13381 | RTKNESM | 0.167044 | -0.1792 |
| SyS2094 | 4204 | GCCCAATTTAATGTTGTGCGTGGTGATGGCACAG | 8793 | AQFNVVRGDAQ | 13382 | FNVVRGD | 0.167044 | -0.1792 |
| SyS2095 | 4205 | GCCCAAATCGTCAGAGAGGCATGAACCAAGCACAG | 8794 | AQIVRGMNQAQ | 13383 | IVRGMNQ | 0.166951 | -0.18861 |
| SyS2096 | 4206 | GCCCAACAACACACCCCACCCTCAACGCACAG | 8795 | AQQHTPTLNAQ | 13384 | QHTPTLN | 0.166887 | -0.19846 |
| GS1222 | 4207 | GCCCAAAGCCTCGGCAAAGAACCCCTCGCACAG | 8796 | AQSLGKEPLAQ | 13385 | SLGKEPL | 0.166818 | -0.16484 |
| SyS2097 | 4208 | GCCCAAAGCAGCAGCGGCCTCAACGCACAG | 8797 | AQSSGHGLNAQ | 13386 | SSGHGLN | 0.166803 | 0.1418 |
| GS1223 | 4209 | GCCCAACGGATTAATAGTGATTCTACTGCACAG | 8798 | AQRINSDSTAQ | 13387 | RINSDST | 0.16679 | -0.12903 |
| SyS2098 | 4210 | GCCCAAAATCCGCATAATCATCCTGTTGCACAG | 8799 | AQNPHNHPVAQ | 13388 | NPHNHPV | 0.166789 | -0.19375 |
| SyS2100 | 4211 | GCCCAATCGCATAAGCCGTCGACGGTTGCACAG | 8800 | AQSHKPSTVAQ | 13389 | SHKPSTV | 0.166718 | -0.19739 |
| SyS2101 | 4212 | GCCCAAAGCAGCATGAGCCACCTACGCACAG | 8801 | AQSSMSTTYAQ | 13390 | SSMSTTY | 0.166718 | -0.19739 |
| SyS2102 | 4213 | GCCCAAGGTGCTGCTGTCTTCTAATCCTGCACAG | 8802 | AQGAAASNPAQ | 13391 | GAAASNP | 0.166693 | -0.11859 |
| GS1224 | 4214 | GCCCAAATGAACCAAAGAGAACAAAAAGCACAG | 8803 | AQMNQREQKAQ | 13392 | MNQREQK | 0.166658 | -0.16125 |
| SyS2103 | 4215 | GCCCAATCGTATCCTAGTAATCCGGGGCACAG | 8804 | AQSYPSNPRAQ | 13393 | SYPSNPR | 0.166484 | -0.2083 |
| SyS2104 | 4216 | GCCCAACTGCGTGATTTTGTGACTGATGCACAG | 8805 | AQLRDFVTDAQ | 13394 | LRDFVTD | 0.166484 | -0.2083 |
| GS1225 | 4217 | GCCCAAAACAACACCGTCATGAGAAGCGCACAG | 8806 | AQNNTVMRSAQ | 13395 | NNTVMRS | 0.166403 | 0.078355 |
| SyS2105 | 4218 | GCCCAACTCAGCCCAGAAAATACATCGCACAG | 8807 | AQLSPRKYIAQ | 13396 | LSPRKYI | 0.166309 | -0.21557 |
| SyS2106 | 4219 | GCCCAACACATCAGACCCCAGCCCGGCACAG | 8808 | AQHIRPPSPAQ | 13397 | HIRPPSP | 0.166309 | -0.21557 |
| SyS2107 | 4220 | GCCCAACCTTATGTGTCGACTACTGCGGCACAG | 8809 | AQPYVSTTAAQ | 13398 | PYVSTTA | 0.166295 | -0.20216 |
| SyS2108 | 4221 | GCCCAAGTCAACCACGGCAGCCCACCGCACAG | 8810 | AQVNHGSPTAQ | 13399 | VNHGSPT | 0.166263 | -0.07616 |
| SyS2109 | 4222 | GCCCAAAGTGGTTATCTTAATGGTGCGGCACAG | 8811 | AQSGYLNGAAQ | 13400 | SGYLNGA | 0.166181 | -0.21202 |
| SyS2110 | 4223 | GCCCAAAGTCGGGAGAGACGTCTGATGCACAG | 8812 | AQSRERTSDAQ | 13401 | SRERTSD | 0.166115 | -0.01918 |
| GS1227 | 4224 | GCCCAAACCCACAGCGTCACCAGAAGCGCACAG | 8813 | AQTHSVTRSAQ | 13402 | THSVTRS | 0.166033 | -0.10592 |
| GS1228 | 4225 | GCCCAACTTGTTGCGAATAAGAATGGGGCACAG | 8814 | AQLVANKNAAQ | 13403 | LVANKNA | 0.16597 | -0.12426 |
| GS1229 | 4226 | GCCCAAAATTTTACGGATCGTGCTACTGCACAG | 8815 | AQNFTDRATAQ | 13404 | NFTDRAT | 0.165948 | -0.16337 |
| SyS2111 | 4227 | GCCCAATATAGGACGAGTACTTTGGCGGCACAG | 8816 | AQYRTSTLAAQ | 13405 | YRTSTLA | 0.165933 | -0.09069 |
| GS1230 | 4228 | GCCCAACACGTCATGAACAAACAAGCCGCACAG | 8817 | AQHVMNKQAAQ | 13406 | HVMNKQA | 0.165928 | -0.14151 |
| SyS2112 | 4229 | GCCCAAGCCACCAACACCCGCACCGGCACAG | 8818 | AQATNNPASAQ | 13407 | ATNNPAS | 0.1659 | -0.23012 |
| SyS2113 | 4230 | GCCCAAACCATCATGAAAGCCCAAACCGCACAG | 8819 | AQTIMKAQTAQ | 13408 | TIMKAQT | 0.1659 | 0.100294 |
| SyS2114 | 4231 | GCCCAAGGCATGAGCACCATGACCCCGCACAG | 8820 | AQGMSTMTPAQ | 13409 | GMSTMTP | 0.165745 | -0.07802 |
| GS1231 | 4232 | GCCCAAGGCACCCCATCTACAAACAAGCACAG | 8821 | AQGTPIYKQAQ | 13410 | GTPIYKQ | 0.165686 | -0.18188 |
| SyS2115 | 4233 | GCCCAAAATGGTACGTTGGAGAAGGGCGGCACAG | 8822 | AQNGTLEKAAQ | 13411 | NGTLEKA | 0.165659 | -0.05555 |

FIG. 33 (Continued)

| | | | | | | | | |
|---|---|---|---|---|---|---|---|---|
| SyS2116 | 4234 | GCCCAAAGCAACGAAAGAACCATCCCGCACAG | 8823 | AQSNERTIPAQ | 13412 | SNERTIP | 0.165594 | -0.1198 |
| SyS2117 | 4235 | GCCCAAATTCCGGTGTCTATTCAGGCTGCACAG | 8824 | AQIPVSIQAAQ | 13413 | IPVSIQA | 0.165516 | -0.17998 |
| SyS2118 | 4236 | GCCCAAAACCTCAAAGAGAAGGCCCGCACAG | 8825 | AQNLQREGPAQ | 13414 | NLQREGP | 0.165401 | -0.00546 |
| GS1234 | 4237 | GCCCAAGGGAGGGTGGTAAGTCTAATGCACAG | 8826 | AQGEGGKSNAQ | 13415 | GEGGKSN | 0.165262 | -0.17672 |
| SyS2119 | 4238 | GCCCAATTGCAGGGTAATGGGAGGAATGCACAG | 8827 | AQLQGNGRNAQ | 13416 | LQGNGRN | 0.165238 | -0.13798 |
| GS1236 | 4239 | GCCCAACTCGTCAGCAGCACCAGCGAAGCACAG | 8828 | AQLVSSTSEAQ | 13417 | LVSSTSE | 0.165149 | -0.17863 |
| SyS2120 | 4240 | GCCCAAAGCCTCGCCGGCAACACCACCGCACAG | 8829 | AQSLAGNTTAQ | 13418 | SLAGNTT | 0.165128 | -0.11547 |
| SyS2122 | 4241 | GCCCAATTGACTGTTGGTAATAATGTGGCACAG | 8830 | AQLTVGNNVAQ | 13419 | LTVGNNV | 0.164995 | -0.1489 |
| SyS2123 | 4242 | GCCCAAAGCATCCTCACCAGAGACAGGCACAG | 8831 | AQSILTRDSAQ | 13420 | SILTRDS | 0.164909 | -0.15253 |
| SyS2124 | 4243 | GCCCAAGTTCTTGTTGATTCGCGTGCGGCACAG | 8832 | AQVLVDSRAAQ | 13421 | VLVDSRA | 0.164849 | -0.20588 |
| SyS2125 | 4244 | GCCCAAGGCGTCGCCAGCACCACCGCACAG | 8833 | AQGVASTTTAQ | 13422 | GVASTTT | 0.164819 | -0.15617 |
| SyS2126 | 4245 | GCCCAACACGGCGCCAACCTCAGCGTCGCACAG | 8834 | AQHGANLSVAQ | 13423 | HGANLSV | 0.164788 | -0.05676 |
| SyS2127 | 4246 | GCCCAATCGTTAATCAGCGTCTGTTGCACAG | 8835 | AQSFNQPSVAQ | 13424 | SFNQPSV | 0.164762 | -0.04976 |
| GS1238 | 4247 | GCCCAACTCAACCAAACCAAAGAGTCGCACAG | 8836 | AQLNQNQRVAQ | 13425 | LNQNQRV | 0.164752 | -0.15317 |
| SyS2128 | 4248 | GCCCAAAGAATCGACAGCCAAGACACCGCACAG | 8837 | AQRIDSQDTAQ | 13426 | RIDSQDT | 0.164726 | -0.20951 |
| GS1239 | 4249 | GCCCAAACCGTCCCCGGCAGACCCAGCGCACAG | 8838 | AQTVPGRPSAQ | 13427 | TVPGRPS | 0.164623 | -0.14779 |
| SyS2130 | 4250 | GCCCAACGTGAGCCGAATAATACGAGTGCACAG | 8839 | AQREPNNTSAQ | 13428 | REPNNTS | 0.164588 | -0.05033 |
| SyS2131 | 4251 | GCCCAAGAAGAATGACCATGCACGCCGGCACAG | 8840 | AQERMTMHAAQ | 13429 | ERMTMHA | 0.164489 | -0.12101 |
| GS1240 | 4252 | GCCCAAATTGCTATTCAGAATGATCGGGCACAG | 8841 | AQIAIQNDRAQ | 13430 | IAIQNDR | 0.164441 | -0.14603 |
| SyS2132 | 4253 | GCCCAACTTGGGGCTCAGTCTATTCGGCACAG | 8842 | AQLGAQSISAQ | 13431 | LGAQSIS | 0.164426 | -0.17072 |
| SS136 | 4254 | GCCCAAGCAGGGGGATAAGACGTATGTTGCACAG | 8843 | AQAGDKTYVAQ | 13432 | AGDKTYV | 0.164227 | -0.35249 |
| SyS2135 | 4255 | GCCCAAATGAATAGGACTGGGTATACTGCACAG | 8844 | AQMNRTAYTAQ | 13433 | MNRTAYT | 0.164206 | -0.17799 |
| SyS2136 | 4256 | GCCCAAGCGCTGCCTGGGGGTCTTATGGCACAG | 8845 | AQALPGGLMAQ | 13434 | ALPGGLM | 0.164168 | -0.22406 |
| GS1241 | 4257 | GCCCAACTCAAAAACCACGACACCACCGCACAG | 8846 | AQLKNHDTTAQ | 13435 | LKNHDTT | 0.164164 | -0.02897 |
| SyS2138 | 4258 | GCCCAACCCCTCAACTACGCCCTCGAAGCACAG | 8847 | AQPLNYALEAQ | 13436 | PLNYALE | 0.164085 | -0.2231 |
| SyS2139 | 4259 | GCCCAAAGCAAACAAATGCACAACGACGCACAG | 8848 | AQSKQMHNDAQ | 13437 | SKQMHND | 0.163943 | -0.14283 |
| SyS2140 | 4260 | GCCCAAACGGCGCATACGACTCCTTTTGCACAG | 8849 | AQTAHTTPFAQ | 13438 | TAHTTPF | 0.163842 | -0.14647 |
| SyS2141 | 4261 | GCCCAACTCAAAAACGGGCGACAGCCAAGCACAG | 8850 | AQLKTGDSQAQ | 13439 | LKTGDSQ | 0.163842 | -0.14647 |
| SyS2142 | 4262 | GCCCAATATTCTACGACGGCTGAGTATGCACAG | 8851 | AQYSTTAEYAQ | 13440 | YSTTAEY | 0.163781 | -0.19107 |
| SyP66 | 4263 | GCCCAACCGCTGGATCGGACGGGTGAGGCACAG | 8852 | AQPLDRTGEAQ | 13441 | PLDRTGE | 0.163769 | -0.04278 |
| SyS2144 | 4264 | GCCCAAGGCCCCGGCGAAGTCAAAATCGCACAG | 8853 | AQGPGEVKIAQ | 13442 | GPGEVKI | 0.163669 | -0.17505 |
| GS1243 | 4265 | GCCCAACTCAGAAAACCTCGACCTCAACGCACAG | 8854 | AQLRNLDLNAQ | 13443 | LRNLDLN | 0.163512 | -0.09845 |

FIG. 33 (Continued)

| | | | | | | | | |
|---|---|---|---|---|---|---|---|---|
| SyS2145 | 4266 | GCCCAACTGGGGTCTACTTTGACTAAGGCACAG | 8855 | AQLGSTLTKAQ | 13444 | LGSTLTK | 0.163495 | -0.14302 |
| GS1244 | 4267 | GCCCAATTGAGGCCTGTGAGTGAGCATGCACAG | 8856 | AQIRPVSEHAQ | 13445 | LRPVSEH | 0.1634 | -0.16842 |
| GS1245 | 4268 | GCCCAAAGTAGGAGTCTGACTGAGATGGCACAG | 8857 | AQSRSLTEMAQ | 13446 | SRSLTEM | 0.163369 | -0.17577 |
| SyS2147 | 4269 | GCCCAAAACGGCCTCAGCACCACCATGGCACAG | 8858 | AQNGLSTTMAQ | 13447 | NGLSTTM | 0.163348 | -0.16889 |
| GS1247 | 4270 | GCCCAACATGATAAGACGTATGCGATGGCACAG | 8859 | AQHDKTYAMAQ | 13448 | HDKTYAM | 0.163317 | -0.16304 |
| SyS2148 | 4271 | GCCCAAGTTCCGTCGGATAAGATGCGTGCACAG | 8860 | AQVPSDKMRAQ | 13449 | VPSDKMR | 0.163313 | -0.2268 |
| SyS2149 | 4272 | GCCCAAGGCGCCCACAACCTCCTCACCGCACAG | 8861 | AQGAHNLLTAQ | 13450 | GAHNLLT | 0.163277 | -0.20345 |
| GS1248 | 4273 | GCCCAAAGCACCAGCACCACCATGGTCATGGCACAG | 8862 | AQSTSTMVMMAQ | 13451 | STSTMVM | 0.163265 | -0.11218 |
| SS137 | 4274 | GCCCAAAAACATGGCCCACGAAAGCAAAGCACAG | 8863 | AQNMAHESKAQ | 13452 | NMAHESK | 0.163246 | -0.34932 |
| SyS2151 | 4275 | GCCCAATATCTTGGGGTGGGTGCTACTGCACAG | 8864 | AQYLGVGATAQ | 13453 | YLGVGAT | 0.163021 | -0.17193 |
| SyS2152 | 4276 | GCCCAAGCCAGCGAATACAACCAACACGCACAG | 8865 | AQASEYNQHAQ | 13454 | ASEYNQH | 0.162953 | -0.21072 |
| SyS2153 | 4277 | GCCCAAAGAGCCGAAGGGCGACAAAATCGCACAG | 8866 | AQRAEGDKIAQ | 13455 | RAEGDKI | 0.162815 | -0.18861 |
| SyS2154 | 4278 | GCCCAATCTAGTGGTAGTAGTTTTCATGCACAG | 8867 | AQSSGSSFHAQ | 13456 | SSGSSFH | 0.162597 | -0.218 |
| SyS2155 | 4279 | GCCCAATGGGGCAAAGAATACACCGGCGCACAG | 8868 | AQWGKEYTGAQ | 13457 | WGKEYTG | 0.162268 | -0.12824 |
| SyS2156 | 4280 | GCCCAACCTGCTTCGGGGGCTATGCCTGCACAG | 8869 | AQPASGAMPAQ | 13458 | PASGAMP | 0.16218 | 0.044005 |
| SyS2158 | 4281 | GCCCAAAGGGGGCGGTTGTTGTGGCTGCACAG | 8870 | AQRGAVVVAAQ | 13459 | RGAVVVA | 0.161915 | -0.16587 |
| GS1249 | 4282 | GCCCAAGTGATGATGCAGAATCATGCTGCACAG | 8871 | AQVMMQNHAAQ | 13460 | VMMQNHA | 0.161911 | -0.12712 |
| GS1250 | 4283 | GCCCAACAAGACAGACTCCAAAGCAGAGCACAG | 8872 | AQQDRLQSRAQ | 13461 | QDRLQSR | 0.161891 | -0.14906 |
| SyS2159 | 4284 | GCCCAAGGTCATGCTGCGTTTCTGTGGCACAG | 8873 | AQGHAAVSVAQ | 13462 | GHAAVSV | 0.161865 | 0.031161 |
| SyS2160 | 4285 | GCCCAAGACAAAACGACAGCACCCCGCACAG | 8874 | AQDKTDSTPAQ | 13463 | DKTDSTP | 0.161817 | -0.20216 |
| GP176 | 4286 | GCCCAAGTGCCTCCGACTTCTTTTACTGCACAG | 8875 | AQVPPTSFTAQ | 13464 | VPPTSFT | 0.161782 | -0.06149 |
| GS1251 | 4287 | GCCCAAGTCGGCCCAACGCCCAACAGCACACAG | 8876 | AQVGPNAQHAQ | 13465 | VGPNAQH | 0.16174 | -0.06577 |
| SyS2161 | 4288 | GCCCAACATCATGGTCGGGGCTGATACTGCACAG | 8877 | AQHHGRADTAQ | 13466 | HHGRADT | 0.161642 | -0.23419 |
| GS1253 | 4289 | GCCCAACATGTTAATATGGGTCCGGCGGCACAG | 8878 | AQHVNMGPAAQ | 13467 | HVNMGPA | 0.161627 | -0.1747 |
| SyS2162 | 4290 | GCCCAACACGCCACCAAAGAAACCAGCGCACAG | 8879 | AQHATKETSAQ | 13468 | HATKETS | 0.161604 | -0.17998 |
| SyS2163 | 4291 | GCCCAATTGGCTACGGGTGTGAGTAATGCACAG | 8880 | AQLATGVSNAQ | 13469 | LATGVSN | 0.161594 | -0.07794 |
| SyS2164 | 4292 | GCCCAAAGCCTCGGCAGCTACCCCACCGCACAG | 8881 | AQSLGSYPTAQ | 13470 | SLGSYPT | 0.1614 | -0.11737 |
| SyS2165 | 4293 | GCCCAAGGCAGCAAAGCCTACGTCGGGGCACAG | 8882 | AQGSKAYVGAQ | 13471 | GSKAYVG | 0.161272 | -0.12101 |
| SyS2167 | 4294 | GCCCAACAAGACAGAATGAGCGTCAACGCACAG | 8883 | AQQDRMSVNAQ | 13472 | QDRMSVN | 0.161186 | -0.18954 |
| SyS2168 | 4295 | GCCCAATGGTCGGATTCTCTGAGGGATGCACAG | 8884 | AQWSDSLRDAQ | 13473 | WSDSLRD | 0.161166 | -0.21194 |
| SyS2169 | 4296 | GCCCAAACGAAGGTGCCTATGACTCAGGCACAG | 8885 | AQTKVPMTQAQ | 13474 | TKVPMTQ | 0.161135 | -0.08946 |
| SyS2170 | 4297 | GCCCAATCTCCGTTGTCTGATCGGTTGGCACAG | 8886 | AQSPLSDRLAQ | 13475 | SPLSDRL | 0.161094 | -0.18405 |

FIG. 33 (Continued)

| | | | | | | | | |
|---|---|---|---|---|---|---|---|---|
| SyS2171 | 4298 | GCCCAACTGTATGGTAGTTCGGTTGTTGCACAG | 8887 | AQLYGSSVVAQ | 13476 | LYGSSVV | 0.161094 | -0.18405 |
| SyS2172 | 4299 | GCCCAACCGACGCAGACTGTTAGTTCGGCACAG | 8888 | AQPTQTVSSAQ | 13477 | PTQTVSS | 0.161094 | -0.18405 |
| GP178 | 4300 | GCCCAACTGAATAAGCTGCTTGGGGCGGCACAG | 8889 | AQLNKLLGAAQ | 13478 | LNKLLGA | 0.160777 | 0.340925 |
| SyS2173 | 4301 | GCCCAACATTCTAATCAGGAGCCTCGGCACAG | 8890 | AQHSNQEPRAQ | 13479 | HSNQEPR | 0.160633 | -0.17106 |
| SyS2174 | 4302 | GCCCAAAACGGCGCCAGCATCCACAGCGCACAG | 8891 | AQNGASIHSAQ | 13480 | NGASIHS | 0.16061 | 0.144677 |
| SyS2175 | 4303 | GCCCAACTCAGCCAACAAAGACTCCAAGCACAG | 8892 | AQLSQQRLQAQ | 13481 | LSQQRLQ | 0.160413 | -0.02302 |
| GS1258 | 4304 | GCCCAACTCCCCACGGCACCATGAACGCACAG | 8893 | AQLPHGTMNAQ | 13482 | LPHGTMN | 0.160361 | -0.12536 |
| SyS2176 | 4305 | GCCCAAAGCAGCCCGACGCCAAATACGCACAG | 8894 | AQSSPDAKYAQ | 13483 | SSPDAKY | 0.160306 | -0.1986 |
| GS1259 | 4306 | GCCCAATTCCACACCCCGCCGCAAGCGCACAG | 8895 | AQFHTPAGNAQ | 13484 | FHTPAGN | 0.160249 | -0.13792 |
| SyS2177 | 4307 | GCCCAAAGAACCACCGCCAACAGCCTCGCACAG | 8896 | AQRTTANSLAQ | 13485 | RTTANSL | 0.16022 | -0.09434 |
| SyS2178 | 4308 | GCCCAATTGGATAAGACTATTCCTCAGGCACAG | 8897 | AQLDKTIPQAQ | 13486 | LDKTIPQ | 0.160087 | -0.20224 |
| SyS2179 | 4309 | GCCCAATGGCAAGGCAACAGACAAGCCGCACAG | 8898 | AQWQGNRQAAQ | 13487 | WQGNRQA | 0.160025 | -0.07373 |
| SyS2181 | 4310 | GCCCAAGGGTATGGTACGATTACGCCTGCACAG | 8899 | AQGYGTITPAQ | 13488 | GYGTITP | 0.159821 | -0.02887 |
| GS1260 | 4311 | GCCCAAATGAGAGAACAACAAAGCCGCACAG | 8900 | AQMREQNKAAQ | 13489 | MREQNKA | 0.15981 | -0.17201 |
| SyS2183 | 4312 | GCCCAAAACCTCGCCGGCCTCACCGGCGCACAG | 8901 | AQNLAGLTGAQ | 13490 | NLAGLTG | 0.159698 | -0.16889 |
| SyS2184 | 4313 | GCCCAATGGTTTAAGGCTGGGAGTGTGCACAG | 8902 | AQWFKAGSAAQ | 13491 | WFKAGSA | 0.159617 | -0.20951 |
| SyS2185 | 4314 | GCCCAAATCAACGTCGCCCCCTACAAAGCACAG | 8903 | AQINVAPYKAQ | 13492 | INVAPYK | 0.159555 | -0.16102 |
| SyS2186 | 4315 | GCCCAAGGGGTGCATTCGAATGGTCAGGCACAG | 8904 | AQGVHSNGQAQ | 13493 | GVHSNGQ | 0.159514 | -0.10739 |
| SyS2187 | 4316 | GCCCAAATGAGCGCCAGCACCAACACCGCACAG | 8905 | AQMSASTNTAQ | 13494 | MSASTNT | 0.15942 | -0.1344 |
| GS1263 | 4317 | GCCCAAGGCAGCCACAACGCCAAGGGCGCACAG | 8906 | AQGSHNAQGAQ | 13495 | GSHNAQG | 0.159285 | -0.08901 |
| SyS2189 | 4318 | GCCCAAATCAGCGCCGTCCCCAAAAACGCACAG | 8907 | AQISAVPKNAQ | 13496 | ISAVPKN | 0.159253 | -0.17875 |
| SyS2190 | 4319 | GCCCAAGCCGGGCATGCAAAACGCACAG | 8908 | AQAGGGMQNAQ | 13497 | AGGGMQN | 0.159207 | -0.1198 |
| SyS2191 | 4320 | GCCCAACTCCTCAACACCACCAGCACCGCACAG | 8909 | AQLLNTTSTAQ | 13498 | LLNTTST | 0.159024 | 0.011774 |
| SyS2192 | 4321 | GCCCAAACTAATACTGTGAGTGCTAGTGCACAG | 8910 | AQTNTVSASAQ | 13499 | TNTVSAS | 0.158935 | 0.332609 |
| SyS2193 | 4322 | GCCCAACAGTTGTCTCCGATTGTTAATTTGGCACAG | 8911 | AQQLSPIAMAQ | 13500 | QLSPIAM | 0.158902 | -0.19618 |
| GS1264 | 4323 | GCCCAACTTACTCGTACGTCGGTGGATGCACAG | 8912 | AQAPRGVNLAQ | 13501 | APRGVNL | 0.158854 | -0.18149 |
| SyS2194 | 4324 | GCCCAACTGGGGCAGAAGGGCCTACTGCACAG | 8913 | AQLTRTSVDAQ | 13502 | LTRTSVD | 0.158821 | -0.01311 |
| SyS2195 | 4325 | GCCCAACTGGGGCAGAAGGGCCTACTGCACAG | 8914 | AQLGQKAPTAQ | 13503 | LGQKAPT | 0.158804 | -0.1069 |
| SyS2196 | 4326 | GCCCAAAAGAATGCCGCGCCTCTGACGGCACAG | 8915 | AQKNAPPLTAQ | 13504 | KNAPPLT | 0.158756 | -0.21694 |
| SyS2197 | 4327 | GCCCAAGTCAGAAACGCCGTCCACGCCGCACAG | 8916 | AQVRNAVHAAQ | 13505 | VRNAVHA | 0.158629 | -0.12577 |
| SyS2198 | 4328 | GCCCAAATCAGACACATGGACGCCCCGCACAG | 8917 | AQIRHMDAPAQ | 13506 | IRHMDAP | 0.158527 | -0.1792 |
| SyS2200 | 4329 | GCCCAAGGTGCTCCTTTGGTTGCTACTGCACAG | 8918 | AQGAPLVATAQ | 13507 | GAPLVAT | 0.15843 | -0.17629 |

FIG. 33 (Continued)

| | | | | | | | | |
|---|---|---|---|---|---|---|---|---|
| SyS2201 | 4330 | GCCCAATCTGATCATAATGCTCGTGGGGCACAG | AQSDHNARGAQ | 8919 | SDHNARG | 13508 | 0.158426 | -0.15859 |
| SyS2202 | 4331 | GCCCAAATCAGCGACACCTCCACTACGCACAG | AQISDTLHYAQ | 8920 | ISDTLHY | 13509 | 0.158424 | -0.08821 |
| GS1266 | 4332 | GCCCAAAACAACAGAGGCAGCATCAGCGCACAG | AQNNRGSISAQ | 8921 | NNRGSIS | 13510 | 0.158422 | -0.05843 |
| GS1267 | 4333 | GCCCAACAACAAGAGAAAGAGACGGCGTCGCACAG | AQQRERDGVAQ | 8922 | QRERDGV | 13511 | 0.158316 | -0.10804 |
| SyS2203 | 4334 | GCCCAAAGTAAGCAGGATGTGCTGTGCACAG | AQSKQDVRAAQ | 8923 | SKQDVRA | 13512 | 0.158297 | -0.18284 |
| SyS2204 | 4335 | GCCCAAAACAGCGCAGACTCAACGTCGCACAG | AQNSGRLNVAQ | 8924 | NSGRLNV | 13513 | 0.158284 | -0.17013 |
| SyS2205 | 4336 | GCCCAAGGCCCAGCGTCGAAAGCAACGCACAG | AQGPSVESNAQ | 8925 | GPSVESN | 13514 | 0.158284 | -0.23296 |
| GS1268 | 4337 | GCCCAATTGCTTTCTTCTTCGCCTTCTGCACAG | AQLLSSSPSAQ | 8926 | LLSSSPS | 13515 | 0.158261 | -0.16394 |
| SyS2206 | 4338 | GCCCAAAAAGTCCTCGTCAGCGGCAGCGCACAG | AQKVLVSGSAQ | 8927 | KVLVSGS | 13516 | 0.158127 | -0.20709 |
| SyS2207 | 4339 | GCCCAAGATGTGCGGAATACTATTGCTGCACAG | AQDVRNTIAAQ | 8928 | DVRNTIA | 13517 | 0.158027 | -0.07579 |
| GS1270 | 4340 | GCCCAACATAAGTTGGTGACGAAGGATGCACAG | AQHKLVTKDAQ | 8929 | HKLVTKD | 13518 | 0.157915 | -0.1747 |
| GS1271 | 4341 | GCCCAACCGTATGTTTCGGGTGTTCCTGCACAG | AQPYVSGVPAQ | 8930 | PYVSGVP | 13519 | 0.157885 | -0.11277 |
| SyS2209 | 4342 | GCCCAAAACGACTAAGGCTTCGTTTACTGCACAG | AQTTKASFTAQ | 8931 | TTKASFT | 13520 | 0.15776 | -0.17998 |
| GS1272 | 4343 | GCCCAAACCCCCACGGCCCCGACGCGGCACAG | AQTPHGPDAAQ | 8932 | TPHGPDA | 13521 | 0.157568 | -0.18368 |
| SyS2210 | 4344 | GCCCAAGATTATCGTCAGACTGATCATGCACAG | AQDYRQTDHAQ | 8933 | DYRQTDH | 13522 | 0.157547 | -0.17314 |
| SyS2211 | 4345 | GCCCAACACAGCCCCAAACCGACCACGCACAG | AQHSPKPDHAQ | 8934 | HSPKPDH | 13523 | 0.157547 | -0.19375 |
| SyS2212 | 4346 | GCCCAAGCGTATGGTCAGGTGCCTCTGCACAG | AQAYGQVPPAQ | 8935 | AYGQVPP | 13524 | 0.157393 | -0.07373 |
| SyS2213 | 4347 | GCCCAAGCAACCAAGGCCTCGCCGGGGCACAG | AQSNQGLAGAQ | 8936 | SNQGLAG | 13525 | 0.157367 | -0.11495 |
| SyS2214 | 4348 | GCCCAAATCAACAGCCCCATCGGCAACGCACAG | AQINSPIGNAQ | 8937 | INSPIGN | 13526 | 0.157315 | -0.09779 |
| SyS2215 | 4349 | GCCCAACAAAACCAAATCATGAGCGGGGCACAG | AQQNQIMSGAQ | 8938 | QNQIMSG | 13527 | 0.157275 | -0.19739 |
| SyS2216 | 4350 | GCCCAAGTCTACCAAGGCAACCAAAACGCACAG | AQVYQGNQNAQ | 8939 | VYQGNQN | 13528 | 0.157122 | -0.05314 |
| GS1273 | 4351 | GCCCAAGGCAGCAACAGCGACCACCGCACAG | AQGSNSQHTAQ | 8940 | GSNSQHT | 13529 | 0.156944 | -0.11091 |
| SyS2217 | 4352 | GCCCAAAAAGCAGGAGCCGTCGGATAGGGCACAG | AQKQEPSDRAQ | 8941 | KQEPSDR | 13530 | 0.156938 | -0.14283 |
| GS1274 | 4353 | GCCCAACACAGAAGCAGCAGCCCGCCGCACAG | AQHRSSPAAAQ | 8942 | HRSSPAA | 13531 | 0.156784 | -0.15945 |
| SyS2219 | 4354 | GCCCAAAATGAGGGGAATTCGATGAAGGCACAG | AQNEGNSMKAQ | 8943 | NEGNSMK | 13532 | 0.156665 | -0.08967 |
| GS1277 | 4355 | GCCCAAAGACCCGACAAAGGCCCATGGCACAG | AQRPDKGPMAQ | 8944 | RPDKGPM | 13533 | 0.156399 | -0.15764 |
| SyS2222 | 4356 | GCCCAAGCGATTGTGTCTCATCCGCTGGCACAG | AQAIVSHPLAQ | 8945 | AIVSHPL | 13534 | 0.156109 | -0.19805 |
| GS1279 | 4357 | GCCCAAACCCAAGGCGAAAGACCCGTCGCACAG | AQTQGERPVAQ | 8946 | TQGERPV | 13535 | 0.156022 | -0.17386 |
| SyS2225 | 4358 | GCCCAATACGTCAACAGCGCCCCCAAAGCACAG | AQYVNSAPKAQ | 8947 | YVNSAPK | 13536 | 0.155853 | -0.17799 |
| GS1280 | 4359 | GCCCAACCTTCGGGGACTTCGATTGTGGCACAG | AQPSGTSIVAQ | 8948 | PSGTSIV | 13537 | 0.155836 | -0.17919 |
| SyS2226 | 4360 | GCCCAAAGCGTCGGCGGCCAACAGAGAAGCGCACAG | AQSVGANRSAQ | 8949 | SVGANRS | 13538 | 0.155529 | -0.18491 |
| SyS2227 | 4361 | GCCCAATCTGCGCATTTTAATCATTCGGGCACAG | AQSAHFNHSAQ | 8950 | SAHFNHS | 13539 | 0.155529 | -0.18491 |

FIG. 33 (Continued)

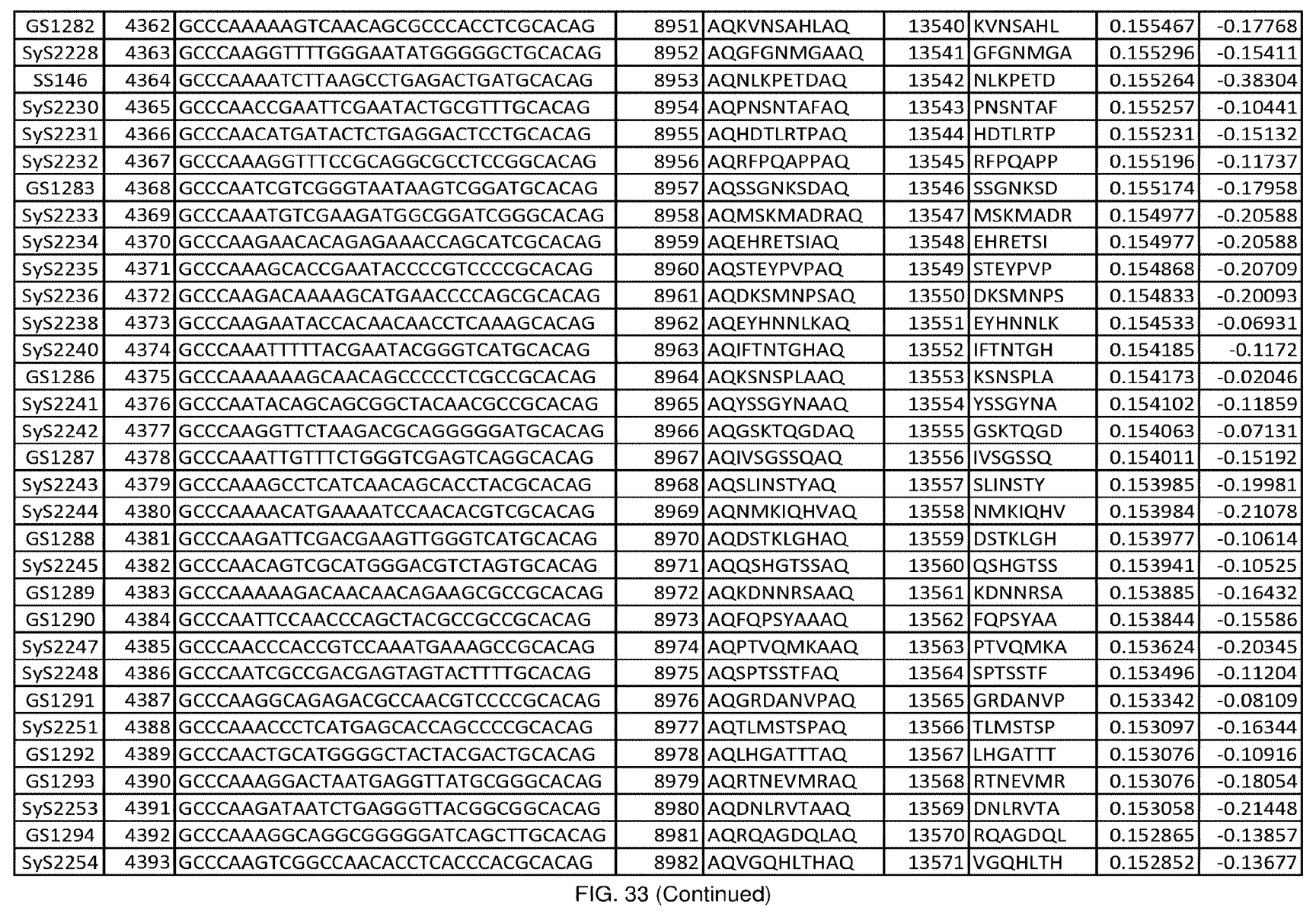

| | | | | | | | |
|---|---|---|---|---|---|---|---|
| GS1282 | 4362 | GCCCAAAAAGTCAACAGCGCCACCTGCACAG | 8951 | AQKVNSAHLAQ | 13540 | KVNSAHL | 0.155467 | -0.17768 |
| SyS2228 | 4363 | GCCCAAGGTTTTGGGAATATGGGGGCTGCACAG | 8952 | AQGFGNMGAAQ | 13541 | GFGNMGA | 0.155296 | -0.15411 |
| SS146 | 4364 | GCCCAAAATCTTAAGCCTGAATACTGCGTTTGCACAG | 8953 | AQNLKPETDAQ | 13542 | NLKPETD | 0.155264 | -0.38304 |
| SyS2230 | 4365 | GCCCAACCGAATTCGAATACTCTGAGGACTCCTGCACAG | 8954 | AQPNSNTAFAQ | 13543 | PNSNTAF | 0.155257 | -0.10441 |
| SyS2231 | 4366 | GCCCAACATGATACTCTGAGGACTCCTGCACAG | 8955 | AQHDTLRTPAQ | 13544 | HDTLRTP | 0.155231 | -0.15132 |
| SyS2232 | 4367 | GCCCAAAGGTTTCCGCAGGCGCCTCCGGCACAG | 8956 | AQRFPQAPPAQ | 13545 | RFPQAPP | 0.155196 | -0.11737 |
| GS1283 | 4368 | GCCCAATCGTCGGGTAATAAGTCGGATGCACAG | 8957 | AQSSGNKSDAQ | 13546 | SSGNKSD | 0.155174 | -0.17958 |
| SyS2233 | 4369 | GCCCAAATGTCGAAGATGGCGGATCGGGCACAG | 8958 | AQMSKMADRAQ | 13547 | MSKMADR | 0.154977 | -0.20588 |
| SyS2234 | 4370 | GCCCAAGAACACAGAGAAACCAGCATCGCACAG | 8959 | AQEHRETSIAQ | 13548 | EHRETSI | 0.154977 | -0.20588 |
| SyS2235 | 4371 | GCCCAAAGCACCGAATACCCCGTCCCCGCACAG | 8960 | AQSTEYPVPAQ | 13549 | STEYPVP | 0.154868 | -0.20709 |
| SyS2236 | 4372 | GCCCAAGACAAAAGCATGAACCCCAGCGCACAG | 8961 | AQDKSMNPSAQ | 13550 | DKSMNPS | 0.154833 | -0.20093 |
| SyS2238 | 4373 | GCCCAAGAATACCACAACAACCTCAAAGCACAG | 8962 | AQEYHNNLKAQ | 13551 | EYHNNLK | 0.154533 | -0.06931 |
| SyS2240 | 4374 | GCCCAAATTTTTACGAATACGGGTCATGCACAG | 8963 | AQIFTNTGHAQ | 13552 | IFTNTGH | 0.154185 | -0.1172 |
| GS1286 | 4375 | GCCCAAAAAAGCAACAGCCCCTCGCCGCACAG | 8964 | AQKSNSPLAAQ | 13553 | KSNSPLA | 0.154173 | -0.02046 |
| SyS2241 | 4376 | GCCCAATACAGCAGCGGCTACAACGCCGCACAG | 8965 | AQYSSGYNAAQ | 13554 | YSSGYNA | 0.154102 | -0.11859 |
| SyS2242 | 4377 | GCCCAAGGTTCTAAGACGCAGGGGATGCACAG | 8966 | AQGSKTQGDAQ | 13555 | GSKTQGD | 0.154063 | -0.07131 |
| GS1287 | 4378 | GCCCAAATTGTTTCTGGGTCGAGTCAGGCACAG | 8967 | AQIVSGSSQAQ | 13556 | IVSGSSQ | 0.154011 | -0.15192 |
| SyS2243 | 4379 | GCCCAAAGCCTCATCAACAGCACCTACGCACAG | 8968 | AQSLINSTYAQ | 13557 | SLINSTY | 0.153985 | -0.19981 |
| SyS2244 | 4380 | GCCCAAAACATGAAAATCCAACACGTCGCACAG | 8969 | AQNMKIQHVAQ | 13558 | NMKIQHV | 0.153984 | -0.21078 |
| GS1288 | 4381 | GCCCAAGATTCGACGAAGTTGGGTCATGCACAG | 8970 | AQDSTKLGHAQ | 13559 | DSTKLGH | 0.153977 | -0.10614 |
| SyS2245 | 4382 | GCCCAACAGTCGCATGGGACGTCTAGTGCACAG | 8971 | AQQSHGTSSAQ | 13560 | QSHGTSS | 0.153941 | -0.10525 |
| GS1289 | 4383 | GCCCAAAAGACAACAACAGAGAAGCGCCGCACAG | 8972 | AQKDNNRSAAQ | 13561 | KDNNRSA | 0.153885 | -0.16432 |
| GS1290 | 4384 | GCCCAATTCCAACCCAGCTACGCCGCGCACAG | 8973 | AQFQPSYAAAQ | 13562 | FQPSYAA | 0.153844 | -0.15586 |
| SyS2247 | 4385 | GCCCAACCACCGTCCAAATGAAAGCCGCACAG | 8974 | AQPTVQMKAAQ | 13563 | PTVQMKA | 0.153624 | -0.20345 |
| SyS2248 | 4386 | GCCCAATCGCGACGAGTAGTACTTTTGCACAG | 8975 | AQSPTSSTFAQ | 13564 | SPTSSTF | 0.153496 | -0.11204 |
| GS1291 | 4387 | GCCCAAGGCAGAGACGCCAACGTCCCCGCACAG | 8976 | AQGRDANVPAQ | 13565 | GRDANVP | 0.153342 | -0.08109 |
| SyS2251 | 4388 | GCCCAAACCCTCATGAGCACCAGCCCCGCACAG | 8977 | AQTLMSTSPAQ | 13566 | TLMSTSP | 0.153097 | -0.16344 |
| GS1292 | 4389 | GCCCAACTGCATGGGCTACTACGACTGCACAG | 8978 | AQLHGATTTAQ | 13567 | LHGATTT | 0.153076 | -0.10916 |
| GS1293 | 4390 | GCCCAAAGGACTAATGAGGTTATGCGGGCACAG | 8979 | AQRTNEVMRAQ | 13568 | RTNEVMR | 0.153076 | -0.18054 |
| SyS2253 | 4391 | GCCCAAGATAATCTGAGGGTTACGGCGGCACAG | 8980 | AQDNLRVTAAQ | 13569 | DNLRVTA | 0.153058 | -0.21448 |
| GS1294 | 4392 | GCCCAAAGGCAGGGGGGGATCAGCTTGCACAG | 8981 | AQRQAGDQLAQ | 13570 | RQAGDQL | 0.152865 | -0.13857 |
| SyS2254 | 4393 | GCCCAAGTCGGCCAACACCTCACCCACGCACAG | 8982 | AQVGQHLTHAQ | 13571 | VGQHLTH | 0.152852 | -0.13677 |

FIG. 33 (Continued)

| | | | | | | | | |
|---|---|---|---|---|---|---|---|---|
| SyS2255 | 4394 | GCCCAACTCAGCGCGCCAGCGGCATCGCACAG | 8983 | AQLSAASGIAQ | 13572 | LSAASGI | 0.152829 | -0.16497 |
| SyS2256 | 4395 | GCCCAAAGCAGCCACAACGGCTTCATCGCACAG | 8984 | AQSSHNGFIAQ | 13573 | SSHNGFI | 0.152739 | -0.14425 |
| GS1296 | 4396 | GCCCAAAACGCCACCAGACAATACAGCGCACAG | 8985 | AQNATRQYSAQ | 13574 | NATRQYS | 0.152256 | -0.06882 |
| GS1297 | 4397 | GCCCAAGTCAGCAGCAGACAAAGCCTCGGCGCACAG | 8986 | AQVSRQSLGAQ | 13575 | VSRQSLG | 0.152253 | -0.15676 |
| SyS2259 | 4398 | GCCCAAGACGTCGTCAAACCCACGGCGCACAG | 8987 | AQDVVKPHGAQ | 13576 | DVVKPHG | 0.152101 | -0.10404 |
| SyS2260 | 4399 | GCCCAAGGGATTGGGGGTATTAGTTCTGCACAG | 8988 | AQGIGGISSAQ | 13577 | GIGGISS | 0.152077 | -0.00277 |
| SyS2262 | 4400 | GCCCAAACTAATAATAGTCTGCGTGAGGCACAG | 8989 | AQTNNSLREAQ | 13578 | TNNSLRE | 0.151972 | -0.02172 |
| SyS2263 | 4401 | GCCCAAAGCGTACGGCTTCGGCGCTGGCACAG | 8990 | AQTRTASALAQ | 13579 | TRTASAL | 0.15196 | -0.08332 |
| SyS2264 | 4402 | GCCCAAACTACGACGGCTCCGAGTCCGGCACAG | 8991 | AQTTTAPSPAQ | 13580 | TTTAPSP | 0.151942 | 0.097476 |
| SyS2265 | 4403 | GCCCAAAACGCCAGCATGAGCAGCATCGCACAG | 8992 | AQNASMSSIAQ | 13581 | NASMSSI | 0.151936 | 0.127665 |
| SyS2266 | 4404 | GCCCAAACCCAACCCACAGAGGCCTCGCACAG | 8993 | AQTQPHRGLAQ | 13582 | TQPHRGL | 0.151921 | -0.20466 |
| SyS2267 | 4405 | GCCCAAAGACTCGACCACCACAGCAGCGCACAG | 8994 | AQRLDHHSSAQ | 13583 | RLDHHSS | 0.151906 | -0.2305 |
| SyS2268 | 4406 | GCCCAAGAAAAACACCACCAGAATCGCCGCACAG | 8995 | AQENTTRIAAQ | 13584 | ENTTRIA | 0.151859 | 0.202781 |
| GS1299 | 4407 | GCCCAAAGCCTCAGAGGCAACGAAGCCGCACAG | 8996 | AQSLRGNEAAQ | 13585 | SLRGNEA | 0.151754 | -0.16718 |
| GS1300 | 4408 | GCCCAACCTAATGTTCCTTCGCATTCTGCACAG | 8997 | AQPNVPSHSAQ | 13586 | PNVPSHS | 0.15171 | -0.18278 |
| SyS2269 | 4409 | GCCCAAGGGATGCCTTTGATGAAGATGGCACAG | 8998 | AQGMPLMKMAQ | 13587 | GMPLMKM | 0.151503 | -0.2083 |
| SyS2270 | 4410 | GCCCACAGAAGACTGAGCGGACGGTTGCACAG | 8999 | AQQKTERTVAQ | 13588 | QKTERTV | 0.15144 | -0.03374 |
| SyS2271 | 4411 | GCCCAAAACCACACACCACCAGCAGCGCACAG | 9000 | AQNHTNHSSAQ | 13589 | NHTNHSS | 0.151411 | -0.16829 |
| GS1302 | 4412 | GCCCAAGGGGCTGGGGAATAGGTCTGCTGCACAG | 9001 | AQGLGNRSAAQ | 13590 | GLGNRSA | 0.15133 | -0.17958 |
| GS1303 | 4413 | GCCCAAGGAACCTCGACAAAGAGGCCTCGCACAG | 9002 | AQDLDKRGLAQ | 13591 | DLDKRGL | 0.151278 | -0.07669 |
| SyS2273 | 4414 | GCCCAACTCACCAACGCCCAACCGACGCACAG | 9003 | AQLTNAQPDAQ | 13592 | LTNAQPD | 0.151194 | -0.21571 |
| SyS2275 | 4415 | GCCCAAACGAAGCCTGATTATCTGGTTGCACAG | 9004 | AQTKPDYLVAQ | 13593 | TKPDYLV | 0.151065 | -0.15859 |
| SyS2276 | 4416 | GCCCAAAAGTTGCAGTTGCATGAGGTTGCACAG | 9005 | AQKLQLHEVAQ | 13594 | KLQLHEV | 0.150883 | -0.08921 |
| SyS2277 | 4417 | GCCCAAACGTCTGTGACGATTTCGAGTGCACAG | 9006 | AQTSVTISSAQ | 13595 | TSVTISS | 0.150853 | -0.08154 |
| SyS2278 | 4418 | GCCCAAAATTCGAGTAATAGGCGTGAGGCACAG | 9007 | AQNSSNRAEAQ | 13596 | NSSNRAE | 0.150815 | -0.09555 |
| GS1304 | 4419 | GCCCAACTCGAACACGGCACCAGAATCGCACAG | 9008 | AQLEHGTRIAQ | 13597 | LEHGTRI | 0.150746 | -0.07792 |
| GS1305 | 4420 | GCCCAAACCCTCCAAATGAGAGAACACGCACAG | 9009 | AQTLQMREHAQ | 13598 | TLQMREH | 0.150701 | -0.13475 |
| GS1306 | 4421 | GCCCAAGGCAGCCCCAAACCGCACAG | 9010 | AQGSPTAQTAQ | 13599 | GSPTAQT | 0.150489 | -0.15945 |
| SyS2280 | 4422 | GCCCAAATAAGGGGCAGACGCTTACTGCACAG | 9011 | AQNKGQTLTAQ | 13600 | NKGQTLT | 0.150205 | -0.20588 |
| SyS2281 | 4423 | GCCCAATCGGTGGGTCATCGGGATATGGCACAG | 9012 | AQSVGHRDMAQ | 13601 | SVGHRDM | 0.150092 | -0.15617 |
| GS1308 | 4424 | GCCCAAAGAGACAAAAGCAGCATGCACACCGCACAG | 9013 | AQRDKSSMHAQ | 13602 | RDKSSMH | 0.149802 | -0.13189 |
| SyS2283 | 4425 | GCCCAAGTCAGCGTCATCAACAACACCGCACAG | 9014 | AQVSVINNTAQ | 13603 | VSVINNT | 0.14972 | -0.11447 |

FIG. 33 (Continued)

| | | | | | | | | |
|---|---|---|---|---|---|---|---|---|
| SyS2284 | 4426 | GCCCAACTTCCTAATTCTGCTTTAGTGCACAG | 9015 | AQLPNSAFSAQ | 13604 | LPNSAFS | 0.149676 | -0.02892 |
| GS1309 | 4427 | GCCCAACGTACGGTGTCTACGGATGATGCACAG | 9016 | AQRTVSTDDAQ | 13605 | RTVSTDD | 0.149671 | -0.18368 |
| GS1310 | 4428 | GCCCAACTCATGGACAGAATGGCCAGCGCACAG | 9017 | AQLMDRMASAQ | 13606 | LMDRMAS | 0.149549 | -0.14121 |
| SyS2285 | 4429 | GCCCAACGAGTGGGTTTAATACTTTGGCACAG | 9018 | AQPSGFNTLAQ | 13607 | PSGFNTL | 0.149506 | -0.21078 |
| SyS2286 | 4430 | GCCCAAAAAAGCGCCCAACCCATGAGCGCACAG | 9019 | AQKSAQPMSAQ | 13608 | KSAQPMS | 0.149458 | -0.11374 |
| SyS2287 | 4431 | GCCCAAACCGGCCTCAGCGTCCAAAAGCACAG | 9020 | AQTGLSVQKAQ | 13609 | TGLSVQK | 0.149458 | -0.23618 |
| SyS2288 | 4432 | GCCCAACACGGCTTCCCGGCCCCGCACAG | 9021 | AQHGFPAGPAQ | 13610 | HGFPAGP | 0.149413 | -0.19981 |
| SyS2289 | 4433 | GCCCAAAGCTACGAAGCCGTCGGCATCGCACAG | 9022 | AQSYEAVGIAQ | 13611 | SYEAVGI | 0.149397 | -0.13594 |
| SyS2290 | 4434 | GCCCAAAACCGCCAAAGGCGTCCTCAGCGCACAG | 9023 | AQTAKGVLSAQ | 13612 | TAKGVLS | 0.149081 | -0.22649 |
| SS153 | 4435 | GCCCAAGGGCGCCAGCACCCACAACGCCGCACAG | 9024 | AQGASTHNAAQ | 13613 | GASTHNA | 0.149034 | -0.40725 |
| SyS2291 | 4436 | GCCCAAATCATCAAAGAAATCCCGCCGCACAG | 9025 | AQIIKEIPAAQ | 13614 | IIKEIPA | 0.149013 | -0.16708 |
| GS1313 | 4437 | GCCCAAAAACCACGTCATCAGCAACGGGCACAG | 9026 | AQNHVISNGAQ | 13615 | NHVISNG | 0.148941 | -0.12903 |
| SyS2293 | 4438 | GCCCAATACACCAACATGGCCGGCGTCGCACAG | 9027 | AQYTNMAGVAQ | 13616 | YTNMAGV | 0.148928 | -0.14405 |
| SyS2294 | 4439 | GCCCAATTCAACAGAATCGGCGGCGGCGCACAG | 9028 | AQFNRIGAGAQ | 13617 | FNRIGAG | 0.14886 | -0.12101 |
| SyS2295 | 4440 | GCCCAATGGAGCACCATGATGAAAAGCGCACAG | 9029 | AQWSTMMKSAQ | 13618 | WSTMMKS | 0.148757 | -0.21679 |
| SyS2296 | 4441 | GCCCAAACCGCCCCGCCAACCACGTCGCACAG | 9030 | AQTAPANHVAQ | 13619 | TAPANHV | 0.148692 | 0.040594 |
| SyS2298 | 4442 | GCCCAAATGCATGGGGGTTCGGAGCTGGCACAG | 9031 | AQMHGGSELAQ | 13620 | MHGGSEL | 0.148583 | -0.18737 |
| GS1314 | 4443 | GCCCAAATGAGTAGGAGGATGGGGGGTGGCGCACAG | 9032 | AQMSRMGVAAQ | 13621 | MSRMGVA | 0.148576 | -0.1774 |
| GS1315 | 4444 | GCCCAAACTCGGATTAGTGAGGTTCTTGCACAG | 9033 | AQTRISEVLAQ | 13622 | TRISEVL | 0.148534 | -0.1313 |
| SyS2299 | 4445 | GCCCAAAGCGGCCCCGGCCTCAGAACCGCACAG | 9034 | AQSGPGLRTAQ | 13623 | SGPGLRT | 0.148397 | -0.13798 |
| GS1316 | 4446 | GCCCAAGATAAGCGTCATCATGCGGAGGCACAG | 9035 | AQDKRHHAEAQ | 13624 | DKRHHAE | 0.148387 | -0.10709 |
| SyS2300 | 4447 | GCCCAATTGACGGCAGAATGATCGGCCTGCACAG | 9036 | AQLTQNDRPAQ | 13625 | LTQNDRP | 0.148385 | -0.19353 |
| GS1317 | 4448 | GCCCAAAGCGTCACCAGCCACGTCGCACAG | 9037 | AQSVTTSHVAQ | 13626 | SVTTSHV | 0.148348 | -0.17919 |
| SyS2301 | 4449 | GCCCAAATGCTCACCGGCGGCACCAACGCACAG | 9038 | AQMLTGGTNAQ | 13627 | MLTGGTN | 0.148306 | -0.17259 |
| SyS2302 | 4450 | GCCCAAGACAACGTCGCCAACGCCGGCGCACAG | 9039 | AQDNVANAGAQ | 13628 | DNVANAG | 0.148252 | -0.125 |
| SyS2303 | 4451 | GCCCAAATGACCACCAACAGCATCGCCGCACAG | 9040 | AQMTTNSIAAQ | 13629 | MTTNSIA | 0.148226 | -0.22042 |
| SyS2304 | 4452 | GCCCAAATGCGTACGCAGTCTCTGTCGGCACAG | 9041 | AQMRTQSLSAQ | 13630 | MRTQSLS | 0.14815 | 0.030244 |
| GS1318 | 4453 | GCCCAATACGGCAGCTTCACCGGCCAAGCACAG | 9042 | AQYGSFTGQAQ | 13631 | YGSFTGQ | 0.148082 | -0.14334 |
| GS1320 | 4454 | GCCCAAGGCCCATGTGCTCCTCAAAGCCGCACAG | 9043 | AQGPMLLKAAQ | 13632 | GPMLLKA | 0.148051 | -0.16753 |
| SyS2305 | 4455 | GCCCAAATGACCCAAAAAGCCCCGTCGCACAG | 9044 | AQMTQKAPVAQ | 13633 | MTQKAPV | 0.147926 | -0.03714 |
| GS1321 | 4456 | GCCCAAAGCGCCAACGCCCACCAAACTCGCACAG | 9045 | AQSANATKLAQ | 13634 | SANATKL | 0.147918 | -0.10232 |
| SyS2306 | 4457 | GCCCAATTCAACGGCAGCCTCGCCATGGCACAG | 9046 | AQFNGSLAMAQ | 13635 | FNGSLAM | 0.147866 | -0.14302 |

FIG. 33 (Continued)

| | | | | | | | | |
|---|---|---|---|---|---|---|---|---|
| SyS2308 | 4458 | GCCCAAATTGTTAATGCTAAGCTTACTGCACAG | 9047 | AQIVNAKLTAQ | 13636 | IVNAKLT | 0.147749 | -0.20103 |
| SyS2310 | 4459 | GCCCAAATGTTCAGCGGCCTCCAAGCCGCACAG | 9048 | AQMFSGLQAAQ | 13637 | MFSGLQA | 0.147689 | -0.23296 |
| GS1322 | 4460 | GCCCAAGTGATTATCGGGTGAATGGTGCACAG | 9049 | AQVDYRVNGAQ | 13638 | VDYRVNG | 0.147677 | -0.16241 |
| SyS2311 | 4461 | GCCCAACTGGCTTCGGCTGGTAATGGTGCACAG | 9050 | AQLASAGNGAQ | 13639 | LASAGNG | 0.147593 | -0.07841 |
| GS1323 | 4462 | GCCCAACGTGATCTTCATTCTAAGGATGCACAG | 9051 | AQRDLHSKDAQ | 13640 | RDLHSKD | 0.147554 | -0.17958 |
| SyS2313 | 4463 | GCCCAAAGCCACGTCAGCAGAACCGCGGCACAG | 9052 | AQSHVSRTAAQ | 13641 | SHVSRTA | 0.147511 | 0.008708 |
| SyS2314 | 4464 | GCCCAAACCCCGTCCAAAGCCTCAGCGCACAG | 9053 | AQTPVQSLSAQ | 13642 | TPVQSLS | 0.147458 | -0.1444 |
| SyS2315 | 4465 | GCCCAATACCTCAACGGCAGCGAACTCGCACAG | 9054 | AQYLNGSELAQ | 13643 | YLNGSEL | 0.147331 | -0.1489 |
| SyS2316 | 4466 | GCCCAACCTGCTTTGAAGACTCATGAGGCACAG | 9055 | AQPALKTHEAQ | 13644 | PALKTHE | 0.14732 | 0.228732 |
| GS1324 | 4467 | GCCCAAAATAAGTCTCTGACTTCTGATGCACAG | 9056 | AQNKSLTSDAQ | 13645 | NKSLTSD | 0.147304 | -0.16432 |
| GS1325 | 4468 | GCCCAATATAATGCTACTAAGTCGAGTGCACAG | 9057 | AQYNATKSSAQ | 13646 | YNATKSS | 0.147262 | -0.13189 |
| GS1326 | 4469 | GCCCAAATGCGGGATAAGAGTCATGATGCACAG | 9058 | AQMRDKSHDAQ | 13647 | MRDKSHD | 0.147262 | -0.13189 |
| SyS2318 | 4470 | GCCCAACACAGAACCGAAGGCAAAACGCACAG | 9059 | AQHRTEGQNAQ | 13648 | HRTEGQN | 0.147163 | -0.041 |
| SyS2319 | 4471 | GCCCAACTCCACAAACCGACGAATTCGCACAG | 9060 | AQLHKPDEFAQ | 13649 | LHKPDEF | 0.147149 | -0.14672 |
| SyS2320 | 4472 | GCCCAAATTGCTGCGAGGCCTCCTTCGGCACAG | 9061 | AQIAARPPSAQ | 13650 | IAARPPS | 0.14708 | -0.16223 |
| SyS2321 | 4473 | GCCCAAACGCCTACGCATTATTCTCATGCACAG | 9062 | AQTPTHYSHAQ | 13651 | TPTHYSH | 0.14708 | -0.19496 |
| GP183 | 4474 | GCCCAATCGACTTTTTCGGCTGATAGGGCACAG | 9063 | AQSTFSADRAQ | 13652 | STFSADR | 0.147035 | -0.07197 |
| SyP68 | 4475 | GCCCAACAGTCGGTGCAGGTGACGGCTGCACAG | 9064 | AQQSVQVTAAQ | 13653 | QSVQVTA | 0.146995 | -0.04053 |
| SyS2322 | 4476 | GCCCAACTCGACAGCAGCAGAAACAGAGCACAG | 9065 | AQLDSSRNRAQ | 13654 | LDSSRNR | 0.146928 | -0.18527 |
| GS1327 | 4477 | GCCCAAAGACAACCCAAAGCACCGTCGCACAG | 9066 | AQRQPQSTVAQ | 13655 | RQPQSTV | 0.146727 | -0.01889 |
| SyS2323 | 4478 | GCCCAAAGAGTGCGACGACGGCGTCAGAGCACAG | 9067 | AQRVDDGVRAQ | 13656 | RVDDGVR | 0.146717 | -0.07779 |
| GS1328 | 4479 | GCCCAAAAAATCACCAACACTTACAGCGCACAG | 9068 | AQKITNTYSAQ | 13657 | KITNTYS | 0.146679 | -0.1481 |
| GS1329 | 4480 | GCCCAACCTGGGAAGGCGACTCCTGCACAG | 9069 | AQPGKATPPAQ | 13658 | PGKATPP | 0.146646 | -0.15317 |
| GS1330 | 4481 | GCCCAATTCAGCACCCCACACCCCCGCACAG | 9070 | AQFSTHTPPAQ | 13659 | FSTHTPP | 0.146343 | -0.13761 |
| SyS2324 | 4482 | GCCCAACTCGCCCCAACATGAGACTCGCACAG | 9071 | AQLAPNMRLAQ | 13660 | LAPNMRL | 0.146185 | -0.21194 |
| SS154 | 4483 | GCCCAAAACCTCCCAGAACCAACGTCGCACAG | 9072 | AQNLPRTNVAQ | 13661 | NLPRTNV | 0.146169 | -0.35701 |
| GS1331 | 4484 | GCCCAAGAGACGAGTAATGTGAATCGTGCACAG | 9073 | AQETSNVNRAQ | 13662 | ETSNVNR | 0.14611 | -0.18188 |
| SyS2325 | 4485 | GCCCAAGGCAGCACCGACCACAGACTCGCACAG | 9074 | AQGSTDHRLAQ | 13663 | GSTDHRL | 0.145928 | -0.13071 |
| SS155 | 4486 | GCCCAAGTCAACACCGCCGCGCCATGCACAG | 9075 | AQVNTAMPAAQ | 13664 | VNTAMPA | 0.145614 | -0.40725 |
| GS1335 | 4487 | GCCCAAATGGTTGCTCGGGATCAGAATGCACAG | 9076 | AQMVARDQNAQ | 13665 | MVARDQN | 0.145535 | -0.13881 |
| SyS2328 | 4488 | GCCCAAAAAAACAACCCGTCCTCCACGCACAG | 9077 | AQKNNPVLHAQ | 13666 | KNNPVLH | 0.145436 | -0.18984 |
| GS1337 | 4489 | GCCCAAGATTCGACGACGGTTAGGCTTGCACAG | 9078 | AQDSTTVRLAQ | 13667 | DSTTVRL | 0.145378 | -0.10767 |

FIG. 33 (Continued)

| | | | | | | | | |
|---|---|---|---|---|---|---|---|---|
| SyS2329 | 4490 | GCCCAAAAACTCAACGTCATGAACGACGCACAG | 9079 | AQKLNVMNDAQ | 13668 | KLNVMND | 0.145256 | -0.15738 |
| GS1339 | 4491 | GCCCAAAGCCTCAGAGACAAAAGCGCCGCACAG | 9080 | AQSLRDKNAAQ | 13669 | SLRDKNA | 0.145231 | -0.18727 |
| SyS2330 | 4492 | GCCCAAGGTGTTGGTAATAGTCTGAGTGCACAG | 9081 | AQGVGNSLSAQ | 13670 | GVGNSLS | 0.145202 | -0.01482 |
| SyS2332 | 4493 | GCCCAATTCAGCAAAACCAACTTCAACGCACAG | 9082 | AQFSKTNFNAQ | 13671 | FSKTNFN | 0.145119 | -0.22557 |
| GS1342 | 4494 | GCCCAAGCTAATCGGCCTTCGCTGCTGCACAG | 9083 | AQANRPSLPAQ | 13672 | ANRPSLP | 0.144885 | -0.0877 |
| GS1343 | 4495 | GCCCAAGACAGCAAACCAACAGAGTCGCACAG | 9084 | AQDSQTNRVAQ | 13673 | DSQTNRV | 0.144816 | -0.09307 |
| SyS2333 | 4496 | GCCCAAATTTGACGTCGTCCGGTTGCACAG | 9085 | AQISTSSPVAQ | 13674 | ISTSSPV | 0.144754 | -0.12222 |
| SyS2334 | 4497 | GCCCAAATCCTCAAAATCACCGAAGGCGCACAG | 9086 | AQILKITEGAQ | 13675 | ILKITEG | 0.144609 | -0.14918 |
| GS1344 | 4498 | GCCCAATTTCGTCGGCGTCTGAGATTGCACAG | 9087 | AQFRPASEIAQ | 13676 | FRPASEI | 0.144534 | -0.13935 |
| SyS2335 | 4499 | GCCCAAAAAAAGACAGCGAACCCCTCGCACAG | 9088 | AQKKDSEPLAQ | 13677 | KKDSEPL | 0.144431 | 0.01409 |
| SyS2336 | 4500 | GCCCAAAACGCCAGACCCCTCACCGCGCACAG | 9089 | AQNARPLTAAQ | 13678 | NARPLTA | 0.144383 | -0.05797 |
| SyS2338 | 4501 | GCCCAAAAGGCGGGCTAGGATGGAGACTGCACAG | 9090 | AQKAARMETAQ | 13679 | KAARMET | 0.144286 | -0.10236 |
| SyS2340 | 4502 | GCCCAACACGCCAACGTCAGCAGCAGAGAGCACAG | 9091 | AQHANVSSRAQ | 13680 | HANVSSR | 0.144111 | -0.14672 |
| SyS2341 | 4503 | GCCCAAACCAGCACCACCCAAACCAGCGCACAG | 9092 | AQTSTTQTSAQ | 13681 | TSTTQTS | 0.144008 | -0.21448 |
| SyS2342 | 4504 | GCCCAAGTGCGTTGTCGCTGAGTCCGGCACAG | 9093 | AQSALSLSPAQ | 13682 | SALSLSP | 0.143867 | -0.11439 |
| SyS2343 | 4505 | GCCCAAGCTAATGTTCAGATTCAGTCGGCACAG | 9094 | AQANVQIQSAQ | 13683 | ANVQIQS | 0.143839 | -0.19739 |
| GS1346 | 4506 | GCCCAAACCCCAGCAGCAACAGCCTCGCACAG | 9095 | AQTPSSNSLAQ | 13684 | TPSSNSL | 0.143816 | -0.14429 |
| SyS2345 | 4507 | GCCCAAACGATGACGGGGCCTGGTCATGCACAG | 9096 | AQTMTGPGHAQ | 13685 | TMTGPGH | 0.143627 | -0.14425 |
| SyS2346 | 4508 | GCCCAAATTACTGCTCAGATTACGAATGCACAG | 9097 | AQITAQITNAQ | 13686 | ITAQITN | 0.143574 | -0.22064 |
| SyS2348 | 4509 | GCCCAACTTCCTAATCCTTCGTCTCGGGCACAG | 9098 | AQLPNPSSRAQ | 13687 | LPNPSSR | 0.143468 | -0.19723 |
| SyS2349 | 4510 | GCCCAAAAGATGGGGACTATGACGCCTGCACAG | 9099 | AQKMGTMTPAQ | 13688 | KMGTMTP | 0.143411 | -0.08828 |
| GS1347 | 4511 | GCCCAATACACCAACGGCAGAATCAACGCACAG | 9100 | AQYTNGRINAQ | 13689 | YTNGRIN | 0.143337 | -0.13284 |
| SyS2350 | 4512 | GCCCAAGATGGGAGTAATGTGGTGAAGGCACAG | 9101 | AQDGSNVVKAQ | 13690 | DGSNVVK | 0.143302 | -0.21202 |
| GS1348 | 4513 | GCCCAACTCCCCTCAGCATCCCGCGCACAG | 9102 | AQLPLSIPAAQ | 13691 | LPLSIPA | 0.143269 | -0.17481 |
| GS1349 | 4514 | GCCCAAGAAAGCAGACTCAGCAGCAGCACAG | 9103 | AQESRLSSSAQ | 13692 | ESRLSSS | 0.143208 | -0.16814 |
| SyS2351 | 4515 | GCCCAAATGAGTCCTTCTCGGGGTAATGCACAG | 9104 | AQMSPSRGNAQ | 13693 | MSPSRGN | 0.143199 | -0.13677 |
| SyS2352 | 4516 | GCCCAAAGCGTCCACGCCGCCAAACAAGCACAG | 9105 | AQSVHAAKQAQ | 13694 | SVHAAKQ | 0.143145 | -0.14647 |
| SyS2353 | 4517 | GCCCAAGCGTTTTCTAGTGGTACTTCGGCACAG | 9106 | AQAFSSGTSAQ | 13695 | AFSSGTS | 0.143125 | 0.020339 |
| GS1350 | 4518 | GCCCAAACTGGGTGGTCTCCTTCGCCTGCACAG | 9107 | AQTGWSPSPAQ | 13696 | TGWSPSP | 0.143107 | -0.15478 |
| SyS2354 | 4519 | GCCCAAGCGTCGCATAGTGCGAGTGGTGCACAG | 9108 | AQASHSASGAQ | 13697 | ASHSASG | 0.143021 | -0.23012 |
| GS1353 | 4520 | GCCCAAGTCACCCCAGAAGCCCCTCGCACAG | 9109 | AQVTPRSPLAQ | 13698 | VTPRSPL | 0.142958 | -0.12807 |
| GS1354 | 4521 | GCCCAAACTGAGCGTGATACTAGTCGTGCACAG | 9110 | AQTERDTSRAQ | 13699 | TERDTSR | 0.142958 | -0.1159 |

FIG. 33 (Continued)

| | | | | | | | | |
|---|---|---|---|---|---|---|---|---|
| SyS2355 | 4522 | GCCCAATACACCCTCACGGCACCACCGCACAG | 9111 | AQYTLTGTTAQ | 13700 | YTLTGTT | 0.142869 | -0.18527 |
| SyS2356 | 4523 | GCCCAAGACCTCAGAGTCAGCAGAGACGCACAG | 9112 | AQDLRVSRDAQ | 13701 | DLRVSRD | 0.142848 | -0.13071 |
| SyS2357 | 4524 | GCCCAACTTATTGCGTGCGATACGGCGGGCACAG | 9113 | AQLIASHTAAQ | 13702 | LIASHTA | 0.142848 | -0.13071 |
| SyS2358 | 4525 | GCCCAACAGCGTTCTGAGAATTCGCATGCACAG | 9114 | AQQRSENSHAQ | 13703 | QRSENSH | 0.142835 | -0.08424 |
| GS13355 | 4526 | GCCCAAAGTGCGAGTAATCAGACTTATGCACAG | 9115 | AQSASNQTYAQ | 13704 | SASNQTY | 0.142747 | -0.17005 |
| SyS2360 | 4527 | GCCCAATTGGAGAAGGTGCTGCAGCGGCACAG | 9116 | AQLEKVLQPAQ | 13705 | LEKVLQP | 0.142579 | -0.23296 |
| SyS2361 | 4528 | GCCCAAAATAGTGGTCCGTTGGTGATTGCACAG | 9117 | AQNSGPLVIAQ | 13706 | NSGPLVI | 0.142353 | -0.17829 |
| SyS2362 | 4529 | GCCCAAGGCACCATCCACAGCCCGTCGCACAG | 9118 | AQGTIHSPVAQ | 13707 | GTIHSPV | 0.142285 | -0.23376 |
| SyS2363 | 4530 | GCCCAAAACAAAAACGGGGAAGTCCTCGCACAG | 9119 | AQNKNGEVLAQ | 13708 | NKNGEVL | 0.142243 | -0.13686 |
| SyS2364 | 4531 | GCCCAACCCATGAACGAAAGAGAAAGAGCACAG | 9120 | AQPMNERERAQ | 13709 | PMNERER | 0.1422 | -0.1986 |
| SyS2366 | 4532 | GCCCAAGGCAGCAACAACCTCCACCCGCACAG | 9121 | AQGSNNLHPAQ | 13710 | GSNNLHP | 0.141901 | -0.14768 |
| SyS2367 | 4533 | GCCCAAATGAGCCTCCACGCCAAAGCGCACAG | 9122 | AQMSLHAKSAQ | 13711 | MSLHAKS | 0.141901 | -0.18284 |
| SyS2368 | 4534 | GCCCAACAAGAAAAAGCCCTCGCCAGAGCACAG | 9123 | AQQEKALARAQ | 13712 | QEKALAR | 0.141841 | -0.08342 |
| SP45 | 4535 | GCCCAAGATCGTAGTACGCATGCTAAGGCACAG | 9124 | AQDRSTHAKAQ | 13713 | DRSTHAK | 0.141804 | -0.05361 |
| SyS2369 | 4536 | GCCCAAATTGTGAGGGGTGATACGTCTGCACAG | 9125 | AQIVRGDTSAQ | 13714 | IVRGDTS | 0.141804 | -0.2305 |
| GS13359 | 4537 | GCCCAAAGCAGCGGCGGCATGAACGAAGCACAG | 9126 | AQSSGGMNEAQ | 13715 | SSGGMNE | 0.141777 | -0.17386 |
| SyS2370 | 4538 | GCCCAAAGTTGCATGTCGTGTTGAGGCTGCACAG | 9127 | AQKLHAVEAAQ | 13716 | KLHAVEA | 0.141757 | -0.19254 |
| SyS2371 | 4539 | GCCCAAATGTTCGCCGAAGGCACCGTCGCACAG | 9128 | AQMFAEGTVAQ | 13717 | MFAEGTV | 0.14166 | -0.18984 |
| GS13360 | 4540 | GCCCAAACCCTCGGCAGAGTCCCCAAGCACAG | 9129 | AQTLGRVPQAQ | 13718 | TLGRVPQ | 0.141609 | -0.12235 |
| GS13361 | 4541 | GCCCAACTCCTCGGCAACAAAGACAAAGCACAG | 9130 | AQLLGNKDKAQ | 13719 | LLGNKDK | 0.141569 | -0.13971 |
| GS13362 | 4542 | GCCCAAAGAGTCAACACCAGCACGACGCACAG | 9131 | AQRVNTSTDAQ | 13720 | RVNTSTD | 0.141559 | 0.158617 |
| SyS2372 | 4543 | GCCCAACCCCAAGGCGTCAGCCCGCCGCACAG | 9132 | AQPQGVSPAAQ | 13721 | PQGVSPA | 0.14153 | -0.18121 |
| SyS2373 | 4544 | GCCCAAGGCGCCGTCTCCAGCAAAGCCGCACAG | 9133 | AQGAVLSKAAQ | 13722 | GAVLSKA | 0.14147 | -0.14056 |
| SyS2374 | 4545 | GCCCAACTCGGCCACGCGCCACCAGCGCACAG | 9134 | AQLGHAATSAQ | 13723 | LGHAATS | 0.141412 | -0.21194 |
| SyS2375 | 4546 | GCCCAAAGCGGCTTCAGCAGCACGCCGCACAG | 9135 | AQSGFSSTAAQ | 13724 | SGFSSTA | 0.141288 | -0.12331 |
| SyS2376 | 4547 | GCCCAATTGGTGAATCAGCCTCAGTCGGCACAG | 9136 | AQLVNQPQSAQ | 13725 | LVNQPQS | 0.141288 | -0.12331 |
| GS13366 | 4548 | GCCCAAGGTCGTGCGGAGGTGGGGATTGCACAG | 9137 | AQGRAEVGIAQ | 13726 | GRAEVGI | 0.141255 | -0.16932 |
| GS13369 | 4549 | GCCCAAGTCCTGCGCCACCAAAAACAGCGCACAG | 9138 | AQVLATKNSAQ | 13727 | VLATKNS | 0.140992 | -0.15764 |
| SyS2378 | 4550 | GCCCAACAGGCTCATGCGTTTGCGGATGCACAG | 9139 | AQQAHAFADAQ | 13728 | QAHAFAD | 0.140963 | -0.20588 |
| SyS2379 | 4551 | GCCCAAAACCTCGACACCGTCAAAACCGCACAG | 9140 | AQNLDTVKTAQ | 13729 | NLDTVKT | 0.140932 | -0.21941 |
| SyS2380 | 4552 | GCCCAACGTCCGCAGACTCTGCCGAATGCACAG | 9141 | AQRPQTLPNAQ | 13730 | RPQTLPN | 0.140903 | -0.17013 |
| SyS2381 | 4553 | GCCCAAAACCCCAGAAACAGCCCCACCGCACAG | 9142 | AQNPRNSPTAQ | 13731 | NPRNSPT | 0.140813 | -0.1392 |

FIG. 33 (Continued)

| | | | | | | | |
|---|---|---|---|---|---|---|---|
| SyS2382 | 4554 | GCCCAACACATGTGCAGATGGATGCGGATGCACAG | AQHVQMDADAQ | 13732 | HVQMDAD | 0.140761 | -0.1071 |
| GS1371 | 4555 | GCCCAAACTTATCGGACTGAGCGGTGGCACAG | AQTYRTEPVAQ | 13733 | TYRTEPV | 0.14075 | -0.18099 |
| SyS2383 | 4556 | GCCCAACCGGCCTCGTCAACATGAGCGCACAG | AQPGLVNMSAQ | 13734 | PGLVNMS | 0.140733 | -0.21557 |
| SyS2384 | 4557 | GCCCAAAGCCTCAGCCAAGCCCCGCCGCACAG | AQSLSQGPAAQ | 13735 | SLSQGPA | 0.14057 | -0.10768 |
| SyS2385 | 4558 | GCCCAACTGGGTGCTTCTGGTTATACGGCACAG | AQLGASGYTAQ | 13736 | LGASGYT | 0.14047 | -0.22527 |
| SyS2386 | 4559 | GCCCAAAGGCGCCGTCACCACCATGCCGCACAG | AQSAVTTMPAQ | 13737 | SAVTTMP | 0.14044 | -0.23419 |
| GP186 | 4560 | GCCCAAAAGGTGAATGCTGAGCTTCTTGCACAG | AQKVNAELLAQ | 13738 | KVNAELL | 0.140309 | -0.07287 |
| SyS2387 | 4561 | GCCCAACCGTTTACGCCTAAGTTGAGTGCACAG | AQPFTPKLSAQ | 13739 | PFTPKLS | 0.140302 | -0.20951 |
| GS1372 | 4562 | GCCCAAATGAGAAGCACCAACGCCAGCGCACAG | AQMRSTNASAQ | 13740 | MRSTNAS | 0.140251 | -0.14868 |
| SyS2388 | 4563 | GCCCAAGTGATGTATGCGCGTGGGGATGCACAG | AQVMYARGDAQ | 13741 | VMYARGD | 0.140081 | -0.11698 |
| GS1373 | 4564 | GCCCAACGGGTTGGTAGTACGATGCAGGCACAG | AQRVGSTMQAQ | 13742 | RVGSTMQ | 0.140075 | -0.16146 |
| SP47 | 4565 | GCCCAATTGACGGTGGCGGTTGAGACTGCACAG | AQLTVAVETAQ | 13743 | LTVAVET | 0.139972 | -0.05361 |
| SyS2390 | 4566 | GCCCAATGGACTAATTCTGGTAGTTCTGCACAG | AQWTNSGSSAQ | 13744 | WTNSGSS | 0.139811 | -0.18769 |
| GS1374 | 4567 | GCCCAACACGCCATGAGAGGCACCGGCGCACAG | AQHAMRGTGAQ | 13745 | HAMRGTG | 0.139811 | -0.16842 |
| SyS2391 | 4568 | GCCCAACACCAGAACGTCAGAGGCAGCGCACAG | AQHQDVRGSAQ | 13746 | HQDVRGS | 0.139527 | -0.18861 |
| GS1375 | 4569 | GCCCAAAGCTTCCAAAGAGAAATCCCGCACAG | AQSFQREIPAQ | 13747 | SFQREIP | 0.13934 | -0.09891 |
| GS1377 | 4570 | GCCCAACTCCAAAGAGCGCCCTCAACGCACAG | AQLQRAALNAQ | 13748 | LQRAALN | 0.1391 | -0.16528 |
| SyS2392 | 4571 | GCCCAAGGCGACGCCACCATCAGACCGCACAG | AQSDATIRPAQ | 13749 | SDATIRP | 0.139008 | 0.01549 |
| GS1378 | 4572 | GCCCAACAAATGAGCACCGGCAGAGTCGCACAG | AQQMSTGRVAQ | 13750 | QMSTGRV | 0.13898 | -0.10908 |
| GS1379 | 4573 | GCCCAAAGAAGCACCCAAGCCATCCCGCACAG | AQRSTQAIPAQ | 13751 | RSTQAIP | 0.138749 | -0.15766 |
| SyS2395 | 4574 | GCCCAACAAATCAGAGACGCCAACGCGCACAG | AQQIRDANAAQ | 13752 | QIRDANA | 0.138593 | -0.14056 |
| GS1382 | 4575 | GCCCAACTCCACACCAGCCTACGCACAG | AQLHTSNAYAQ | 13753 | LHTSNAY | 0.138339 | -0.18368 |
| SS160 | 4576 | GCCCAATCTTCTGGGCTGGGGACGCCTGCACAG | AQSSGLGTPAQ | 13754 | SSGLGTP | 0.138099 | -0.36216 |
| SyS2396 | 4577 | GCCCAAGAGCCACAAACCCGTCAGAGACGCACAG | AQDHKPVRDAQ | 13755 | DHKPVRD | 0.138062 | -0.16708 |
| GS1383 | 4578 | GCCCAAATGAAACTCGTCAGCGTCGGCGCACAG | AQMKLVSVGAQ | 13756 | MKLVSVG | 0.138012 | -0.12152 |
| SyS2397 | 4579 | GCCCAAGGTGAGCAGAGTCTTAAGGCGGCACAG | AQGEQSLKAAQ | 13757 | GEQSLKA | 0.137822 | -0.16102 |
| GS1385 | 4580 | GCCCAAATGACCAGCGGCACCAACGGCGCACAG | AQMTSGTNGAQ | 13758 | MTSGTNG | 0.137741 | -0.16304 |
| SyS2398 | 4581 | GCCCAACATGGGCTAAGGGTGTTGTTGCACAG | AQHAAKGVVAQ | 13759 | HAAKGVV | 0.137688 | -0.1392 |
| SyS2401 | 4582 | GCCCAAAGCAGCAGAGACAAAGAACCCGCACAG | AQSSRQNEPAQ | 13760 | SSRQNEP | 0.137659 | -0.23012 |
| SyS2402 | 4583 | GCCCAAGCCCTCATCAACAGACCCAACGCACAG | AQALINRPNAQ | 13761 | ALINRPN | 0.137501 | -0.08183 |
| SyS2403 | 4584 | GCCCAATTGAGGTCTTCATGGCGTCTGCACAG | AQLRSSMASAQ | 13762 | LRSSMAS | 0.137488 | -0.17072 |
| SyS2404 | 4585 | GCCCAAAATAATGAGTATTCGAAGCTGGCACAG | AQNNEYSKLAQ | 13763 | NNEYSKL | 0.137304 | -0.13033 |

FIG. 33 (Continued)

| | | | | | | | |
|---|---|---|---|---|---|---|---|
| GS1386 | 4586 | GCCCAAACTGGGCGTTTGAATGGGGAGGCACAG | 9175 | AQTGRLNGEAQ | 13764 | TGRLNGE | 0.137105 | -0.15001 |
| GS1387 | 4587 | GCCCAAACCAACAGCCACGCACCGTCAGAGCACAG | 9176 | AQTNSHAVRAQ | 13765 | TNSHAVR | 0.137064 | -0.10066 |
| SyS2406 | 4588 | GCCCAAATCGTCACCAACCACAGCCACGCACAG | 9177 | AQIVTNHSHAQ | 13766 | IVTNHSH | 0.136985 | 0.018624 |
| GS1388 | 4589 | GCCCAAGCCCTCACCAGAGACATCACCGCACAG | 9178 | AQALTRDITAQ | 13767 | ALTRDIT | 0.136966 | -0.10929 |
| SyS2407 | 4590 | GCCCAAGGCATCGCCAACCAAGGCGTCGCACAG | 9179 | AQGIANQGVAQ | 13768 | GIANQGV | 0.136871 | -0.02727 |
| GP188 | 4591 | GCCCAAAATACTGTGCGTTCTCAGCAGGCACAG | 9180 | AQNTVRSQQAQ | 13769 | NTVRSQQ | 0.136631 | -0.07079 |
| SyS2409 | 4592 | GCCCAAATGGAGAATTCGAATAAGGCTGCACAG | 9181 | AQMENSNKAAQ | 13770 | MENSNKA | 0.136602 | -0.21078 |
| SyS2410 | 4593 | GCCCAAGGTACGGTTAGGGTGCAGGCTGCACAG | 9182 | AQGTVRVQAAQ | 13771 | GTVRVQA | 0.136485 | -0.00948 |
| SyS2411 | 4594 | GCCCAAACCACCAGCCACCTCATCGACGCACAG | 9183 | AQTTSHLIDAQ | 13772 | TTSHLID | 0.136485 | -0.16223 |
| GS1389 | 4595 | GCCCAAGGTACGCAGGGCGCATCAGGGTGCACAG | 9184 | AQGTQAHQGAQ | 13773 | GTQAHQG | 0.13647 | -0.00419 |
| GS1390 | 4596 | GCCCAAAAAATGAGCGCGCAGCAGCGTCGCACAG | 9185 | AQKMSASSVAQ | 13774 | KMSASSV | 0.136227 | -0.15586 |
| SyS2414 | 4597 | GCCCAAAGCCTCAAAGTCAACCCGGCGCACAG | 9186 | AQSLKVNPGAQ | 13775 | SLKVNPG | 0.136211 | -0.22164 |
| GP189 | 4598 | GCCCAATCGACTGGGACGTCTACTCTTGCACAG | 9187 | AQSTGTSTLAQ | 13776 | STGTSTL | 0.136041 | 0.207438 |
| SyS2415 | 4599 | GCCCAAGTTTGACGAATCGTGAGCAGGCACAG | 9188 | AQVLTNREQAQ | 13777 | VLTNREQ | 0.135897 | -0.05665 |
| SyS2416 | 4600 | GCCCAACTCGACGTCAGCAGAACCCTCGCACAG | 9189 | AQLDVSRTLAQ | 13778 | LDVSRTL | 0.135826 | -0.18769 |
| SyS2417 | 4601 | GCCCAATCGTTGGGACTGAGAGTCGTGCACAG | 9190 | AQSFGTESRAQ | 13779 | SFGTESR | 0.135821 | 0.273431 |
| SyS2418 | 4602 | GCCCAACAGCTTGCGAAGGGAATTATGCACAG | 9191 | AQQLAKGNYAQ | 13780 | QLAKGNY | 0.135676 | -0.22557 |
| SyS2419 | 4603 | GCCCAAGCCAAAAACGACCCAGAGCCGCACAG | 9192 | AQAKNDPRAAQ | 13781 | AKNDPRA | 0.135675 | 0.015165 |
| SyS2420 | 4604 | GCCCAACTCACCCAAGTCGGCGGCACCGCACAG | 9193 | AQLTQVGGTAQ | 13782 | LTQVGGT | 0.135637 | -0.18163 |
| SyS2421 | 4605 | GCCCAAAAGCAGAATACTTCTCTGGCACAG | 9194 | AQKQNTTSLAQ | 13783 | KQNTTSL | 0.135601 | -0.23133 |
| SyS2423 | 4606 | GCCCAACTTTCGACTAGGGCTGAGGATGCACAG | 9195 | AQLSTRAEDAQ | 13784 | LSTRAED | 0.135448 | -0.23419 |
| GS1394 | 4607 | GCCCAAACCGTCCCCAACATCCCCATGGCACAG | 9196 | AQTVPNIPMAQ | 13785 | TVPNIPM | 0.135363 | -0.15317 |
| GS1395 | 4608 | GCCCAAAATTCGTTGTCTAAGCTGTCGGCACAG | 9197 | AQNSLSKLSAQ | 13786 | NSLSKLS | 0.13513 | -0.00256 |
| SyS2424 | 4609 | GCCCAAATGAATGAGCATCAGATGAAGGCACAG | 9198 | AQMNEHQMKAQ | 13787 | MNEHQMK | 0.135017 | -0.20339 |
| GS1396 | 4610 | GCCCAAGACGTCAAAGGCCACCAAAGCGCACAG | 9199 | AQDVKGHQSAQ | 13788 | DVKGHQS | 0.135013 | -0.096 |
| SyS2427 | 4611 | GCCCAAGACGTCAGCGTCCAAAAAGACGCACAG | 9200 | AQDVSLQKDAQ | 13789 | DVSLQKD | 0.134944 | -0.11931 |
| GS1397 | 4612 | GCCCAAACCAGACCCAGCGGCACCTACGCACAG | 9201 | AQTRPSGTYAQ | 13790 | TRPSGTY | 0.134868 | -0.16932 |
| SyS2429 | 4613 | GCCCAAGTTAAGGGGCCGGATTCTCTTGCACAG | 9202 | AQVKGPDSLAQ | 13791 | VKGPDSL | 0.134815 | -0.1792 |
| SyS2430 | 4614 | GCCCAAAACCACCAGCAGTCTACGAACTCGCACAG | 9203 | AQNHSSYELAQ | 13792 | NHSSYEL | 0.13473 | -0.14526 |
| SyS2431 | 4615 | GCCCAAACCGTCAGAACCCCTCATCGCACAG | 9204 | AQTVRTPLIAQ | 13793 | TVRTPLI | 0.134668 | -0.23497 |
| SyS2432 | 4616 | GCCCAAGCCAGCATCGACACGACCAACACGCACAG | 9205 | AQASIDSQHAQ | 13794 | ASIDSQH | 0.134524 | -0.20093 |
| GS1401 | 4617 | GCCCAAGATCAGAGAAGAATTCTGGGCATGCACAG | 9206 | AQDQKNSGHAQ | 13795 | DQKNSGH | 0.134505 | -0.18054 |

FIG. 33 (Continued)

| | | | | | | | | |
|---|---|---|---|---|---|---|---|---|
| SyS2434 | 4618 | GCCCAACTGACACCAACAACAAAGCCGCACAG | 9207 | AQLDTNNKAAQ | 13796 | LDTNNKA | 0.134292 | 0.171043 |
| GP190 | 4619 | GCCCAAGCGGAGTGCTCATGCGCAGGTTGCACAG | 9208 | AQASAHAQVAQ | 13797 | ASAHAQV | 0.134161 | 0.132411 |
| GS1403 | 4620 | GCCCAAGACAGCGGCAAACAACGACGCACAG | 9209 | AQDSGKHNDAQ | 13798 | DSGKHND | 0.134104 | -0.17919 |
| GS1404 | 4621 | GCCCAACTTAATCGGAATAGTGGTATGGCACAG | 9210 | AQLNRNSGMAQ | 13799 | LNRNSGM | 0.134006 | -0.08579 |
| SyS2436 | 4622 | GCCCAACCCACCATGCTCCCGACAAAGCACAG | 9211 | AQPTMLPDKAQ | 13800 | PTMLPDK | 0.133981 | -0.21818 |
| GS1406 | 4623 | GCCCAAAGCACCCAAGTCAGCAACTACGCACAG | 9212 | AQSTQVSNYAQ | 13801 | STQVSNY | 0.133756 | -0.10556 |
| SyS2439 | 4624 | GCCCAATCTAATCAGACGCTGATGAGTGCACAG | 9213 | AQSNQTLMSAQ | 13802 | SNQTLMS | 0.133656 | -0.2268 |
| GS1407 | 4625 | GCCCAAAGAAAACCCGGCAGCACCAGCGCACAG | 9214 | AQRNPGSTSAQ | 13803 | RNPGSTS | 0.133603 | -0.05879 |
| GS1409 | 4626 | GCCCAACGTATGGCTCAGGGTTATAGTGCACAG | 9215 | AQRMAQGYSAQ | 13804 | RMAQGYS | 0.133569 | -0.1747 |
| SyS2441 | 4627 | GCCCAACAGGTTATGCGTCAGAGTAGTGCACAG | 9216 | AQQVMRQSSAQ | 13805 | QVMRQSS | 0.133377 | -0.22649 |
| SyS2442 | 4628 | GCCCAAAAGAATACGACGGTTAGTGATGCACAG | 9217 | AQKNTTVSDAQ | 13806 | KNTTVSD | 0.133377 | -0.22649 |
| SyS2443 | 4629 | GCCCAAACGGCAAAACCGCAGAGACGCACAG | 9218 | AQTGKTARDAQ | 13807 | TGKTARD | 0.133287 | -0.17382 |
| SyS2444 | 4630 | GCCCAAATCCTCAGAAACCCTCACGAAGCACAG | 9219 | AQILRTLTEAQ | 13808 | ILRTLTE | 0.133244 | -0.12829 |
| GS1411 | 4631 | GCCCAAAGACTCGACAACGCGGCATGGCACAG | 9220 | AQRLDNAGMAQ | 13809 | RLDNAGM | 0.133189 | -0.08971 |
| SyS2445 | 4632 | GCCCAAAGTGGTACTGGTAGGCAGCAGGCACAG | 9221 | AQSGTGRQQAQ | 13810 | SGTGRQQ | 0.133033 | -0.1101 |
| SyS2447 | 4633 | GCCCAACTCGGCAAAGACACCTTCAGCGCACAG | 9222 | AQLGKDTFSAQ | 13811 | LGKDTFS | 0.132869 | -0.1242 |
| GS1413 | 4634 | GCCCAACGGTATGATGGGTCTGTGGCTGCACAG | 9223 | AQRYDGSVAAQ | 13812 | RYDGSVA | 0.132847 | -0.13504 |
| SyS2448 | 4635 | GCCCAGGCCCACTACCCGCCAGCACCGCACAG | 9224 | AQAHYPASTAQ | 13813 | AHYPAST | 0.132836 | -0.14405 |
| SyS2449 | 4636 | GCCCAAAAAGCAACGGCAGCCCCTCGCACAG | 9225 | AQKSNGSPLAQ | 13814 | KSNGSPL | 0.132749 | -0.09137 |
| SyS2450 | 4637 | GCCCAAAGAGACCTGTCTTCTCACCAAAGCACAG | 9226 | AQRDLVLTKAQ | 13815 | RDLVLTK | 0.132711 | -0.13986 |
| SyS2451 | 4638 | GCCCAACCAGCAACCCGCAACATGGCACAG | 9227 | AQTSNPGNMAQ | 13816 | TSNPGNM | 0.132642 | -0.18405 |
| GS1414 | 4639 | GCCCAATTGCCGAGGCCGAGTAATACGGCACAG | 9228 | AQLPRPSNTAQ | 13817 | LPRPSNT | 0.132631 | -0.16573 |
| SyS2452 | 4640 | GCCCAAACCGGCGGCGGCAGCTTCAGCGCACAG | 9229 | AQTGGGSFSAQ | 13818 | TGGGSFS | 0.132596 | 0.004539 |
| SyS2454 | 4641 | GCCCAATACCCCAACAAAGAACTCAGCGCACAG | 9230 | AQYPNKELSAQ | 13819 | YPNKELS | 0.132195 | -0.06134 |
| SyS2456 | 4642 | GCCCAAACGATGGTGCATCAGGAGTCTGCACAG | 9231 | AQTMVHQESAQ | 13820 | TMVHQES | 0.132057 | -0.01475 |
| SyS2457 | 4643 | GCCCAAGTTAATAGTAATAATTCGATGGCACAG | 9232 | AQVNSNNSMAQ | 13821 | VNSNNSM | 0.132035 | -0.11468 |
| GS1416 | 4644 | GCCCAAAACGGCGTCACGTCACCCCCGCACAG | 9233 | AQNGVHVTPAQ | 13822 | NGVHVTP | 0.132015 | -0.04532 |
| SyS2458 | 4645 | GCCCAAGCCAAATACCTCAACAGCAACGCACAG | 9234 | AQAKYLNSNAQ | 13823 | AKYLNSN | 0.131997 | -0.13316 |
| SyS2460 | 4646 | GCCCAAGGTATGACGAAGAATGGTGGGGCACAG | 9235 | AQGMTKNGGAQ | 13824 | GMTKNGG | 0.131765 | 0.019619 |
| SyS2461 | 4647 | GCCCAACGGCGCGTGATGAGGGTATGGCACAG | 9236 | AQRARDEGMAQ | 13825 | RARDEGM | 0.131684 | -0.09036 |
| GS1418 | 4648 | GCCCAAGTCCCAGCCCCGGCGCCACCGCACAG | 9237 | AQVPSPGATAQ | 13826 | VPSPGAT | 0.131628 | -0.18188 |
| GS1419 | 4649 | GCCCAAAAAACCCAACTCGGCCAAATGGCACAG | 9238 | AQKTQLGQMAQ | 13827 | KTQLGQM | 0.131628 | -0.18188 |

FIG. 33 (Continued)

| | | | | | | |
|---|---|---|---|---|---|---|
| SyS2462 | 4650 | GCCCAATCTACTTCGACGATTCAGCGGCACAG | 9239 AQSTSTIQPAQ | 13828 STSTIQP | 0.131508 | -0.12707 |
| SyS2463 | 4651 | GCCCAACGTAAGGAGAATGCTAGTTATGCACAG | 9240 AQRKENASYAQ | 13829 RKENASY | 0.131186 | -0.19739 |
| SyS2464 | 4652 | GCCCAACTGACGAATCATGGGAATGTTGCACAG | 9241 AQLTNHGNVAQ | 13830 LTNHGNV | 0.131105 | -0.11468 |
| SyS2465 | 4653 | GCCCAACTCGACAACGTCCACAGCCACGCACAG | 9242 AQLDNVHSHAQ | 13831 LDNVHSH | 0.131105 | -0.20339 |
| SyS2466 | 4654 | GCCCAACCCACCATGGCCGTCACCCCGCACAG | 9243 AQPTMAVTPAQ | 13832 PTMAVTP | 0.131105 | -0.22557 |
| SyS2467 | 4655 | GCCCAAAAGCCTGAGCGTACTGAGGCGGCACAG | 9244 AQKPERTEAAQ | 13833 KPERTEA | 0.131079 | -0.17314 |
| GS1420 | 4656 | GCCCAAACCGGCGACAGAAAAGGGGCGCACAG | 9245 AQTGDRKSGAQ | 13834 TGDRKSG | 0.131063 | -0.16623 |
| GS1421 | 4657 | GCCCAAGCTAAGCATACTTCGTTTCCTGCACAG | 9246 AQAKHTSFPAQ | 13835 AKHTSFP | 0.131036 | -0.171 |
| GS1422 | 4658 | GCCCAAGGGTTGGTTGCGTCGTTGGGGGCACAG | 9247 AQGLVASLGAQ | 13836 GLVASLG | 0.131036 | -0.171 |
| SyS2468 | 4659 | GCCCAATCTGTTCCTAGGTCGGAGTTGGCACAG | 9248 AQSVPRSELAQ | 13837 SVPRSEL | 0.130804 | -0.11824 |
| GS1425 | 4660 | GCCCAAGCTGAGAGGATTGGTATGGGGTGCACAG | 9249 AQAERIGMGAQ | 13838 AERIGMG | 0.130715 | -0.04864 |
| SyP69 | 4661 | GCCCAATCTCTGGTTCGGCAGTCTGATGCACAG | 9250 AQSLVRQSDAQ | 13839 SLVRQSD | 0.130711 | -0.04411 |
| SyS2470 | 4662 | GCCCAACACGTCAAAGCCAACCCATCGCACAG | 9251 AQHVKANPIAQ | 13840 HVKANPI | 0.130681 | -0.20093 |
| SyS2473 | 4663 | GCCCAAGTCGTCGACACCCTCAAAAACGCACAG | 9252 AQVVDTLKNAQ | 13841 VVDTLKN | 0.130632 | -0.11957 |
| SyS2474 | 4664 | GCCCAACAGATTCCTTATAATTCGTCGGCACAG | 9253 AQQIPYNSSAQ | 13842 QIPYNSS | 0.130617 | 0.06558 |
| SyS2475 | 4665 | GCCCAAGCTGATCATTCTATGCATGTTGCACAG | 9254 AQADHSMHVAQ | 13843 ADHSMHV | 0.130612 | -0.2231 |
| SyS2476 | 4666 | GCCCAAAACCACGTCACCGCCCAAGCGCACAG | 9255 AQNHVTAQAAQ | 13844 NHVTAQA | 0.130454 | -0.0399 |
| GS1429 | 4667 | GCCCAACCAACTTCACCAAAGCGGCGCACAG | 9256 AQTNFTKSGAQ | 13845 TNFTKSG | 0.130388 | 0.51224 |
| SyS2477 | 4668 | GCCCAATATGGTCATTCGATGACTAATGCACAG | 9257 AQYGHSMTNAQ | 13846 YGHSMTN | 0.130368 | -0.17678 |
| SyS2479 | 4669 | GCCCAAATGAGACCGGACCTCAAAACGCACAG | 9258 AQMRPDLKTAQ | 13847 MRPDLKT | 0.130368 | -0.23133 |
| SyS2480 | 4670 | GCCCAAGGCCCGGCACCAGCTTCAAAGCACAG | 9259 AQGPGTSFKAQ | 13848 GPGTSFK | 0.130368 | -0.23133 |
| SyS2481 | 4671 | GCCCAAGTTCTACGACTCCTGGGCTTGCACAG | 9260 AQSSTTPGLAQ | 13849 SSTTPGL | 0.130295 | -0.09714 |
| SS170 | 4672 | GCCCAATCGGTGAAGGCTAATCCTACTGCACAG | 9261 AQSVKANPTAQ | 13850 SVKANPT | 0.130019 | -0.37951 |
| GS1430 | 4673 | GCCCAAACCCCACCGTCTTCACCCCGCACAG | 9262 AQTPTVFTPAQ | 13851 TPTVFTP | 0.129999 | -0.15574 |
| GP193 | 4674 | GCCCAAATGCTGCCTAGTCCTGGGTCGGCACAG | 9263 AQMLPSPGSAQ | 13852 MLPSPGS | 0.129923 | -0.06982 |
| GS1432 | 4675 | GCCCAAAACTTCGACTACGGCAAACCCGCACAG | 9264 AQNFDYAKPAQ | 13853 NFDYAKP | 0.129793 | -0.15945 |
| SyS2482 | 4676 | GCCCAAACCCTCAACACCAGCCCCATGGCACAG | 9265 AQTLNTSPMAQ | 13854 TLNTSPM | 0.129754 | -0.11431 |
| SyS2483 | 4677 | GCCCAAAACCAACAGCCCCAAAAGCACCGCACAG | 9266 AQTNSPKSTAQ | 13855 TNSPKST | 0.129681 | -0.17136 |
| SyS2484 | 4678 | GCCCAAGTCACCCCGGCAGATACAGGCACAG | 9267 AQVTPGRYSAQ | 13856 VTPGRYS | 0.129681 | -0.17136 |
| SyS2485 | 4679 | GCCCAAACCAGAGTCAGCAACCTGACGCACAG | 9268 AQTRVSNLDAQ | 13857 TRVSNLD | 0.129667 | 0.015982 |
| GS1433 | 4680 | GCCCAAAGTCATGGTCCTGATAGGACGGCACAG | 9269 AQSHGPDRTAQ | 13858 SHGPDRT | 0.129608 | -0.18278 |
| SyS2488 | 4681 | GCCCAAAATATTCATACGGCTACGACTGCACAG | 9270 AQNIHTATTAQ | 13859 NIHTATT | 0.12948 | -0.21072 |

FIG. 33 (Continued)

| ID | No. | Sequence | No. | Sequence | No. | Pep | Val1 | Val2 |
|---|---|---|---|---|---|---|---|---|
| SyS2490 | 4682 | GCCCAATTGCTTCCGCAGACTACGCTTGCACAG | 9271 | AQLLPQTTLAQ | 13860 | LLPQTTL | 0.129383 | -0.05215 |
| SyS2491 | 4683 | GCCCAACGTACTAATGATACTTCGGCGGCACAG | 9272 | AQRTNDTSAAQ | 13861 | RTNDTSA | 0.12914 | -0.15534 |
| GS1435 | 4684 | GCCCAAGAAAGAAACGGGCAGCCACGAAGCACAG | 9273 | AQERNGSHEAQ | 13862 | ERNGSHE | 0.129106 | -0.14524 |
| GS1436 | 4685 | GCCCAAAACACCAGAGAAGCCTTCATCGCACAG | 9274 | AQNTREAFIAQ | 13863 | NTREAFI | 0.129068 | -0.15676 |
| GS1437 | 4686 | GCCCAAGTCGGCCAATACGCAGCCCGCACAG | 9275 | AQVGQYASPAQ | 13864 | VGQYASP | 0.129006 | 0.012421 |
| GS1438 | 4687 | GCCCAAGTCGCGAAACCGGCAGAACCGCGCACAG | 9276 | AQVAETGRTAQ | 13865 | VAETGRT | 0.128986 | -0.17672 |
| GS1439 | 4688 | GCCCAAATGAGCGCCGGGCAGCAACAGCGCACAG | 9277 | AQMSAGSNSAQ | 13866 | MSAGSNS | 0.128951 | -0.17381 |
| SyS2492 | 4689 | GCCCAACTCAGCCCCAAAAACGCCCAAGCACAG | 9278 | AQLSPKNAQAQ | 13867 | LSPKNAQ | 0.128916 | -0.17799 |
| SyS2497 | 4690 | GCCCAAGCGGGCACCAGCCAACTCCCGCACAG | 9279 | AQSGTSQLPAQ | 13868 | SGTSQLP | 0.128594 | -0.19969 |
| SS171 | 4691 | GCCCAAAGACTCCAAGACACAAACCCCAAGCACAG | 9280 | AQRLQDKPQAQ | 13869 | RLQDKPQ | 0.12854 | -0.41153 |
| SyS2498 | 4692 | GCCCAAAACGTCCCCAGAAGCAGCGTCGCACAG | 9281 | AQNVPRSSVAQ | 13870 | NVPRSSV | 0.128415 | -0.15738 |
| SyS2500 | 4693 | GCCCAAGCCCTCGGCAGCCCCAGACCCGCACAG | 9282 | AQALGSPRPAQ | 13871 | ALGSPRP | 0.128407 | -0.13686 |
| SyS2501 | 4694 | GCCCAAGCGAAGGAGCCTATGAGTGCGGCACAG | 9283 | AQAKEPMSAAQ | 13872 | AKEPMSA | 0.128223 | -0.19723 |
| GS1441 | 4695 | GCCCAAGCCGTCAGCGGCGCCCACGCACAG | 9284 | AQAVSGAAHAQ | 13873 | AVSGAAH | 0.128127 | -0.15781 |
| SyS2502 | 4696 | GCCCAATACAACAACACAAAGCGCCGCCGCACAG | 9285 | AQYNNKSAAAQ | 13874 | YNNKSAA | 0.12811 | -0.15904 |
| SyS2503 | 4697 | GCCCAACAAGTCAGCGTCAGAAACCTCGCACAG | 9286 | AQQVSVRNLAQ | 13875 | QVSVRNL | 0.12807 | -0.18769 |
| SyS2504 | 4698 | GCCCAAAGGGGTACTCATCCTCCGGCTGCACAG | 9287 | AQKGTHPPAAQ | 13876 | KGTHPPA | 0.12807 | -0.18769 |
| GS1442 | 4699 | GCCCAACAGTATCCTAATAGTAAGGTTGCACAG | 9288 | AQQYPNSKVAQ | 13877 | QYPNSKV | 0.128026 | -0.16623 |
| SyS2505 | 4700 | GCCCAACAACATAATGCTTCGAATTCTGGGGCACAG | 9289 | AQHNASNSGAQ | 13878 | HNASNSG | 0.127942 | -0.14283 |
| SyS2507 | 4701 | GCCCAAGAACTCAACCCAAATTCATCGCACAG | 9290 | AQELNPKFIAQ | 13879 | ELNPKFI | 0.127896 | -0.19981 |
| SyS2508 | 4702 | GCCCAATCGCGTGAGACTCCTGGGACTGCACAG | 9291 | AQSRETPGTAQ | 13880 | SRETPGT | 0.127851 | 0.095109 |
| SyS2509 | 4703 | GCCCAAAATTTAAGCCGCAGAATGAGGCACAG | 9292 | AQNFKPQNEAQ | 13881 | NFKPQNE | 0.127738 | -0.18121 |
| SyS2510 | 4704 | GCCCAAGCTATGACTTCGGGGGTCGGCGGCACAG | 9293 | AQAMTSGSAAQ | 13882 | AMTSGSA | 0.127637 | -0.16708 |
| GS1443 | 4705 | GCCCAAAAGGATCCGAGGAGTACGTTGGCACAG | 9294 | AQKDPRSTLAQ | 13883 | KDPRSTL | 0.127399 | -0.16842 |
| GS1444 | 4706 | GCCCAAGACAGAGAGGCACCAGAACCGTCGCACAG | 9295 | AQDRGTRTVAQ | 13884 | DRGTRTV | 0.127399 | -0.16842 |
| GS1445 | 4707 | GCCCAAAGCCTCGCCAGAAACAACGTCGCACAG | 9296 | AQSLARNNVAQ | 13885 | SLARNNV | 0.127397 | -0.15097 |
| SyS2511 | 4708 | GCCCAAGCCATCAGATTCAACGAACCCGCACAG | 9297 | AQAIRFNEPAQ | 13886 | AIRFNEP | 0.127317 | -0.23012 |
| SyS2512 | 4709 | GCCCAACAACACAGATTTGAGGGAGCCGGTGGCACAG | 9298 | AQQHHIATPAQ | 13887 | QHHIATP | 0.127284 | 0.014485 |
| GS1447 | 4710 | GCCCAACAACTGTTGTTAATAAGCTTAGTGCACAG | 9299 | AQQILREPVAQ | 13888 | QILREPV | 0.127158 | -0.17291 |
| GS1448 | 4711 | GCCCAAACTGTTGTTAATAAGCTTAGTGCACAG | 9300 | AQTVVNKLSAQ | 13889 | TVVNKLS | 0.127158 | -0.17291 |
| SyS2513 | 4712 | GCCCAAAGAGAGACAACACCACCAAATTCGCACAG | 9301 | AQRDNTTKFAQ | 13890 | RDNTTKF | 0.127154 | 0.054334 |
| SyS2515 | 4713 | GCCCAAAGCCTCCTCAGCACCCCTCGGCGCACAG | 9302 | AQSLLSTLGAQ | 13891 | SLLSTLG | 0.127046 | -0.22803 |

FIG. 33 (Continued)

| | | | | | | | | |
|---|---|---|---|---|---|---|---|---|
| SyS2516 | 4714 | GCCCAAGGCCAAGTCCCGTCACCAGAGCACAG | 9303 | AQGQVPVTRAQ | 13892 | GQVPVTR | 0.126817 | -0.1319 |
| SyS2517 | 4715 | GCCCAAATCCAAAACAGCCTCATGCCGCACAG | 9304 | AQIQNSLMPAQ | 13893 | IQNSLMP | 0.126654 | -0.0084 |
| GP194 | 4716 | GCCCAACAGCATAATACGCAGAATACTGCACAG | 9305 | AQQHNTQNTAQ | 13894 | QHNTQNT | 0.126648 | -0.07218 |
| SyS2518 | 4717 | GCCCAAGTCGGCCCCACCATGACCCACGCACAG | 9306 | AQVGPTMTHAQ | 13895 | VGPTMTH | 0.126491 | -0.15781 |
| GS1450 | 4718 | GCCCAAACCAACGTCACCATGGCCAGAGCACAG | 9307 | AQTNVTMARAQ | 13896 | TNVTMAR | 0.126427 | -0.17481 |
| GS1451 | 4719 | GCCCAAAGGCGCCCACTTCACCGGCACCGCACAG | 9308 | AQSAHFTGTAQ | 13897 | SAHFTGT | 0.126427 | -0.17481 |
| GS1453 | 4720 | GCCCAAAGATACAGCGTCAACGACAAAGCACAG | 9309 | AQRYSVNDKAQ | 13898 | RYSVNDK | 0.126337 | -0.17201 |
| SyS2519 | 4721 | GCCCAAGTCTACAAAAGCGCCGACCCCGCACAG | 9310 | AQVYKSADPAQ | 13899 | VYKSADP | 0.126276 | -0.13556 |
| SyS2521 | 4722 | GCCCAAGTCCACACCGCCCTCCCATGGCACAG | 9311 | AQVHTALPMAQ | 13900 | VHTALPM | 0.126124 | -0.17435 |
| SyS2522 | 4723 | GCCCAAACTATTAGTAGTGCTGGTATTGCACAG | 9312 | AQTISSAGIAQ | 13901 | TISSAGI | 0.126033 | -0.07473 |
| GS1455 | 4724 | GCCCAAAGGTTGCCTTCGACTCAGGCGGCACAG | 9313 | AQRLPSTQAAQ | 13902 | RLPSTQA | 0.126016 | -0.12848 |
| SyS2523 | 4725 | GCCCAAAGCCAAGAAAGAGCCATGAGCGCACAG | 9314 | AQSQERAMSAQ | 13903 | SQERAMS | 0.125872 | -0.20709 |
| GS1456 | 4726 | GCCCAAATGAATCAGCTTGCGAATCCTGCACAG | 9315 | AQMNQLANPAQ | 13904 | MNQLANP | 0.125837 | -0.12712 |
| SyS2524 | 4727 | GCCCAATTTGGGGCGACTAGTGGGCAGGCACAG | 9316 | AQFGATSGQAQ | 13905 | FGATSGQ | 0.12559 | -0.11323 |
| SyS2525 | 4728 | GCCCAAACGCTTCTTCGTTCTCCTGCTGCACAG | 9317 | AQTLLRSPAAQ | 13906 | TLLRSPA | 0.125488 | -0.14526 |
| GS1457 | 4729 | GCCCAACTTAGGTCGAATGTGTCGAATGCACAG | 9318 | AQLRSNVSNAQ | 13907 | LRSNVSN | 0.125352 | -0.12087 |
| GS1458 | 4730 | GCCCAAATCGCCAACAGCCAAGCGCCGCACAG | 9319 | AQIANSQAAAQ | 13908 | IANSQAA | 0.125352 | -0.10113 |
| TS177 | 4731 | GCCCAATCTAATCGTATTGTGCCTGTTGCACAG | 9320 | AQSNRIVPVAQ | 13909 | SNRIVPV | 0.125315 | -0.25713 |
| GP197 | 4732 | GCCCAATCTCCGAATCCTTCTAATGCGGCACAG | 9321 | AQSPNPSNAAQ | 13910 | SPNPSNA | 0.125295 | -0.0703 |
| SyS2526 | 4733 | GCCCAAAAATGGGACAGCGCCAACGAAGCACAG | 9322 | AQKWDSANEAQ | 13911 | KWDSANE | 0.125284 | -0.10361 |
| SyS2527 | 4734 | GCCCAAGCTTCGTCGTCAGGGTGAGGCTGCACAG | 9323 | AQASRQGEAAQ | 13912 | ASRQGEA | 0.125259 | -0.10404 |
| SyS2528 | 4735 | GCCCAAGTTCCTGGGAATAGTCCTCATGCACAG | 9324 | AQVPGNSPHAQ | 13913 | VPGNSPH | 0.125198 | -0.15738 |
| SyS2529 | 4736 | GCCCAAAGCGCCACCACCAACAGCGTCGCACAG | 9325 | AQSATTNSVAQ | 13914 | SATTNSV | 0.125189 | 0.067512 |
| SyS2530 | 4737 | GCCCAACACATCGGCGCCAGACAAGTCGCACAG | 9326 | AQHIGARQVAQ | 13915 | HIGARQV | 0.125155 | -0.15904 |
| GS1462 | 4738 | GCCCAACTTACGGATCGTTCTCCTATGGCACAG | 9327 | AQLTDRSPMAQ | 13916 | LTDRSPM | 0.125019 | -0.13728 |
| SyS2531 | 4739 | GCCCAAAATCCGACGCAGGCTGTTTTGGCACAG | 9328 | AQNPTQAVLAQ | 13917 | NPTQAVL | 0.124871 | -0.21679 |
| GS1464 | 4740 | GCCCAAACCAAAAACGAAACCGGCACCGCACAG | 9329 | AQTKNETGTAQ | 13918 | TKNETGT | 0.124832 | -0.05823 |
| SyS2533 | 4741 | GCCCAACTCACCGCCACCCTCACCAGCGCACAG | 9330 | AQLTATLTSAQ | 13919 | LTATLTS | 0.124607 | -0.2268 |
| SyS2535 | 4742 | GCCCAATATAAGGCTAGTTATGCTGCGGGCACAG | 9331 | AQYKASYAAAQ | 13920 | YKASYAA | 0.124548 | -0.07814 |
| SyS2536 | 4743 | GCCCAAACTCTTCCTGATAAGGTGTCGGCACAG | 9332 | AQTLPDKVSAQ | 13921 | TLPDKVS | 0.124499 | -0.18163 |
| SyS2537 | 4744 | GCCCAAAATAATCATATTCCTTGGCTGCACAG | 9333 | AQNNHIPLAAQ | 13922 | NNHIPLA | 0.12448 | -0.10087 |
| SyS2538 | 4745 | GCCCAATCTAATCTGACGGTCTAATCCTGCACAG | 9334 | AQSNLTSNPAQ | 13923 | SNLTSNP | 0.124443 | 0.020734 |

FIG. 33 (Continued)

| | | | | | | | | |
|---|---|---|---|---|---|---|---|---|
| SS177 | 4746 | GCCCAACAACAACAAAACGACAGAAACGCCGCACAG | 9335 | AQQQNDRNAAQ | 13924 | QQNDRNA | 0.124316 | -0.33917 |
| SyS2540 | 4747 | GCCCAAATGCTCAGCACCAACAGAAGCGCACAG | 9336 | AQMLSTNRSAQ | 13925 | MLSTNRS | 0.124294 | -0.18769 |
| SyS2541 | 4748 | GCCCAAATCACCAGCGCCACCCTCAGCGCACAG | 9337 | AQITSATLSAQ | 13926 | ITSATLS | 0.124242 | -0.22434 |
| GS1465 | 4749 | GCCCAAGTCGACGCCATGCAAAGACCCGCACAG | 9338 | AQVDAMQRPAQ | 13927 | VDAMQRP | 0.124217 | -0.16051 |
| GS1466 | 4750 | GCCCAAAGAGAAGCCAACTACGCCAGCGCACAG | 9339 | AQREANYASAQ | 13928 | REANYAS | 0.124095 | -0.18368 |
| GS1467 | 4751 | GCCCAACGTAGTAATAATGCTGATCTGGCACAG | 9340 | AQRSNNADLAQ | 13929 | RSNNADL | 0.12408 | -0.18054 |
| SyS2542 | 4752 | GCCCAAGGCCTCGACAAAATGGGCAGCGCACAG | 9341 | AQGLDKMGSAQ | 13930 | GLDKMGS | 0.124074 | -0.00826 |
| GS1468 | 4753 | GCCCAATTCACCACCAGCCACGCCCCGCACAG | 9342 | AQFTTSHAPAQ | 13931 | FTTSHAP | 0.123988 | -0.13761 |
| GS1469 | 4754 | GCCCAAGACAAAAGCGTCAAATTCGCCGCACAG | 9343 | AQDKSVKFAAQ | 13932 | DKSVKFA | 0.123988 | -0.13761 |
| SyS2544 | 4755 | GCCCAACACGCCAAAAAAGAACTCCAAGCACAG | 9344 | AQHAKKELQAQ | 13933 | HAKKELQ | 0.123802 | -0.22042 |
| SyS2546 | 4756 | GCCCAAGTCGAAAGCAAAGGCGCCAGCGCACAG | 9345 | AQVESKGASAQ | 13934 | VESKGAS | 0.123704 | 0.11358 |
| GS1470 | 4757 | GCCCAAAAAACCGCCCCCAGCATGGGCGCACAG | 9346 | AQKTAPSMGAQ | 13935 | KTAPSMG | 0.123698 | -0.14537 |
| GS1471 | 4758 | GCCCAAGGCCTCAGAACCGACAACAGAGCACAG | 9347 | AQGLRTDNRAQ | 13936 | GLRTDNR | 0.123641 | -0.1476 |
| SyS2548 | 4759 | GCCCAACGTATTGCGGGGATAATCCTGCACAG | 9348 | AQRIAGNNPAQ | 13937 | RIAGNNP | 0.123582 | -0.1295 |
| GS1472 | 4760 | GCCCAAAAAGACCCCCACCAGTCGTCGCACAG | 9349 | AQKDPHQVVAQ | 13938 | KDPHQVV | 0.123524 | -0.16241 |
| SyS2549 | 4761 | GCCCAAGAGCAGACTCCGCATAATTCGGCACAG | 9350 | AQEQTPHNSAQ | 13939 | EQTPHNS | 0.123505 | -0.22649 |
| SyS2550 | 4762 | GCCCAAGGGCTGGATAAGGGGAATTGGGCACAG | 9351 | AQGLDKGNWAQ | 13940 | GLDKGNW | 0.12349 | -0.08183 |
| SyS2551 | 4763 | GCCCAACCTTCGAATGGGAATTATTCGGCACAG | 9352 | AQPSNGNYSAQ | 13941 | PSNGNYS | 0.123474 | -0.17072 |
| SyS2552 | 4764 | GCCCAAGGCAGACCCGGCATCGGCAGCGCACAG | 9353 | AQGRPGIGSAQ | 13942 | GRPGIGS | 0.123474 | -0.17072 |
| SyS2553 | 4765 | GCCCAAAGGACGTCTCTGGGGTGTCGGCACAG | 9354 | AQRTSPGVSAQ | 13943 | RTSPGVS | 0.123431 | -0.18737 |
| SyS2554 | 4766 | GCCCAAGTCAACGCCAGCCTCATCAGCGCACAG | 9355 | AQVNASLISAQ | 13944 | VNASLIS | 0.123431 | -0.18737 |
| SyS2555 | 4767 | GCCCAAAAAACCAGCAACCTCCAAGCACAG | 9356 | AQKTSTNLQAQ | 13945 | KTSTNLQ | 0.1234 | -0.13556 |
| SyS2556 | 4768 | GCCCAAATGGATATGAAGCAGAATATGGCACAG | 9357 | AQMDMKQNMAAQ | 13946 | MDMKQNM | 0.123199 | -0.09592 |
| SyS2557 | 4769 | GCCCAAGATCTTAATGGGATTAATGTTGCACAG | 9358 | AQDLNGINVAQ | 13947 | DLNGINV | 0.12317 | -0.17988 |
| GS1475 | 4770 | GCCCAACGTACGCCTCCGAGTTTTGAGGCACAG | 9359 | AQRTPPSFEAQ | 13948 | RTPPSFE | 0.122987 | -0.12067 |
| SyS2559 | 4771 | GCCCAAGACTTCCACGACAGAAAAGGGCGCACAG | 9360 | AQDFHDRKGAQ | 13949 | DFHDRKG | 0.122909 | -0.13314 |
| GS1476 | 4772 | GCCCAACTCCACACCCAAACCGCACAG | 9361 | AQLHTQTQTAQ | 13950 | LHTQTQT | 0.122656 | -0.17381 |
| SyS2561 | 4773 | GCCCAACTCGGCGCCAGCAACAACGCCGCACAG | 9362 | AQLGASNNAAQ | 13951 | LGASNNA | 0.122644 | -0.09068 |
| SyS2562 | 4774 | GCCCAAATCGCCAGCGTCCCCAGAGACGCACAG | 9363 | AQIASVPRDAQ | 13952 | IASVPRD | 0.122568 | -0.22803 |
| SyS2563 | 4775 | GCCCAAAAAGCAAAGACGTCGGCGACGCACAG | 9364 | AQKAKDVGDAQ | 13953 | KAKDVGD | 0.122492 | -0.14548 |
| SyS2564 | 4776 | GCCCAAAGCGCCTTCGCCGCCAAACAAGCACAG | 9365 | AQSAFAAKQAQ | 13954 | SAFAAKQ | 0.122374 | -0.11616 |
| SyS2565 | 4777 | GCCCAAGTCTACCAAGGCCAACACCTCGCACAG | 9366 | AQVYQGQHLAQ | 13955 | VYQGQHL | 0.12237 | -0.19353 |

FIG. 33 (Continued)

| | | | | | | | | |
|---|---|---|---|---|---|---|---|---|
| SyS2567 | 4778 | GCCCAATACCTCCCGCGCCAGCAGCGCACAG | 9367 | AQYLPAASSAQ | 13956 | YLPAASS | 0.122028 | -0.15738 |
| SyS2568 | 4779 | GCCCAAAGCCCCAGCACCGTCATCAGCGCACAG | 9368 | AQSPSTVISAQ | 13957 | SPSTVIS | 0.121889 | -0.22164 |
| SyS2569 | 4780 | GCCCAAGGCACCAACAAACCCCGACGCACAG | 9369 | AQGTNKPPDAQ | 13958 | GTNKPPD | 0.121621 | -0.22064 |
| SyS2570 | 4781 | GCCCAAGAAAGCACCGGCGCCATCAGAGCACAG | 9370 | AQESTGAIRAQ | 13959 | ESTGAIR | 0.121621 | -0.22064 |
| SS180 | 4782 | GCCCAACTCATGAACACCATCGCCGCACAG | 9371 | AQLMNTTIAAQ | 13960 | LMNTTIA | 0.121608 | -0.32745 |
| GS1478 | 4783 | GCCCAAATGGCGGGTGTTGCTCAGCCTGCACAG | 9372 | AQMAGVAQPAQ | 13961 | MAGVAQP | 0.121335 | -0.18637 |
| SyS2573 | 4784 | GCCCAACGGCCGGAGCTTAAGCGTGAGGCACAG | 9373 | AQRPELKREAQ | 13962 | RPELKRE | 0.121162 | -0.20466 |
| SyS2574 | 4785 | GCCCAAAAAGCCCAAGACACCCCCACCGCACAG | 9374 | AQKAQDTPTAQ | 13963 | KAQDTPT | 0.121141 | -0.07163 |
| GS1480 | 4786 | GCCCAAAGCACCAACCACCAGCACCAGCGCACAG | 9375 | AQSTNHSTSAQ | 13964 | STNHSTS | 0.120864 | -0.17291 |
| GS1481 | 4787 | GCCCAATTCCCCAGAACCACCACCGACGCACAG | 9376 | AQFPRTTTDAQ | 13965 | FPRTTTD | 0.120827 | -0.11818 |
| SyS2576 | 4788 | GCCCAATCGCGTGCTCATAATTGGGATGCACAG | 9377 | AQSRAHNLDAQ | 13966 | SRAHNLD | 0.120812 | -0.23173 |
| SyS2577 | 4789 | GCCCAACGTACTATTCAGGAGGGGATTGCACAG | 9378 | AQRTIQEGIAQ | 13967 | RTIQEGI | 0.120812 | -0.23173 |
| GS1482 | 4790 | GCCCAAGGCGGCAAAAGCTTCGCCCAAGCACAG | 9379 | AQGGKSFAQAQ | 13968 | GGKSFAQ | 0.120713 | -0.18054 |
| SyS2578 | 4791 | GCCCAAGGCAGACCCAGCAGCACCCAAGCACAG | 9380 | AQGRPSSTQAQ | 13969 | GRPSSTQ | 0.120696 | -0.01043 |
| SyS2579 | 4792 | GCCCAAAACCCCTCAACACCAGCACCGCACAG | 9381 | AQNPLNTSTAQ | 13970 | NPLNTST | 0.120592 | -0.13772 |
| GS1483 | 4793 | GCCCAAGAAAACCTCAGCAACGGCAGAGCACAG | 9382 | AQENLSNGRAQ | 13971 | ENLSNGR | 0.120537 | -0.0855 |
| GP199 | 4794 | GCCCAAGAGAATACTATTCGGATGAGTGCACAG | 9383 | AQENTIRMSAQ | 13972 | ENTIRMS | 0.12044 | -0.07273 |
| SyS2582 | 4795 | GCCCAACCCCCAGAAGCATGCCCATGGCACAG | 9384 | AQPPRSMPMAQ | 13973 | PPRSMPM | 0.120421 | -0.16466 |
| SyS2583 | 4796 | GCCCAACTCCTCAGCAGCAACCTCCCGCACAG | 9385 | AQLLSSNLPAQ | 13974 | LLSSNLP | 0.120362 | -0.09427 |
| SyS2586 | 4797 | GCCCAAAGAGTCCAAAGCCTCAACGAAGCACAG | 9386 | AQRVQSLNEAQ | 13975 | RVQSLNE | 0.120212 | -0.06599 |
| SyS2588 | 4798 | GCCCAACCGAGGAGGGCGCAGGATGATGCACAG | 9387 | AQPRRAQDDAQ | 13976 | PRRAQDD | 0.119774 | -0.17678 |
| SyS2589 | 4799 | GCCCAACAAGGCAACGTCGGCGCGCACAG | 9388 | AQQGNVNVGAQ | 13977 | QGNVNVG | 0.11977 | -0.05616 |
| GS1484 | 4800 | GCCCAAAGCGGCGAAACCCTCAGAGGCGCACAG | 9389 | AQSGETLRGAQ | 13978 | SGETLRG | 0.119683 | -0.05248 |
| SyS2590 | 4801 | GCCCAACACGTCAGCCACAACACCGACGCACAG | 9390 | AQHVSHNTDAQ | 13979 | HVSHNTD | 0.119543 | -0.20093 |
| SyS2592 | 4802 | GCCCAATTTGGTGGGGGGTCGCTGGTTGCACAG | 9391 | AQFGGGSLVAQ | 13980 | FGGGSLV | 0.119216 | -0.10883 |
| SyS2593 | 4803 | GCCCAACCCAGCCTCAGAAGCGAAGGCGCACAG | 9392 | AQPSLRSEGAQ | 13981 | PSLRSEG | 0.119011 | -0.00524 |
| SS186 | 4804 | GCCCAAGTGCGTAGTGAGAATGGTGTGGCACAG | 9393 | AQVRSENGVAQ | 13982 | VRSENGV | 0.118723 | -0.33991 |
| SyS2594 | 4805 | GCCCAAACCCTCAAAGTCACCGGCGACGCACAG | 9394 | AQTLKVTGDAQ | 13983 | TLKVTGD | 0.118628 | -0.14041 |
| SyS2595 | 4806 | GCCCAAGTCCCCAAAGTCTACCTGGACGCACAG | 9395 | AQVPKVYLDAQ | 13984 | VPKVYLD | 0.118518 | -0.16766 |
| SyS2597 | 4807 | GCCCAAACTAGTATGCGGAATACGGAGGCACAG | 9396 | AQTSMRNTEAQ | 13985 | TSMRNTE | 0.118368 | -0.09192 |
| GS1486 | 4808 | GCCCAAGGCTACAGCAGCGGCAGCATGGCACAG | 9397 | AQGYSHGSMAQ | 13986 | GYSHGSM | 0.118333 | -0.05276 |
| SyS2598 | 4809 | GCCCAAGCCACCTTCCCGAAAAACAAGCACAG | 9398 | AQATFPEKQAQ | 13987 | ATFPEKQ | 0.118306 | -0.18614 |

FIG. 33 (Continued)

| | | | | | | | | |
|---|---|---|---|---|---|---|---|---|
| SyS2599 | 4810 | GCCCAAACCGGCCCCACCCAGGCACGGCACGCACAG | 9399 | AQTGPTHGTAQ | 13988 | TGPTHGT | 0.118306 | -0.18614 |
| GS1490 | 4811 | GCCCAAACCAACGACAGACACGCCCCGCACGCACAG | 9400 | AQTNDRHAPAQ | 13989 | TNDRHAP | 0.118185 | -0.1451 |
| SyS2600 | 4812 | GCCCAAGAGACACCTCGCGCAGCGTCGACGCACAG | 9401 | AQRHLASVDAQ | 13990 | RHLASVD | 0.118181 | -0.22803 |
| SyS2601 | 4813 | GCCCAAAATATGATTCAGCCTAGTAATGCACAG | 9402 | AQNMIQPSNAQ | 13991 | NMIQPSN | 0.118011 | -0.22406 |
| GS1492 | 4814 | GCCCAAAACCTCAGCGGCAGCCCGCGCACAG | 9403 | AQNLSGSPAAQ | 13992 | NLSGSPA | 0.117908 | -0.11652 |
| SyS2602 | 4815 | GCCCAACAAACGTCGGCCCCTCCCCGCACAG | 9404 | AQQTVGPLPAQ | 13993 | QTVGPLP | 0.117854 | -0.21557 |
| SyS2604 | 4816 | GCCCAAGTCGGCCACCTCAGCAGAGACGGCACAG | 9405 | AQVGHLSRDAQ | 13994 | VGHLSRD | 0.117641 | -0.03829 |
| SyS2605 | 4817 | GCCCAACAAAACTTCAACGCCGGCCACGCACAG | 9406 | AQQNFNAGHAQ | 13995 | QNFNAGH | 0.117535 | -0.0709 |
| GS1493 | 4818 | GCCCAACTCACCGGCGCGCCGCCAGAGTCGCACAG | 9407 | AQLTGAARVAQ | 13996 | LTGAARV | 0.117519 | -0.17919 |
| GS1494 | 4819 | GCCCAAGGGACTCGTCCGACTGCGACGGCACAG | 9408 | AQGTRPTATAQ | 13997 | GTRPTAT | 0.117449 | -0.15669 |
| SyS2607 | 4820 | GCCCAAATGCCCTCAGCGTCGCCCCGCACAG | 9409 | AQMPLSVAPAQ | 13998 | MPLSVAP | 0.116992 | -0.1392 |
| GS1495 | 4821 | GCCCAAGACAGAGTCCAACAATTCAGCGCACAG | 9410 | AQDRVQQFSAQ | 13999 | DRVQQFS | 0.11689 | -0.16146 |
| SyS2610 | 4822 | GCCCAAAACAACGACACCAGCACCAAAGCACAG | 9411 | AQNNDTSTKAQ | 14000 | NNDTSTK | 0.116554 | -0.23419 |
| SyS2611 | 4823 | GCCCAACCTTCGAAGAATACTCATATTGCACAG | 9412 | AQPSKNTHIAQ | 14001 | PSKNTHI | 0.116554 | -0.23419 |
| SyS2612 | 4824 | GCCCAACCTTTTAAGGCTGATGTTACGGCACAG | 9413 | AQPFKADVTAQ | 14002 | PFKADVT | 0.116512 | -0.20224 |
| SyS2613 | 4825 | GCCCAACCTAAGACTCCTACTTATGTGGCACAG | 9414 | AQPKTPTYVAQ | 14003 | PKTPTYV | 0.116298 | -0.20586 |
| SyS2614 | 4826 | GCCCAACTCACCAACATGACCACCCCGCACAG | 9415 | AQLTNMTTPAQ | 14004 | LTNMTTP | 0.116179 | 0.069335 |
| SyS2615 | 4827 | GCCCAAGGTAGTAAGGTGCATCTTTCTGCACAG | 9416 | AQGSKVHLSAQ | 14005 | GSKVHLS | 0.116046 | -0.22527 |
| SyS2616 | 4828 | GCCCAATCTATTCCGGGTTATAATAATGCACAG | 9417 | AQSIPGYNNAQ | 14006 | SIPGYNN | 0.116006 | -0.21679 |
| GS1497 | 4829 | GCCCAAATGAAAACCGCGAAAGCTACGCACAG | 9418 | AQMKTAESYAQ | 14007 | MKTAESY | 0.115832 | -0.1756 |
| SyS2618 | 4830 | GCCCAAAACGGCGACAGAGACTCCTCAACGCACAG | 9419 | AQNGDRLLNAQ | 14008 | NGDRLLN | 0.115647 | 0.03466 |
| SS189 | 4831 | GCCCAAGGCACCACCCCCAGCCTCGCACAG | 9420 | AQGTTHTSLAQ | 14009 | GTTHTSL | 0.11558 | -0.38281 |
| GS1499 | 4832 | GCCCAACTCGGCCCCAGCACCCAAAGCGCACAG | 9421 | AQLGPSTQSAQ | 14010 | LGPSTQS | 0.115388 | -0.14619 |
| SyS2619 | 4833 | GCCCAAATGAACGCCCTCACCGACAAAGCACAG | 9422 | AQMNALTDKAQ | 14011 | MNALTDK | 0.115181 | -0.16027 |
| SyS2620 | 4834 | GCCCAAAGCAGCAAAGAAATCAGCCTGCACAG | 9423 | AQSSKEISLAQ | 14012 | SSKEISL | 0.114992 | -0.07231 |
| SyS2621 | 4835 | GCCCAACTCGACAACGGCACCACCAGAGCACAG | 9424 | AQLDNGTTRAQ | 14013 | LDNGTTR | 0.114827 | -0.15288 |
| SyS2622 | 4836 | GCCCAACGTGTGAATTTAATTCGGATGCACAG | 9425 | AQRVNFNSDAQ | 14014 | RVNFNSD | 0.114822 | -0.20345 |
| SyS2623 | 4837 | GCCCAAAACATGCAAGCCATCAGCAACGCACAG | 9426 | AQNMQAISNAQ | 14015 | NMQAISN | 0.114811 | -0.08155 |
| SyS2624 | 4838 | GCCCAAAACAACACCAACCCCAGAAGCATCGCACAG | 9427 | AQNTNPRSIAQ | 14016 | NTNPRSI | 0.114545 | 0.005791 |
| SyS2625 | 4839 | GCCCAAAAAATCAACAGCAACAGCCCGCACAG | 9428 | AQKINSNSPAQ | 14017 | KINSNSP | 0.114472 | -0.07131 |
| GS1501 | 4840 | GCCCAAGTCCCCTCGGCAAAGCCAGCGCACAG | 9429 | AQVPLGKASAQ | 14018 | VPLGKAS | 0.114441 | -0.18637 |
| SyS2628 | 4841 | GCCCAACGGCTGAATCATAATTCGCCTGCACAG | 9430 | AQRLNHNSPAQ | 14019 | RLNHNSP | 0.11425 | -0.20216 |

FIG. 33 (Continued)

| | | | | | | | | |
|---|---|---|---|---|---|---|---|---|
| GS1502 | 4842 | GCCCAACAACTCAACACGTCCTCCCGCACAG | 9431 | AQQLNTVLPAQ | 14020 | QLNTVLP | 0.114132 | -0.18054 |
| SyS2630 | 4843 | GCCCAAGAGACAGCTTCGGCAAAAGCCTCGCACAG | 9432 | AQDSFGKSLAQ | 14021 | DSFGKSL | 0.114045 | -0.16643 |
| SyS2631 | 4844 | GCCCAAAAGCCGCCTAAGTTGGTTGATGCACAG | 9433 | AQKPPKLVDAQ | 14022 | KPPKLVD | 0.113972 | -0.17314 |
| GS1504 | 4845 | GCCCAACAAATCACCGTCGGCAAACCCGCACAG | 9434 | AQQITVGKPAQ | 14023 | QITVGKP | 0.113906 | -0.15574 |
| GS1505 | 4846 | GCCCAACAACACCCCACGGCCAACAAGCACAG | 9435 | AQQHPHGQQAQ | 14024 | QHPHGQQ | 0.113842 | -0.16214 |
| SyS2633 | 4847 | GCCCAAACTTCGACTAATATGGCGGCTGCACAG | 9436 | AQTSTNMAAAQ | 14025 | TSTNMAA | 0.113622 | -0.04892 |
| SyS2634 | 4848 | GCCCAACAAGGCGGCCTCGCCGTCGTCGCACAG | 9437 | AQQGGLAVVAQ | 14026 | QGGLAVV | 0.113622 | -0.15657 |
| GS1507 | 4849 | GCCCAAGGGAGGGGTAGTCTTCCGTTTGCACAG | 9438 | AQGRGSLPFAQ | 14027 | GRGSLPF | 0.113603 | -0.18816 |
| SyS2637 | 4850 | GCCCAAAGCGGCAAACCCGCAGCGAAGCACAG | 9439 | AQSGKPASEAQ | 14028 | SGKPASE | 0.113257 | -0.18245 |
| GS1508 | 4851 | GCCCAACGGTCTCGTTAGTGTGAATTCTGCACAG | 9440 | AQRSVSVNSAQ | 14029 | RSVSVNS | 0.11314 | -0.18245 |
| SyS2638 | 4852 | GCCCAAGACAGAGGGCGGCGTCGTCGCCGCACAG | 9441 | AQDRGGVVAAQ | 14030 | DRGGVVA | 0.113119 | -0.20466 |
| SyS2639 | 4853 | GCCCAAGGTCGTGAGACTGGTTTTCGGCACAG | 9442 | AQGRETGFSAQ | 14031 | GRETGFS | 0.112987 | -0.21315 |
| SyS2640 | 4854 | GCCCAACAGATTGTTCCGTCGAATCCGGCACAG | 9443 | AQQIVPSNPAQ | 14032 | QIVPSNP | 0.112987 | -0.21315 |
| SyP73 | 4855 | GCCCAAACGACGTTGGGTCATAGTAGTTATTCACAG | 9444 | AQTTLGHSYSQ | 14033 | TTLGHSY | 0.11285 | -0.03826 |
| SyS2642 | 4856 | GCCCAAAGCAGAGAATTCCAACTCGCCGCACAG | 9445 | AQSREFQLAAQ | 14034 | SREFQLA | 0.112786 | -0.15738 |
| GS1510 | 4857 | GCCCAAGGCAGAGACCACAACATCGGGCGCACAG | 9446 | AQGRDHNIGAQ | 14035 | GRDHNIG | 0.112781 | -0.17386 |
| TS179 | 4858 | GCCCAATCGAATAATTCTCGGCCGAATGCACAG | 9447 | AQSNNSRPNAQ | 14036 | SNNSRPN | 0.112766 | -0.14993 |
| SyS2643 | 4859 | GCCCAAAAAACCAAAGCAGGACCTCGCACAG | 9448 | AQKNQSSDLAQ | 14037 | KNQSSDL | 0.11276 | 0.0834 |
| SyS2644 | 4860 | GCCCAACCCAACGACAGAGCCCACGGCGCACAG | 9449 | AQPNDRAHGAQ | 14038 | PNDRAHG | 0.112742 | -0.19375 |
| SyS2645 | 4861 | GCCCAAGCTCTGACTAGGACTCAGTCTGCACAG | 9450 | AQALTRTQSAQ | 14039 | ALTRTQS | 0.11269 | -0.10041 |
| SyS2647 | 4862 | GCCCAAATGAGACGCCCCAGCGACAAAGCACAG | 9451 | AQMRPPSDKAQ | 14040 | MRPPSDK | 0.112599 | -0.20224 |
| TS180 | 4863 | GCCCAAACGAATTCGACTACGAAGTCGGCACAG | 9452 | AQTNSTTKSAQ | 14041 | TNSTTKS | 0.112569 | -0.20873 |
| SyS2648 | 4864 | GCCCAAGGCAGACACGGCATGACCGCCGCACAG | 9453 | AQGRHGMTAAQ | 14042 | GRHGMTA | 0.112548 | -0.08222 |
| GS1511 | 4865 | GCCCAAGTCAGCACATCAGCGCCGCACAG | 9454 | AQVSHISPAAQ | 14043 | VSHISPA | 0.112496 | -0.13761 |
| GS1512 | 4866 | GCCCAAAAGGTTACTAGTAATAGTTCGGCACAG | 9455 | AQKVTSNSSAQ | 14044 | KVTSNSS | 0.112386 | -0.16241 |
| SyS2649 | 4867 | GCCCAAATGTACGGCCCGGCGCAGCGCACAG | 9456 | AQMYGPGASAQ | 14045 | MYGPGAS | 0.112262 | -0.19133 |
| GS1514 | 4868 | GCCCAAGTCCTCAGAAGCAACACCCCGCACAG | 9457 | AQVLRSNTPAQ | 14046 | VLRSNTP | 0.112217 | -0.12617 |
| SyS2650 | 4869 | GCCCAAAATAGTAGTTCTAGTAATAAGGCACAG | 9458 | AQNSSSSNKAQ | 14047 | NSSSSNK | 0.112213 | -0.20989 |
| SyS2652 | 4870 | GCCCAAAGCACCGAAAAAAGCACCAGCGCACAG | 9459 | AQSTEKSTSAQ | 14048 | STEKSTS | 0.11211 | -0.0765 |
| GS1516 | 4871 | GCCCAAAACACCACCAAAGGCAACAAAGGCGCACAG | 9460 | AQNTNGNKGAQ | 14049 | NTNGNKG | 0.112014 | -0.18149 |
| GP205 | 4872 | GCCCAAATTACGACTAATCTGGGGGGCGGCACAG | 9461 | AQITTNLGAAQ | 14050 | ITTNLGA | 0.111979 | -0.07377 |
| GS1517 | 4873 | GCCCAAATCCAAAAACCCCAAAGCAGCGCACAG | 9462 | AQIQKPQSSAQ | 14051 | IQKPQSS | 0.111935 | -0.18457 |

FIG. 33 (Continued)

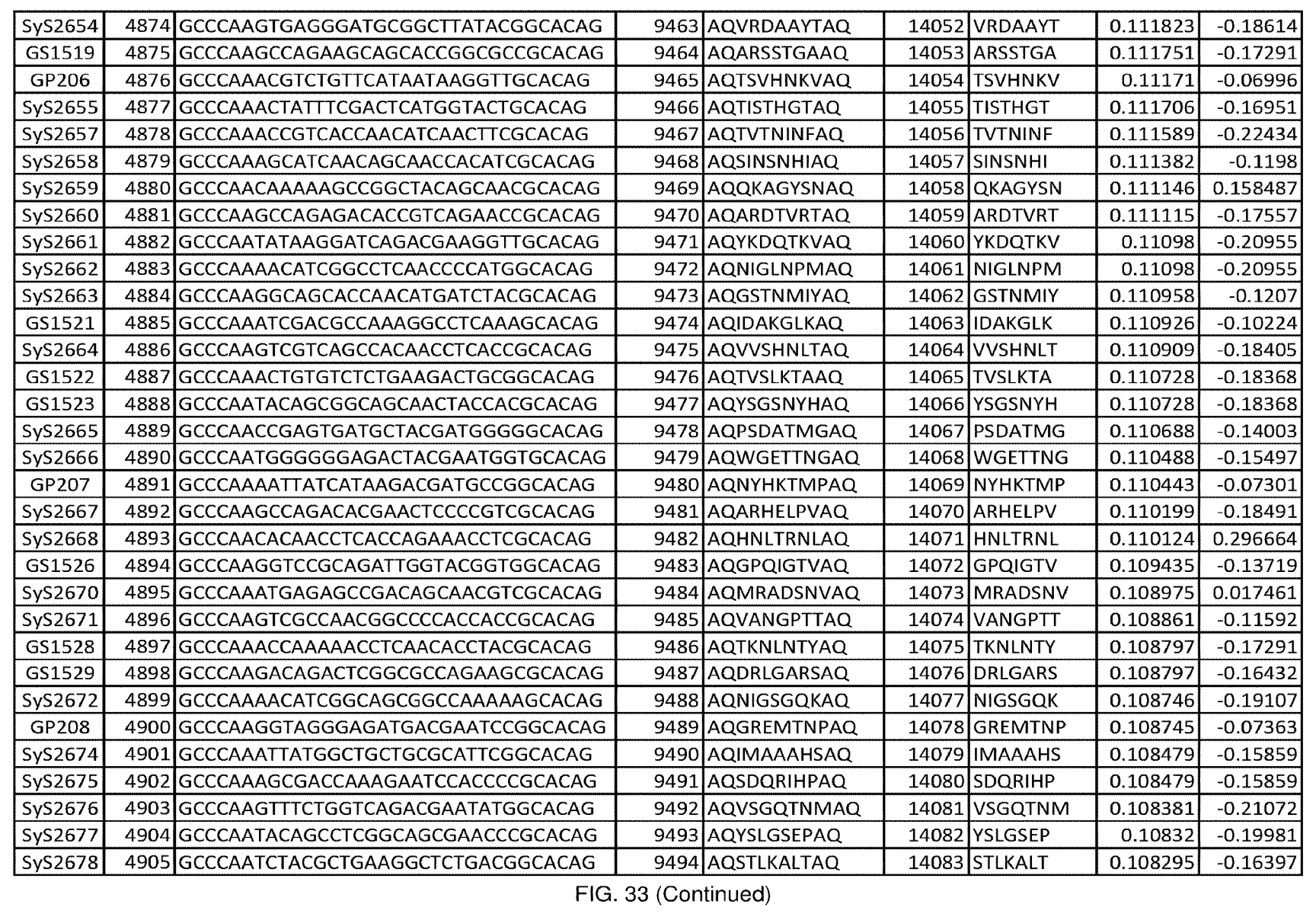

| | | | | | | | | |
|---|---|---|---|---|---|---|---|---|
| SyS2654 | 4874 | GCCCAAGTGAGGGATGCGGCTTATACGGCACAG | 9463 | AQVRDAAYTAQ | 14052 | VRDAAYT | 0.111823 | -0.18614 |
| GS1519 | 4875 | GCCCAAGCCAGAAGCAGCACCGGCGCCGCACAG | 9464 | AQARSSTGAAQ | 14053 | ARSSTGA | 0.111751 | -0.17291 |
| GP206 | 4876 | GCCCAAACGTCTGTTCATAATAAGGTTGCACAG | 9465 | AQTSVHNKVAQ | 14054 | TSVHNKV | 0.11171 | -0.06996 |
| SyS2655 | 4877 | GCCCAAACTATTCGACTCATGGTACTGCACAG | 9466 | AQTISTHGTAQ | 14055 | TISTHGT | 0.111706 | -0.16951 |
| SyS2657 | 4878 | GCCCAAACCGTCACCAACATCAACTTCGCACAG | 9467 | AQTVTNINFAQ | 14056 | TVTNINF | 0.111589 | -0.22434 |
| SyS2658 | 4879 | GCCCAAGCATCAACAGCAACCACATCGCACAG | 9468 | AQSINSNHIAQ | 14057 | SINSNHI | 0.111382 | -0.1198 |
| SyS2659 | 4880 | GCCCAACAAAAGCCGGCTACAGCAACGCACAG | 9469 | AQQKAGYSNAQ | 14058 | QKAGYSN | 0.111146 | 0.158487 |
| SyS2660 | 4881 | GCCCAAGCCAGAGACACCGTCAGAACCGCACAG | 9470 | AQARDTVRTAQ | 14059 | ARDTVRT | 0.111115 | -0.17557 |
| SyS2661 | 4882 | GCCCAATATAAGGATCAGACGAAGGTTGCACAG | 9471 | AQYKDQTKVAQ | 14060 | YKDQTKV | 0.11098 | -0.20955 |
| SyS2662 | 4883 | GCCCAAAAACATCGGCCTCAACCCCATGGCACAG | 9472 | AQNIGLNPMAQ | 14061 | NIGLNPM | 0.11098 | -0.20955 |
| SyS2663 | 4884 | GCCCAAGGCAGCACCAACATGATCTACGCACAG | 9473 | AQGSTNMIYAQ | 14062 | GSTNMIY | 0.110958 | -0.1207 |
| GS1521 | 4885 | GCCCAAATCGACGCCAAAGGCCTCAAAGCACAG | 9474 | AQIDAKGLKAQ | 14063 | IDAKGLK | 0.110926 | -0.10224 |
| SyS2664 | 4886 | GCCCAAGTCGTCAGCCACAACCTCACCGCACAG | 9475 | AQVVSHNLTAQ | 14064 | VVSHNLT | 0.110909 | -0.18405 |
| GS1522 | 4887 | GCCCAAACTGTGTCTCTGAAGACTGCGGCACAG | 9476 | AQTVSLKTAAQ | 14065 | TVSLKTA | 0.110728 | -0.18368 |
| GS1523 | 4888 | GCCCAATACAGCGGCAGCAACTACCACGCACAG | 9477 | AQYSGSNYHAQ | 14066 | YSGSNYH | 0.110728 | -0.18368 |
| SyS2665 | 4889 | GCCCAACCGAGTGATGCTACGATGGGGGCACAG | 9478 | AQPSDATMGAQ | 14067 | PSDATMG | 0.110688 | -0.14003 |
| SyS2666 | 4890 | GCCCAATGGGGGGAGACTACGAATGGTGCGGCACAG | 9479 | AQWGETTNGAQ | 14068 | WGETTNG | 0.110488 | -0.15497 |
| GP207 | 4891 | GCCCAAAATTATCATAAGACGATGCCGGCACAG | 9480 | AQNYHKTMPAQ | 14069 | NYHKTMP | 0.110443 | -0.07301 |
| SyS2667 | 4892 | GCCCAAGCCAGACACGAACTCCCGTCGCACAG | 9481 | AQARHELPVAQ | 14070 | ARHELPV | 0.110199 | -0.18491 |
| SyS2668 | 4893 | GCCCAACACACAACCTCACCAGAAACCTCGCACAG | 9482 | AQHNLTRNLAQ | 14071 | HNLTRNL | 0.110124 | 0.296664 |
| GS1526 | 4894 | GCCCAAGGTCCGCAGATTGGTACGGTGGCACAG | 9483 | AQGPQIGTVAQ | 14072 | GPQIGTV | 0.109435 | -0.13719 |
| SyS2670 | 4895 | GCCCAAATGAGAGCCGACAGCAAGTCGCACAG | 9484 | AQMRADSNVAQ | 14073 | MRADSNV | 0.108975 | 0.017461 |
| SyS2671 | 4896 | GCCCAAGTCGCCAACGCCCCACCACCGCACAG | 9485 | AQVANGPTTAQ | 14074 | VANGPTT | 0.108861 | -0.11592 |
| GS1528 | 4897 | GCCCAAACCAAAAACCTCAACACCTACGCACAG | 9486 | AQTKNLNTYAQ | 14075 | TKNLNTY | 0.108797 | -0.17291 |
| GS1529 | 4898 | GCCCAAGACAGACTCGGCGCGCCAGAAGCGCACAG | 9487 | AQDRLGARSAQ | 14076 | DRLGARS | 0.108797 | -0.16432 |
| SyS2672 | 4899 | GCCCAAAAACATCGGCAGCGGCCAAAAAGCACAG | 9488 | AQNIGSGQKAQ | 14077 | NIGSGQK | 0.108746 | -0.19107 |
| GP208 | 4900 | GCCCAAGGTAGGGAGATGACGAATCCGGCACAG | 9489 | AQGREMTNPAQ | 14078 | GREMTNP | 0.108745 | -0.07363 |
| SyS2674 | 4901 | GCCCAAATTATGGCTGCTGCGCATTCGGCACAG | 9490 | AQIMAAAHSAQ | 14079 | IMAAAHS | 0.108479 | -0.15859 |
| SyS2675 | 4902 | GCCCAAAGGCACCAAAGAATCCACCCCGCACAG | 9491 | AQSDQRIHPAQ | 14080 | SDQRIHP | 0.108479 | -0.15859 |
| SyS2676 | 4903 | GCCCAAGTTTCTGGTCAGACGAATATGGCACAG | 9492 | AQVSGQTNMMAQ | 14081 | VSGQTNM | 0.108381 | -0.21072 |
| SyS2677 | 4904 | GCCCAATACAGCTCGGGCAGCGAACCCGCACAG | 9493 | AQYSLGSEPAQ | 14082 | YSLGSEP | 0.10832 | -0.19981 |
| SyS2678 | 4905 | GCCCAATCTACGCTGAAAGGCTCTGACGGCACAG | 9494 | AQSTLKALTAQ | 14083 | STLKALT | 0.108295 | -0.16397 |

FIG. 33 (Continued)

| | | | | | | | |
|---|---|---|---|---|---|---|---|
| SyS2679 | 4906 | GCCCAAAGGCGCCTCATCCCCAGCCCGCACAG | 9495 | AQSALIPSPAQ | 14084 | SALIPSP | 0.108266 | -0.1889 |
| GS1530 | 4907 | GCCCAAACCAGCCAGCCGGCAACCAAGCACAG | 9496 | AQTSQAGNQAQ | 14085 | TSQAGNQ | 0.108221 | -0.05787 |
| GS1531 | 4908 | GCCCAAACACGCCAGCCTCCCATCGCACAG | 9497 | AQKHASLPIAQ | 14086 | KHASLPI | 0.108122 | -0.15676 |
| GS1532 | 4909 | GCCCAACTCGACCAACTCACCAAAAACGCACAG | 9498 | AQLDQLTKNAQ | 14087 | LDQLTKN | 0.108122 | -0.15676 |
| SyS2680 | 4910 | GCCCAAATGGCCAGAAGCACCGACAGAGCACAG | 9499 | AQMARSTDRAQ | 14088 | MARSTDR | 0.108107 | -0.14526 |
| SyS2681 | 4911 | GCCCAAAGTTATAATCATCATATTGAGAAGGCACAG | 9500 | AQSYNHIEKAQ | 14089 | SYNHIEK | 0.108002 | -0.23012 |
| SS193 | 4912 | GCCCAAGTCAACCACATCCAACCCATGGCACAG | 9501 | AQVNHIQPMAQ | 14090 | VNHIQPM | 0.107975 | -0.33355 |
| GS1533 | 4913 | GCCCAAAGCAGAGCCGAACCCAAACTCGCACAG | 9502 | AQSRAEPKLAQ | 14091 | SRAEPKL | 0.10781 | -0.16394 |
| GS1534 | 4914 | GCCCAAGCCAGCCACATCGCCAACAGCGCACAG | 9503 | AQASHIGNSAQ | 14092 | ASHIGNS | 0.107759 | -0.18637 |
| SyS2682 | 4915 | GCCCAACATCAGGGTTTGCGAGTGCTGCACAG | 9504 | AQHQGFASAAQ | 14093 | HQGFASA | 0.107489 | 0.012345 |
| SyS2684 | 4916 | GCCCAAGAGGGTAAGTCTATTATGCCGGCACAG | 9505 | AQEGKSIMPAQ | 14094 | EGKSIMP | 0.107301 | -0.20709 |
| SyS2685 | 4917 | GCCCAACTCACCGGCATGCACAGCACCGCACAG | 9506 | AQLTGMHSTAQ | 14095 | LTGMHST | 0.107301 | -0.20709 |
| SyS2686 | 4918 | GCCCAAAGTAATCCTAGTACTATTCATGCACAG | 9507 | AQSNPSTIHAQ | 14096 | SNPSTIH | 0.107232 | -0.12873 |
| SyS2688 | 4919 | GCCCAAAGCAGAGACCAACCACCAGCGCACAG | 9508 | AQSRDQPTSAQ | 14097 | SRDQPTS | 0.107118 | -0.18163 |
| SyS2689 | 4920 | GCCCAAAAAACCGCGAACCCTACACCGCACAG | 9509 | AQKTAEPYTAQ | 14098 | KTAEPYT | 0.107074 | -0.18491 |
| SyS2690 | 4921 | GCCCAAATTGGTTCTAATCCTGATAAGGCACAG | 9510 | AQIGSNPDKAQ | 14099 | IGSNPDK | 0.107034 | -0.21436 |
| SyS2691 | 4922 | GCCCAACTCGCCAGCACCTTCAGCCCGCACAG | 9511 | AQLASTFSPAQ | 14100 | LASTFSP | 0.107031 | -0.17998 |
| SyS2692 | 4923 | GCCCAACTTGTTAGGCTTAATACTTCTGCACAG | 9512 | AQLVRLNTSAQ | 14101 | LVRLNTS | 0.106997 | -0.22527 |
| SyP76 | 4924 | GCCCAATTTCAGGATCTGCGTGCGCAAGCACAG | 9513 | AQFQDLRAQAQ | 14102 | FQDLRAQ | 0.10698 | -0.03979 |
| GS1537 | 4925 | GCCCAAATCAGCCACAGCCCCAAACGCACAG | 9514 | AQISHSPQTAQ | 14103 | ISHSPQT | 0.106884 | -0.171 |
| SyS2693 | 4926 | GCCCAATTCCAAGACGGCCAAAGAGAAGCACAG | 9515 | AQFQDGQREAQ | 14104 | FQDGQRE | 0.106797 | -0.11297 |
| SyS2694 | 4927 | GCCCAAGACACCAGAGAAGCCTTCAGAGCACAG | 9516 | AQDTREAFRAQ | 14105 | DTREAFR | 0.106757 | -0.1792 |
| SyS2695 | 4928 | GCCCAATTGGTTGCTGATGCGCGTCCTGCACAG | 9517 | AQLVADARPAQ | 14106 | LVADARP | 0.106656 | -0.20103 |
| GS1540 | 4929 | GCCCAAAGCTTCAGCAGCGGCGGCGGGCACAG | 9518 | AQSFSSGAGAQ | 14107 | SFSSGAG | 0.10653 | -0.08043 |
| SyS2696 | 4930 | GCCCAAGATGTGTTGACTGGGAAGAGTGCACAG | 9519 | AQDVLTGKSAQ | 14108 | DVLTGKS | 0.106522 | -0.15496 |
| SyS2697 | 4931 | GCCCAAAAAGATGGTGTTGAATAATGCTGCACAG | 9520 | AQKMVLNNAAQ | 14109 | KMVLNNA | 0.106481 | -0.17225 |
| SyS2698 | 4932 | GCCCAACGGAAGATTGATACGATGTCTGCACAG | 9521 | AQRKIDTMSAQ | 14110 | RKIDTMS | 0.106265 | -0.13872 |
| GS1541 | 4933 | GCCCAAATGTCTCAGGTGATTACTGGGGCACAG | 9522 | AQMSQVITGAQ | 14111 | MSQVITG | 0.106232 | -0.1439 |
| GP212 | 4934 | GCCCAAACGTATAGGGATACGCGGAATACTGCACAG | 9523 | AQTYDTRNTAQ | 14112 | TYDTRNT | 0.106211 | -0.06295 |
| SyS2699 | 4935 | GCCCAATATAGGGATGGTTTCGGGTAGTGCACAG | 9524 | AQYRDGSGSAQ | 14113 | YRDGSGS | 0.105987 | 0.014681 |
| GS1542 | 4936 | GCCCAAGGGAATATTAGTCCTGCGGGGGCACAG | 9525 | AQGNISPAGAQ | 14114 | GNISPAG | 0.105627 | -0.18149 |
| SyS2700 | 4937 | GCCCAAAAAGCCGGCCCTCAGCGCCACAG | 9526 | AQKAGLGLSAQ | 14115 | KAGLGLS | 0.105529 | -0.21571 |

FIG. 33 (Continued)

| | | | | | | | |
|---|---|---|---|---|---|---|---|
| GP214 | 4938 | GCCCAACGTCATGTGGAGAAGGATACTGCACAG | 9527 | AQRHVEKDTAQ | 14116 | RHVEKDT | 0.105492 | -0.07433 |
| GS1543 | 4939 | GCCCAAAAGAAGTCAGAGCCAACGCCGCACAG | 9528 | AQKEVRANAAQ | 14117 | KEVRANA | 0.105404 | -0.15764 |
| SyS2701 | 4940 | GCCCAAGAGAGTAAGCCTTCTGCGGCACAG | 9529 | AQESKPLPAAQ | 14118 | ESKPLPA | 0.105201 | -0.21557 |
| SyS2702 | 4941 | GCCCAAACGTTGAGTCATAATAGTATGGCACAG | 9530 | AQTLSHNSMAQ | 14119 | TLSHNSM | 0.105046 | 0.006619 |
| SyS2703 | 4942 | GCCCAAGTCGGCAGTCACCGTCAGCGCACAG | 9531 | AQVGSYTVSAQ | 14120 | VGSYTVS | 0.105013 | -0.22649 |
| SyS2704 | 4943 | GCCCAACAAAGCGCCACCAGCCTCACGCACAG | 9532 | AQQSATSLTAQ | 14121 | QSATSLT | 0.104841 | -0.06501 |
| GS1546 | 4944 | GCCCAACACGCCAACGGCCTCAGAGACGCACAG | 9533 | AQHANGLRDAQ | 14122 | HANGLRD | 0.104497 | -0.15955 |
| GS1547 | 4945 | GCCCAAAGAATGAGCCACGACAGCCCGCACAG | 9534 | AQRMSHDSPAQ | 14123 | RMSHDSP | 0.104494 | -0.18637 |
| SyS2705 | 4946 | GCCCAAAAGCATAGTGGTCTTGAGTCTGCACAG | 9535 | AQKHSGLESAQ | 14124 | KHSGLES | 0.104319 | -0.17314 |
| SyS2707 | 4947 | GCCCAAAAACTCAGCACCGCCATCGAAGCACAG | 9536 | AQKLSTAIEAQ | 14125 | KLSTAIE | 0.103851 | -0.06923 |
| SyS2708 | 4948 | GCCCAAAACAGCAAACAACTCCTCTCGCACAG | 9537 | AQNSKQLLLAQ | 14126 | NSKQLLL | 0.10377 | -0.20709 |
| SyS2709 | 4949 | GCCCAATCGCTTCATAATAATCGTGTGGCACAG | 9538 | AQSLHNNRVAQ | 14127 | SLHNNRV | 0.103655 | -0.12587 |
| SyS2710 | 4950 | GCCCAAAGCGCCGACAGAAGCATCACCGCACAG | 9539 | AQSADRSITAQ | 14128 | SADRSIT | 0.103582 | -0.14162 |
| SyS2711 | 4951 | GCCCAACCCACCGGCAGACCCAGAAGCACAG | 9540 | AQPTGRPQEAQ | 14129 | PTGRPQE | 0.103492 | -0.1792 |
| SyS2712 | 4952 | GCCCAAAAGACTGTTCAGGAGCCTTTGGCACAG | 9541 | AQKTVQEPLAQ | 14130 | KTVQEPL | 0.10347 | -0.22926 |
| SyS2715 | 4953 | GCCCAAAGCACCAAAGCCCTCAGCAACGCACAG | 9542 | AQSTKALSNAQ | 14131 | STKALSN | 0.103085 | -0.13677 |
| GS1551 | 4954 | GCCCAAAGCAACCAAAGCACCAGAAGCGCACAG | 9543 | AQSNQSTRSAQ | 14132 | SNQSTRS | 0.103015 | -0.15138 |
| SyS2716 | 4955 | GCCCAAGGTGTTGAGGGGAGTTCGCGGGGCACAG | 9544 | AQGVEGSSRAQ | 14133 | GVEGSSR | 0.102975 | -0.21436 |
| SyS2717 | 4956 | GCCCAACTCCACCAAGGCCCCAGCAGCGCACAG | 9545 | AQLHQGPSSAQ | 14134 | LHQGPSS | 0.102855 | -0.099 |
| GS1552 | 4957 | GCCCAAGTCGACACGACAGAAACGTCGTCGCACAG | 9546 | AQVDSRNVVAQ | 14135 | VDSRNVV | 0.102836 | -0.118 |
| SyS2718 | 4958 | GCCCAACTTGGGAAGCAGACGGCTTTGGCACAG | 9547 | AQLGKQTALAQ | 14136 | LGKQTAL | 0.102831 | -0.1615 |
| SyS2719 | 4959 | GCCCAAAGGCGGCAACAGAACCAACATGGCACAG | 9548 | AQSGNRTNMAQ | 14137 | SGNRTNM | 0.102775 | 0.06214 |
| GS1553 | 4960 | GCCCAAGTCAAAGGCTACGCCAGCACCGCACAG | 9549 | AQVKGYASTAQ | 14138 | VKGYAST | 0.102753 | -0.16051 |
| SyS2720 | 4961 | GCCCAAGCTTCTGTTAGTTCGTCGAGTGCACAG | 9550 | AQASVSSSSAQ | 14139 | ASVSSSS | 0.102658 | 0.00519 |
| SyS2722 | 4962 | GCCCAACTCCAACTCAAAAGCGGCATGGCACAG | 9551 | AQLQLKSGMAQ | 14140 | LQLKSGM | 0.102481 | -0.07053 |
| SyS2723 | 4963 | GCCCAAGATATGCGTGCGTCTGGGAGTGCACAG | 9552 | AQDMRASGSAQ | 14141 | DMRASGS | 0.102358 | -0.19107 |
| GP216 | 4964 | GCCCAATTGACTGCTACGCTGCCTTATGCACAG | 9553 | AQLTATLPYAQ | 14142 | LTATLPY | 0.102226 | -0.0676 |
| GS1555 | 4965 | GCCCAAAGTAATGCTCCTAATTCGTATGCACAG | 9554 | AQSNAPNSYAQ | 14143 | SNAPNSY | 0.102094 | -0.10049 |
| SyS2726 | 4966 | GCCCAAAAAGTCGAAAGCAGCAGAGCCGCACAG | 9555 | AQKVESSRAAQ | 14144 | KVESSRA | 0.102054 | -0.20586 |
| GS1556 | 4967 | GCCCAATGGAGCAACAGCACCACCGTCGCACAG | 9556 | AQWSNSTTVAQ | 14145 | WSNSTTV | 0.10196 | -0.17381 |
| GP217 | 4968 | GCCCAATCTCTTATTCATACGGCGTCCTGCACAG | 9557 | AQSLIHTRPAQ | 14146 | SLIHTRP | 0.101865 | -0.0719 |
| SyS2727 | 4969 | GCCCAAACGCTTTCTAGTCCTCATAATGCACAG | 9558 | AQTLSSPHNAQ | 14147 | TLSSPHN | 0.101849 | -0.22042 |

FIG. 33 (Continued)

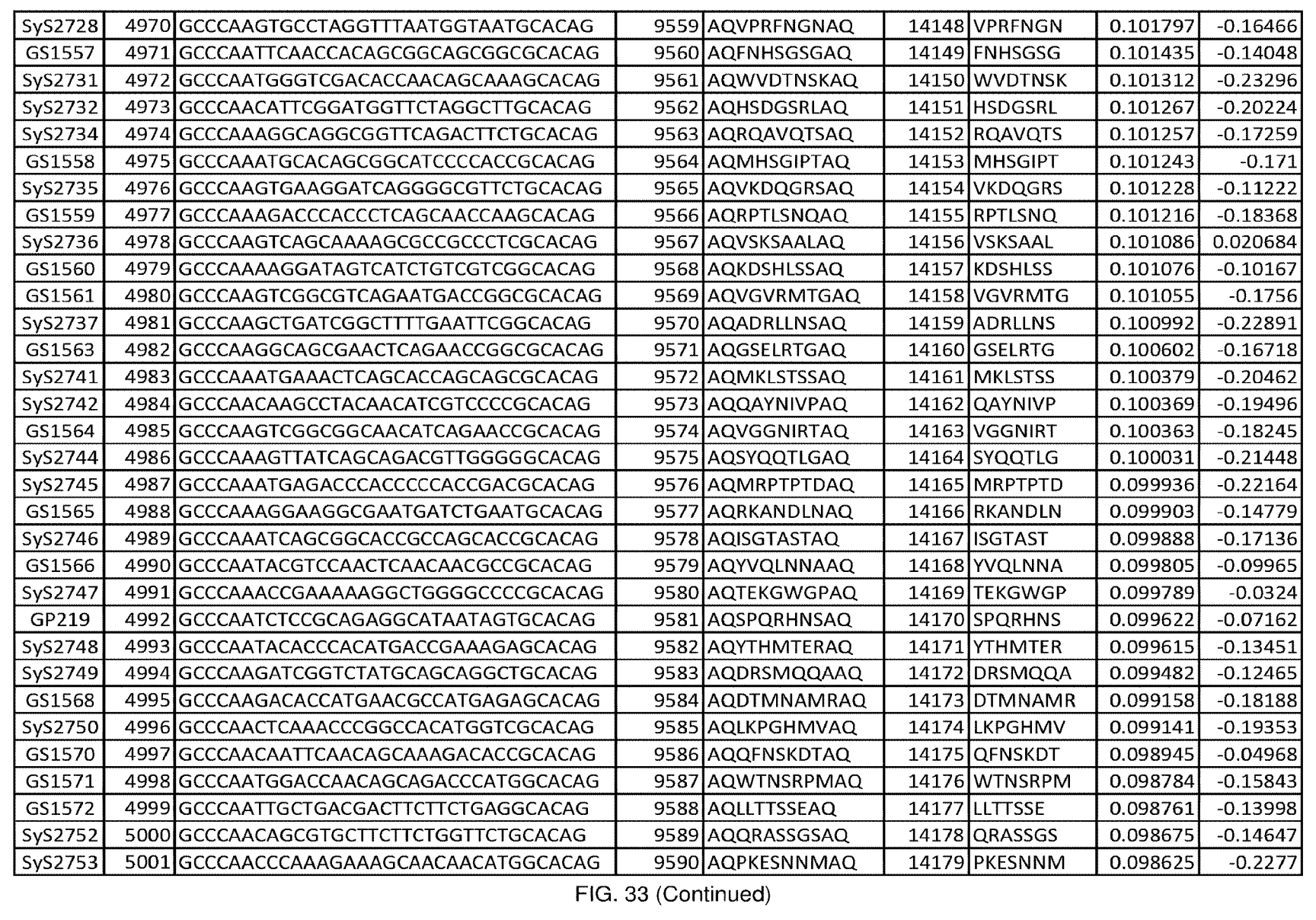

| | | | | | | | | |
|---|---|---|---|---|---|---|---|---|
| SyS2728 | 4970 | GCCCAAGTGCCTAGGTTTAATGGTAATGCACAG | 9559 | AQVPRFNGNAQ | 14148 | VPRFNGN | 0.101797 | -0.16466 |
| GS1557 | 4971 | GCCCAATTCAACCACAGCGGCAGCGGCGCACAG | 9560 | AQFNHSGSGAQ | 14149 | FNHSGSG | 0.101435 | -0.14048 |
| SyS2731 | 4972 | GCCCAATGGGTCGACACCAACAGCAAAGCACAG | 9561 | AQWVDTNSKAQ | 14150 | WVDTNSK | 0.101312 | -0.23296 |
| SyS2732 | 4973 | GCCCAACATTCGGATGGTTCTAGGCTTGCACAG | 9562 | AQHSDGSRLAQ | 14151 | HSDGSRL | 0.101267 | -0.20224 |
| SyS2734 | 4974 | GCCCAAAGGCAGGCGGTTCAGACTTCTGCACAG | 9563 | AQRQAVQTSAQ | 14152 | RQAVQTS | 0.101257 | -0.17259 |
| GS1558 | 4975 | GCCCAAATGCACAGCGGCATCCCCACCGCACAG | 9564 | AQMHSGIPTAQ | 14153 | MHSGIPT | 0.101243 | -0.171 |
| SyS2735 | 4976 | GCCCAAGTGAAGGATCAGGGGCGTTCTGCACAG | 9565 | AQVKDQGRSAQ | 14154 | VKDQGRS | 0.101228 | -0.11222 |
| GS1559 | 4977 | GCCCAAAGACCCACCCTCAGCAACCAAGCACAG | 9566 | AQRPTLSNQAQ | 14155 | RPTLSNQ | 0.101216 | -0.18368 |
| SyS2736 | 4978 | GCCCAAGTCAGCAAAAGCGCCGCCCTCGCACAG | 9567 | AQVSKSAALAQ | 14156 | VSKSAAL | 0.101086 | 0.020684 |
| GS1560 | 4979 | GCCCAAAAGGATAGTCATCTGTCGTCGGCACAG | 9568 | AQKDSHLSSAQ | 14157 | KDSHLSS | 0.101076 | -0.10167 |
| GS1561 | 4980 | GCCCAAGTCGGCGTCAGAATGACCGGCGCACAG | 9569 | AQVGVRMTGAQ | 14158 | VGVRMTG | 0.101055 | -0.1756 |
| SyS2737 | 4981 | GCCCAAGCTGATCGGCTTTTGAATTCGGCACAG | 9570 | AQADRLLNSAQ | 14159 | ADRLLNS | 0.100992 | -0.22891 |
| GS1563 | 4982 | GCCCAAGGCAGCGAACTCAGAACCGGCGGCACAG | 9571 | AQGSELRTGAQ | 14160 | GSELRTG | 0.100602 | -0.16718 |
| SyS2741 | 4983 | GCCCAAAATGAAACTCAGCACCAGCAGCGCACAG | 9572 | AQMKLSTSSAQ | 14161 | MKLSTSS | 0.100379 | -0.20462 |
| SyS2742 | 4984 | GCCCAACAACAGCCTACAACATCGTCCCCGCACAG | 9573 | AQQAYNIVPAQ | 14162 | QAYNIVP | 0.100369 | -0.19496 |
| GS1564 | 4985 | GCCCAAGTCGGGCGGCAACATCAGAACCGCACAG | 9574 | AQVGGNIRTAQ | 14163 | VGGNIRT | 0.100363 | -0.18245 |
| SyS2744 | 4986 | GCCCAAAGTTATCAGACAGACGTTGGGGCACAG | 9575 | AQSYQQTLGAQ | 14164 | SYQQTLG | 0.100031 | -0.21448 |
| SyS2745 | 4987 | GCCCAAAATGAGAACCCACCCCACGACGCACAG | 9576 | AQMRPTPTDAQ | 14165 | MRPTPTD | 0.099936 | -0.22164 |
| GS1565 | 4988 | GCCCAAAGGAAGGGCGAATGATCTGAATGCACAG | 9577 | AQRKANDLNAQ | 14166 | RKANDLN | 0.099903 | -0.14779 |
| SyS2746 | 4989 | GCCCAAAATCAGCGGCCACCGCCAGCACCGCACAG | 9578 | AQISGTASTAQ | 14167 | ISGTAST | 0.099888 | -0.17136 |
| GS1566 | 4990 | GCCCAATACGTCCAACTCAACACGCCGCACAG | 9579 | AQYVQLNNAAQ | 14168 | YVQLNNA | 0.099805 | -0.09965 |
| SyS2747 | 4991 | GCCCAAACCGAAAAAGGCTGGGGCCCCGCACAG | 9580 | AQTEKGWGPAQ | 14169 | TEKGWGP | 0.099789 | -0.0324 |
| GP219 | 4992 | GCCCAATCTCCGCAGAGGCATAATAGTGCACAG | 9581 | AQSPQRHNSAQ | 14170 | SPQRHNS | 0.099622 | -0.07162 |
| SyS2748 | 4993 | GCCCAATACACCCACCATGACCGAAAGAGCACAG | 9582 | AQYTHMTERAQ | 14171 | YTHMTER | 0.099615 | -0.13451 |
| SyS2749 | 4994 | GCCCAAGATCGGTCTATGCAGCAGGCTGCACAG | 9583 | AQDRSMQQAAQ | 14172 | DRSMQQA | 0.099482 | -0.12465 |
| GS1568 | 4995 | GCCCAAGACACCATGAACGCCATGAGAGCACAG | 9584 | AQDTMNAMRAQ | 14173 | DTMNAMR | 0.099158 | -0.18188 |
| SyS2750 | 4996 | GCCCAACTCAAACCCGGCCACATGGTCGCACAG | 9585 | AQLKPGHMVAQ | 14174 | LKPGHMV | 0.099141 | -0.19353 |
| GS1570 | 4997 | GCCCAACAATTCAACAGCAAAGACACCGCACAG | 9586 | AQQFNSKDTAQ | 14175 | QFNSKDT | 0.098945 | -0.04968 |
| GS1571 | 4998 | GCCCAATGGACCAACAGCAGAGACCCCATGGCACAG | 9587 | AQWTNSRPMAQ | 14176 | WTNSRPM | 0.098784 | -0.15843 |
| GS1572 | 4999 | GCCCAACATTGCTGACGACTTCTTCTGAGGCACAG | 9588 | AQLLTTSSEAQ | 14177 | LLTTSSE | 0.098761 | -0.13998 |
| SyS2752 | 5000 | GCCCAACAGCGTGCTTCTTCTGGTTCTGCACAG | 9589 | AQQRASSGSAQ | 14178 | QRASSGS | 0.098675 | -0.14647 |
| SyS2753 | 5001 | GCCCAACCCAAAGAAAGCAACAACATGGCACAG | 9590 | AQPKESNNMAQ | 14179 | PKESNNM | 0.098625 | -0.2277 |

FIG. 33 (Continued)

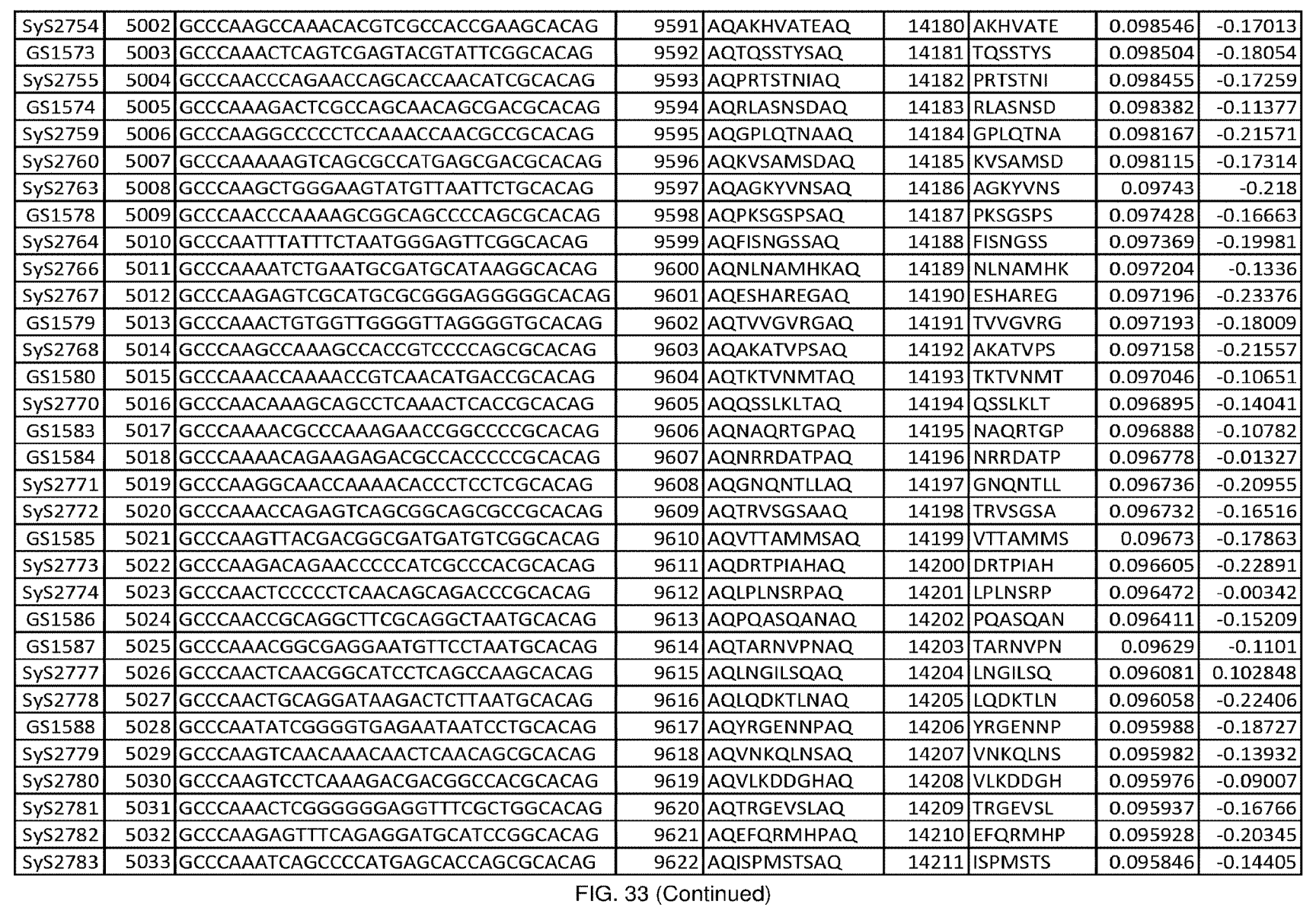

| | | | | | | | | |
|---|---|---|---|---|---|---|---|---|
| SyS2754 | 5002 | GCCCAAGCCAAACACGTCGCCACCGAAGCACAG | 9591 | AQAKHVATEAQ | 14180 | AKHVATE | 0.098546 | -0.17013 |
| GS1573 | 5003 | GCCCAAACTCAGTCGAGTACGTATTCGGCACAG | 9592 | AQTQSSTYSAQ | 14181 | TQSSTYS | 0.098504 | -0.18054 |
| SyS2755 | 5004 | GCCCAAACCAGAACCAGCAACAACATCGCACAG | 9593 | AQPRTSTNIAQ | 14182 | PRTSTNI | 0.098455 | -0.17259 |
| GS1574 | 5005 | GCCCAAAGACTCGCCAGCAACAGCGACGCACAG | 9594 | AQRLASNSDAQ | 14183 | RLASNSD | 0.098382 | -0.11377 |
| SyS2759 | 5006 | GCCCAAGGCCCCTCCAAACCAACGCCGCACAG | 9595 | AQGPLQTNAAQ | 14184 | GPLQTNA | 0.098167 | -0.21571 |
| SyS2760 | 5007 | GCCCAAAAAGTCAGCGCCATGAGCGACGCACAG | 9596 | AQKVSAMSDAQ | 14185 | KVSAMSD | 0.098115 | -0.17314 |
| SyS2763 | 5008 | GCCCAAGCTGGGAAGTATGTTAATTCTGCACAG | 9597 | AQAGKYVNSAQ | 14186 | AGKYVNS | 0.09743 | -0.218 |
| GS1578 | 5009 | GCCCAACCCAAAAGCGGCAGCCCCAGCGCACAG | 9598 | AQPKSGSPSAQ | 14187 | PKSGSPS | 0.097428 | -0.16663 |
| SyS2764 | 5010 | GCCCAATTTATTTCTAATGGGAGTTCGGCACAG | 9599 | AQFISNGSSAQ | 14188 | FISNGSS | 0.097369 | -0.19981 |
| SyS2766 | 5011 | GCCCAAAATCTGAATGCGATGCATAAGGCACAG | 9600 | AQNLNAMHKAQ | 14189 | NLNAMHK | 0.097204 | -0.1336 |
| SyS2767 | 5012 | GCCCAAGAGTCGCATGCGGGGAGGGGGCACAG | 9601 | AQESHAREGAQ | 14190 | ESHAREG | 0.097196 | -0.23376 |
| GS1579 | 5013 | GCCCAAACTGTGGTTGGGGTTAGGGGTGCACAG | 9602 | AQTVVGVRGAQ | 14191 | TVVGVRG | 0.097193 | -0.18009 |
| SyS2768 | 5014 | GCCCAAGCCAAAGCCACCGTCCCCAGCGCACAG | 9603 | AQAKATVPSAQ | 14192 | AKATVPS | 0.097158 | -0.21557 |
| GS1580 | 5015 | GCCCAACCAACAAAACCGTCAACATGACCGCACAG | 9604 | AQTKTVNMTAQ | 14193 | TKTVNMT | 0.097046 | -0.10651 |
| SyS2770 | 5016 | GCCCAACAAAGCAGCCTCAAACTCACCGCACAG | 9605 | AQQSSLKLTAQ | 14194 | QSSLKLT | 0.096895 | -0.14041 |
| GS1583 | 5017 | GCCCAAAAGCCCAAAGAACCGGCCCCGCACAG | 9606 | AQNAQRTGPAQ | 14195 | NAQRTGP | 0.096888 | -0.10782 |
| GS1584 | 5018 | GCCCAAAACAGAGAGACGCCACCCCGCACAG | 9607 | AQNRRDATPAQ | 14196 | NRRDATP | 0.096778 | -0.01327 |
| SyS2771 | 5019 | GCCCAAGGCAACCAAAACACCCTCCTGCACAG | 9608 | AQGNQNTLLAQ | 14197 | GNQNTLL | 0.096736 | -0.20955 |
| SyS2772 | 5020 | GCCCAAACCAGAGTCAGCGGCAGCGCCGCACAG | 9609 | AQTRVSGSAAQ | 14198 | TRVSGSA | 0.096732 | -0.16516 |
| GS1585 | 5021 | GCCCAAGTTACGACGGCGGATGATGTCGGCACAG | 9610 | AQVTTAMMSAQ | 14199 | VTTAMMS | 0.09673 | -0.17863 |
| SyS2773 | 5022 | GCCCAAGACAGAACCCCATGCGCCACGCACAG | 9611 | AQDRTPIAHAQ | 14200 | DRTPIAH | 0.096605 | -0.22891 |
| SyS2774 | 5023 | GCCCAACTCCCCTCAACAGCAGACCCGCACAG | 9612 | AQLPLNSRPAQ | 14201 | LPLNSRP | 0.096472 | -0.00342 |
| GS1586 | 5024 | GCCCAACCGCAGGCTTCGCAGGCTAATGCACAG | 9613 | AQPQASQANAQ | 14202 | PQASQAN | 0.096411 | -0.15209 |
| GS1587 | 5025 | GCCCAAACGGCGAGGAATGTTCCTAATGCACAG | 9614 | AQTARNVPNAQ | 14203 | TARNVPN | 0.09629 | -0.1101 |
| SyS2777 | 5026 | GCCCAACTCAACGGCATCCTCAGCCAAGCACAG | 9615 | AQLNGILSQAQ | 14204 | LNGILSQ | 0.096081 | 0.102848 |
| SyS2778 | 5027 | GCCCAACTGCAGGATAAGACTCTTAATGCACAG | 9616 | AQLQDKTLNAQ | 14205 | LQDKTLN | 0.096058 | -0.22406 |
| GS1588 | 5028 | GCCCAATATCGGGGTGAGAATAATCCTGCACAG | 9617 | AQYRGENNPAQ | 14206 | YRGENNP | 0.095988 | -0.18727 |
| SyS2779 | 5029 | GCCCAAGTCAACAAACAACTCAACAGCGCACAG | 9618 | AQVNKQLNSAQ | 14207 | VNKQLNS | 0.095982 | -0.13932 |
| SyS2780 | 5030 | GCCCAAGTCCTCAAAGACGACGGCCACGCACAG | 9619 | AQVLKDDGHAQ | 14208 | VLKDDGH | 0.095976 | -0.09007 |
| SyS2781 | 5031 | GCCCAAACTCGGGGGGGAGGTTTCGCTGGCACAG | 9620 | AQTRGEVSLAQ | 14209 | TRGEVSL | 0.095937 | -0.16766 |
| SyS2782 | 5032 | GCCCAAGAGTTTCAGAGGATGCATCCGGCACAG | 9621 | AQEFQRMHPAQ | 14210 | EFQRMHP | 0.095928 | -0.20345 |
| SyS2783 | 5033 | GCCCAAAATCAGCCCCATGAGCACCAGCGCACAG | 9622 | AQISPMSTSAQ | 14211 | ISPMSTS | 0.095846 | -0.14405 |

FIG. 33 (Continued)

| | | | | | | | | |
|---|---|---|---|---|---|---|---|---|
| SyS2784 | 5034 | GCCCAACTCGGCCACGACCACGCCACCGCACAG | 9623 | AQLGHDHATAQ | 14212 | LGHDHAT | 0.0958 | -0.22164 |
| GS1590 | 5035 | GCCCAACTCAGCCCGGCCCCCAACAAGCACAG | 9624 | AQLSPGPQQAQ | 14213 | LSPGPQQ | 0.095745 | -0.171 |
| GP221 | 5036 | GCCCAAAAGTTTAGGGGGGAGGAGCCTGCACAG | 9625 | AQKFRGEEPAQ | 14214 | KFRGEEP | 0.095692 | -0.06711 |
| GS1591 | 5037 | GCCCAACAGGGTTCTCGTCTGGCTTCGGCACAG | 9626 | AQQGSRLASAQ | 14215 | QGSRLAS | 0.095684 | -0.16753 |
| SyS2786 | 5038 | GCCCAATGGGAGCGGTTCTCAGTTGTCTGCACAG | 9627 | AQWERSQLSAQ | 14216 | WERSQLS | 0.095581 | -0.20093 |
| SyS2787 | 5039 | GCCCAACAGCAGAAGGCGGCTAATGGGGCACAG | 9628 | AQQQKAANGAQ | 14217 | QQKAANG | 0.095548 | -0.01243 |
| SyS2788 | 5040 | GCCCAATATACGCTGAGTCTGAGTAGTGCACAG | 9629 | AQYTLSLSSAQ | 14218 | YTLSLSS | 0.095427 | -0.20339 |
| SyS2789 | 5041 | GCCCAAGGCCTCATCCCAACAACAGCGCACAG | 9630 | AQGLIPNNSAQ | 14219 | GLIPNNS | 0.095235 | -0.23173 |
| SyS2790 | 5042 | GCCCAAAGCGTCCCGTCAGCAGAACCGCACAG | 9631 | AQSVPVSRTAQ | 14220 | SVPVSRT | 0.095224 | -0.08979 |
| SP51 | 5043 | GCCCAAAATAAGCAGCAGTCTCAGACGGCACAG | 9632 | AQNKQQSQTAQ | 14221 | NKQQSQT | 0.095031 | -0.04883 |
| SyS2792 | 5044 | GCCCAAAGCAAACACAGCGTCCAAGTCGCACAG | 9633 | AQSKHSVQVAQ | 14222 | SKHSVQV | 0.095008 | -0.01372 |
| GS1592 | 5045 | GCCCAAAATCGTCCTTCTCAGCAGGGGGCACAG | 9634 | AQNRPSQQGAQ | 14223 | NRPSQQG | 0.094956 | -0.08958 |
| SyS2793 | 5046 | GCCCAACAAGAATACAGAAACACCCTCGCACAG | 9635 | AQQEYRNTLAQ | 14224 | QEYRNTL | 0.094903 | -0.17072 |
| SyS2794 | 5047 | GCCCAATTCGAAAGAGACAGAATGGGCGCACAG | 9636 | AQFERDRMGAQ | 14225 | FERDRMG | 0.094881 | -0.19133 |
| SyS2795 | 5048 | GCCCAAGCACCAGCAGCAACCTCAGCGCACAG | 9637 | AQSTSSNLSAQ | 14226 | STSSNLS | 0.094566 | -0.23012 |
| SyS2796 | 5049 | GCCCAAAGAAGCCTCGAAGGCATCGTCGCACAG | 9638 | AQRSLEGIVAQ | 14227 | RSLEGIV | 0.094566 | -0.23012 |
| SyS2797 | 5050 | GCCCAAGGCAACAGCAGCAGACTCGACCCGCACAG | 9639 | AQGNSRLDPAQ | 14228 | GNSRLDP | 0.094522 | -0.12222 |
| GS1594 | 5051 | GCCCAAATCGACACCATCGGCAAAGCCGCACAG | 9640 | AQIDTIGKAAQ | 14229 | IDTIGKA | 0.094385 | -0.15766 |
| SyS2799 | 5052 | GCCCAACTGGATCATACGAGTCGTGCGGCACAG | 9641 | AQLDHTSRAAQ | 14230 | LDHTSRA | 0.094325 | -0.18405 |
| SyS2800 | 5053 | GCCCAATGGGCCAAACCAACAGCAGCGCACAG | 9642 | AQWGQTNSSAQ | 14231 | WGQTNSS | 0.094236 | -0.10601 |
| GS1596 | 5054 | GCCCAAGCGCGGGGTAATCTGTGAGTGCACAG | 9643 | AQARGNLSSAQ | 14232 | ARGNLSS | 0.094135 | -0.14906 |
| SyS2801 | 5055 | GCCCAAGACAACATGAAACTCCACGTCGCACAG | 9644 | AQDNMKLHVAQ | 14233 | DNMKLHV | 0.094093 | -0.22527 |
| SyS2802 | 5056 | GCCCAAGAAAAAACCCACAAAGTACGCACAG | 9645 | AQEKTQQSYAQ | 14234 | EKTQQSY | 0.094009 | -0.08103 |
| GS1597 | 5057 | GCCCAATCGAATGGTTGGCGCGGAATGCACAG | 9646 | AQSNGLARNAQ | 14235 | SNGLARN | 0.093844 | -0.16118 |
| GS1598 | 5058 | GCCCAAGTCGTCAGCACAGACCCGCCGCACAG | 9647 | AQVVSHRPAAQ | 14236 | VVSHRPA | 0.093796 | -0.17112 |
| SyS2803 | 5059 | GCCCAAAGTTTGGGTGTTAGTCGGAATGCACAG | 9648 | AQSLGVSRNAQ | 14237 | SLGVSRN | 0.093666 | -0.06472 |
| SyS2804 | 5060 | GCCCAAGACCACAGCCACGGCAGAGACGCACAG | 9649 | AQDHSHGRDAQ | 14238 | DHSHGRD | 0.093446 | -0.218 |
| SyP78 | 5061 | GCCCAATCGACTCATCAGGTGGCGAATGCACAG | 9650 | AQSTHQVANAQ | 14239 | STHQVAN | 0.093182 | -0.0423 |
| SyS2806 | 5062 | GCCCAAAATCAGAGTGCGAGTAGTGCGCACAG | 9651 | AQNQSASSRAQ | 14240 | NQSASSR | 0.09291 | -0.16223 |
| SyS2807 | 5063 | GCCCAAGTCACCGTCGGCAGCCACATGGCACAG | 9652 | AQVTVGSHMAQ | 14241 | VTVGSHM | 0.092881 | -0.13936 |
| SyS2808 | 5064 | GCCCAAAGCAGCAACATCGCCCAAAACGCACAG | 9653 | AQSSNIAQNAQ | 14242 | SSNIAQN | 0.092827 | -0.11131 |
| GP222 | 5065 | GCCCAATTGAATGAGAGATGGCTACTCCTGCACAG | 9654 | AQLNEMATPAQ | 14243 | LNEMATP | 0.092632 | -0.071 |

FIG. 33 (Continued)

| | | | | | | | | |
|---|---|---|---|---|---|---|---|---|
| GS1600 | 5066 | GCCCAAAGCACCAAAATCGAAAGAGACGCACAG | 9655 | AQSTKIERDAQ | 14244 | STKIERD | 0.092384 | -0.16337 |
| SyS2811 | 5067 | GCCCAAAACCTCGTCGACGCCAGAATCGCACAG | 9656 | AQNLVDARIAQ | 14245 | NLVDARI | 0.092338 | -0.20345 |
| GS1601 | 5068 | GCCCAATACAGCACCGGCAAAGACGCCGCACAG | 9657 | AQYSTGKDAAQ | 14246 | YSTGKDA | 0.092318 | -0.16663 |
| SyS2812 | 5069 | GCCCAAACCCAAGGCATCGTCACCAGCGCACAG | 9658 | AQTQGIVTSAQ | 14247 | TQGIVTS | 0.092249 | -0.22187 |
| SyS2813 | 5070 | GCCCAATCTTTTGGGGCTACGAGTTGGCACAG | 9659 | AQSFGATSLAQ | 14248 | SFGATSL | 0.092013 | -0.22434 |
| SyP79 | 5071 | GCCCAAACTGCGGGGGATGTCTTCGCGGGCACAG | 9660 | AQTAGMSSRAQ | 14249 | TAGMSSR | 0.091732 | -0.03931 |
| SyS2815 | 5072 | GCCCAAAGAGACAACAGCCTCATCCCCGCACAG | 9661 | AQRDNSLIPAQ | 14250 | RDNSLIP | 0.091477 | -0.06762 |
| SyS2816 | 5073 | GCCCAAAAGACTAATGCTGATTATGGGGCACAG | 9662 | AQKTNADYGAQ | 14251 | KTNADYG | 0.09146 | -0.13314 |
| GS1602 | 5074 | GCCCAAGTCAACCCCACAGAACCATGGCACAG | 9663 | AQVNPHRTMAQ | 14252 | VNPHRTM | 0.091294 | -0.14811 |
| GS1603 | 5075 | GCCCAAGATATTCGTGGGAGGCCTACTGCACAG | 9664 | AQDIRGRPTAQ | 14253 | DIRGRPT | 0.091275 | -0.16528 |
| SyS2818 | 5076 | GCCCAACGTGAGGTTTCGAGTACTTCTGCACAG | 9665 | AQREVSSTSAQ | 14254 | REVSSTS | 0.091098 | -0.0482 |
| SyS2819 | 5077 | GCCCAAGTCAGCCAAGGCACCAGAGTCGCACAG | 9666 | AQVSQGTRVAQ | 14255 | VSQGTRV | 0.091058 | -0.12344 |
| SyS2820 | 5078 | GCCCAAAAGACGCCTATTATGCATGCGGGCACAG | 9667 | AQKTPIMHAAQ | 14256 | KTPIMHA | 0.090778 | -0.14647 |
| GP224 | 5079 | GCCCAACTGGAGTCGCGGGATACGGTTGCACAG | 9668 | AQLESRDTVAQ | 14257 | LESRDTV | 0.090555 | -0.07426 |
| SyS2822 | 5080 | GCCCAAGTCCTCAACAGCAGCATGACCGCACAG | 9669 | AQVLNSSMTAQ | 14258 | VLNSSMT | 0.090547 | -0.22064 |
| GS1605 | 5081 | GCCCAATTTCGGACTGTGACGCAGGCGGCACAG | 9670 | AQFRTVTQAAQ | 14259 | FRTVTQA | 0.090305 | -0.15001 |
| SyS2823 | 5082 | GCCCAAACCGGCGCCATGAACATGACCGCACAG | 9671 | AQTGAMNMTAQ | 14260 | TGAMNMT | 0.09021 | 0.113384 |
| GS1606 | 5083 | GCCCAATTGAAGACTCAGAATTATTCTGCACAG | 9672 | AQLKTQNYSAQ | 14261 | LKTQNYS | 0.090046 | -0.18457 |
| GS1607 | 5084 | GCCCAACAGAAGACGATGTTGACTGCTGCACAG | 9673 | AQQKTMLTAAQ | 14262 | QKTMLTA | 0.089785 | -0.10968 |
| SyS2824 | 5085 | GCCCAAAGTAATATTATTGGTTCGGATGCACAG | 9674 | AQSNIIGSDAQ | 14263 | SNIIGSD | 0.089711 | -0.20562 |
| SyS2825 | 5086 | GCCCAATGCGTGTCGGTTTCGGTTTCGAAGATGGCACAG | 9675 | AQSVSVSKMAQ | 14264 | SVSVSKM | 0.089669 | -0.22042 |
| SyS2826 | 5087 | GCCCAAGCGGCCAGGTTCGCATGCTGCACAG | 9676 | AQAAQVSHAAQ | 14265 | AAQVSHA | 0.089533 | -0.18284 |
| SyS2827 | 5088 | GCCCAAATTAATGTGGTTGAGAAGGCTGCACAG | 9677 | AQINVVEKAAQ | 14266 | INVVEKA | 0.089471 | -0.14819 |
| SyS2829 | 5089 | GCCCAAATGCTCAGAGGGGACCTCCCGCACAG | 9678 | AQMLRGDLPAQ | 14267 | MLRGDLP | 0.089436 | -0.18245 |
| SyS2830 | 5090 | GCCCAAAACCTCCCACCATGCCAACCCGCACAG | 9679 | AQNLPTMQPAQ | 14268 | NLPTMQP | 0.089402 | -0.21557 |
| SyS2831 | 5091 | GCCCAATTCCAAGACAAAATCAACAGAGCACAG | 9680 | AQFQDKINRAQ | 14269 | FQDKINR | 0.089402 | -0.21557 |
| GS1609 | 5092 | GCCCAAAGCAGACAAACCATGAAACCGCACAG | 9681 | AQSRQTIETAQ | 14270 | SRQTIET | 0.089312 | -0.12392 |
| SyS2833 | 5093 | GCCCAACTCCACAGCAAACTCAACGGGCACAG | 9682 | AQLHSKLNGAQ | 14271 | LHSKLNG | 0.089225 | -0.17557 |
| SyS2834 | 5094 | GCCCAAACCCCAGCGCCAGCAACATGGCACAG | 9683 | AQTPSASNMAQ | 14272 | TPSASNM | 0.089132 | -0.23296 |
| GS1611 | 5095 | GCCCAAGCTAATACGGCTATTAGGACTGCACAG | 9684 | AQANTAIRTAQ | 14273 | ANTAIRT | 0.088865 | -0.18637 |
| GS1612 | 5096 | GCCCAAAGCCCCTACACACCAAAAACGCACAG | 9685 | AQSPYNQNNAQ | 14274 | SPYNQNN | 0.088563 | -0.18009 |
| SyS2835 | 5097 | GCCCAATCGGGGAAGCAGCAGACGACTGCACAG | 9686 | AQSGKQQTTAQ | 14275 | SGKQQTT | 0.088368 | -0.06888 |

FIG. 33 (Continued)

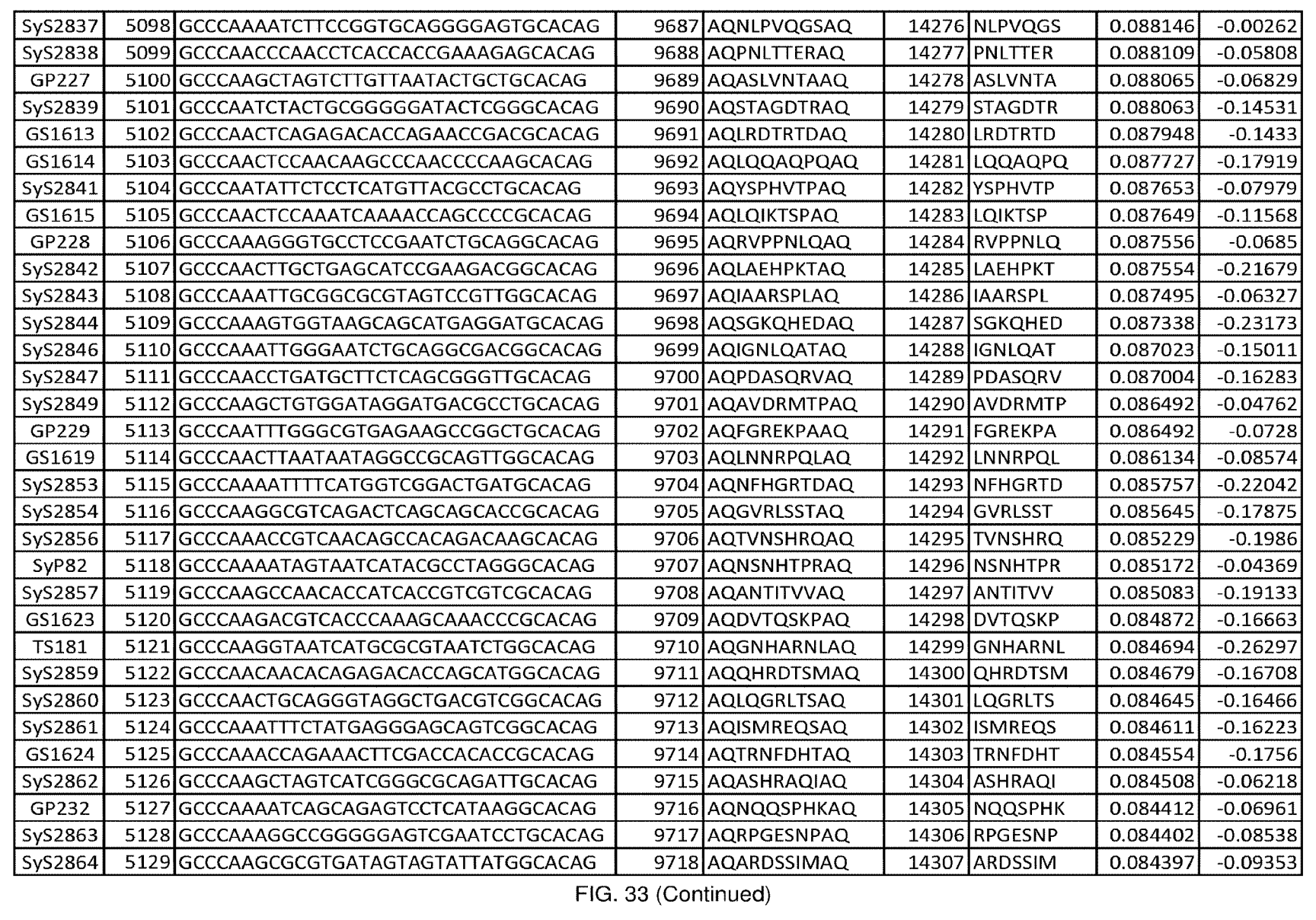

| | | | | | | | | |
|---|---|---|---|---|---|---|---|---|
| SyS2837 | 5098 | GCCCAAAATCTTCCGGTGCAGGGGAGTGCACAG | 9687 | AQNLPVQGSAQ | 14276 | NLPVQGS | 0.088146 | -0.00262 |
| SyS2838 | 5099 | GCCCAACCCAACCTCACCACGGAAAGAGCACAG | 9688 | AQPNLTTERAQ | 14277 | PNLTTER | 0.088109 | -0.05808 |
| GP227 | 5100 | GCCCAAGCTAGTCTTGTTAATACTGCTGCACAG | 9689 | AQASLVNTAAQ | 14278 | ASLVNTA | 0.088065 | -0.06829 |
| SyS2839 | 5101 | GCCCAATCTACTGCGGGGGATACTCGGGCACAG | 9690 | AQSTAGDTRAQ | 14279 | STAGDTR | 0.088063 | -0.14531 |
| GS1613 | 5102 | GCCCAACTCAGAGACACCAGAACCGACGGCACAG | 9691 | AQLRDTRTDAQ | 14280 | LRDTRTD | 0.087948 | -0.1433 |
| GS1614 | 5103 | GCCCAACTCCAACAAGCCCAACCCCAAGCACAG | 9692 | AQLQQAQPQAQ | 14281 | LQQAQPQ | 0.087727 | -0.17919 |
| SyS2841 | 5104 | GCCCAATATTCTCCTCATGTTACGCCTGCACAG | 9693 | AQYSPHVTPAQ | 14282 | YSPHVTP | 0.087653 | -0.07979 |
| GS1615 | 5105 | GCCCAACTCCAAATCAAAACCAGCCCGCACAG | 9694 | AQLQIKTSPAQ | 14283 | LQIKTSP | 0.087649 | -0.11568 |
| GP228 | 5106 | GCCCAAAGGGTGCCTCCGAATCTGCAGGCACAG | 9695 | AQRVPPNLQAQ | 14284 | RVPPNLQ | 0.087556 | -0.0685 |
| SyS2842 | 5107 | GCCCAACTTGCTGAGCATCCGAAGACGGCACAG | 9696 | AQLAEHPKTAQ | 14285 | LAEHPKT | 0.087554 | -0.21679 |
| SyS2843 | 5108 | GCCCAAATTGCGGCGCGTAGTCCGTTGGCACAG | 9697 | AQIAARSPLAQ | 14286 | IAARSPL | 0.087495 | -0.06327 |
| SyS2844 | 5109 | GCCCAAAGTGGTAAGCAGCATGAGGATGCACAG | 9698 | AQSGKQHEDAQ | 14287 | SGKQHED | 0.087338 | -0.23173 |
| SyS2846 | 5110 | GCCCAAATTGGGAATCTGCAGGCGACGGCACAG | 9699 | AQIGNLQATAQ | 14288 | IGNLQAT | 0.087023 | -0.15011 |
| SyS2847 | 5111 | GCCCAACCTGATGCTTCTCAGCGGGTTGCACAG | 9700 | AQPDASQRVAQ | 14289 | PDASQRV | 0.087004 | -0.16283 |
| SyS2849 | 5112 | GCCCAAGCTGTGGATAGGATGACGCCTGCACAG | 9701 | AQAVDRMTPAQ | 14290 | AVDRMTP | 0.086492 | -0.04762 |
| GP229 | 5113 | GCCCAATTTGGGCGTGAGAAGCCGGCTGCACAG | 9702 | AQFGREKPAAQ | 14291 | FGREKPA | 0.086492 | -0.0728 |
| GS1619 | 5114 | GCCCAACTTAATAATAGGCCGCAGTTGGCACAG | 9703 | AQLNNRPQLAQ | 14292 | LNNRPQL | 0.086134 | -0.08574 |
| SyS2853 | 5115 | GCCCAAAATTTTCATGGTCGGACTGATGCACAG | 9704 | AQNFHGRTDAQ | 14293 | NFHGRTD | 0.085757 | -0.22042 |
| SyS2854 | 5116 | GCCCAAGGCGTCAGACTCAGCGACACCGCACAG | 9705 | AQGVRLSSTAQ | 14294 | GVRLSST | 0.085645 | -0.17875 |
| SyS2856 | 5117 | GCCCAAACCGTCAACAGCACAGACAAGCACAG | 9706 | AQTVNSHRQAQ | 14295 | TVNSHRQ | 0.085229 | -0.1986 |
| SyP82 | 5118 | GCCCAAAATAGTAATCATACGCCTAGGGCACAG | 9707 | AQNSNHTPRAQ | 14296 | NSNHTPR | 0.085172 | -0.04369 |
| SyS2857 | 5119 | GCCCAAGCCAACACCATCACCGTCGTCGCACAG | 9708 | AQANTITVVAQ | 14297 | ANTITVV | 0.085083 | -0.19133 |
| GS1623 | 5120 | GCCCAAGACGTCACCCAAAGCAAACCCGCACAG | 9709 | AQDVTQSKPAQ | 14298 | DVTQSKP | 0.084872 | -0.16663 |
| TS181 | 5121 | GCCCAAGGTAATCATGCGGGTAATCTGGCACAG | 9710 | AQGNHARNLAQ | 14299 | GNHARNL | 0.084694 | -0.26297 |
| SyS2859 | 5122 | GCCCAACAACAGAGACACCAGCATATGGCACAG | 9711 | AQQHRDTSMAQ | 14300 | QHRDTSM | 0.084679 | -0.16708 |
| SyS2860 | 5123 | GCCCAACTGCAGGGTAGGCTGACGTCGGCACAG | 9712 | AQLQGRLTSAQ | 14301 | LQGRLTS | 0.084645 | -0.16466 |
| SyS2861 | 5124 | GCCCAAATTTCTATGAGGGAGCAGTCGGCACAG | 9713 | AQISMREQSAQ | 14302 | ISMREQS | 0.084611 | -0.16223 |
| GS1624 | 5125 | GCCCAAACCAGAAACTTCGACCACCGCACAG | 9714 | AQTRNFDHTAQ | 14303 | TRNFDHT | 0.084554 | -0.1756 |
| SyS2862 | 5126 | GCCCAAGCTAGTAATCAGCAGAGTCCTCATGGCACAG | 9715 | AQASHRAQIAQ | 14304 | ASHRAQI | 0.084508 | -0.06218 |
| GP232 | 5127 | GCCCAAAATCAGCAGAGTCCTCATAAGGCACAG | 9716 | AQNQQSPHKAQ | 14305 | NQQSPHK | 0.084412 | -0.06961 |
| SyS2863 | 5128 | GCCCAAAGGCCGGGGGAGTCGAATCCTGCACAG | 9717 | AQRPGESNPAQ | 14306 | RPGESNP | 0.084402 | -0.08538 |
| SyS2864 | 5129 | GCCCAAGCGCGTGATAGTAGTATTATGGCACAG | 9718 | AQARDSSIMAQ | 14307 | ARDSSIM | 0.084397 | -0.09353 |

FIG. 33 (Continued)

| | | | | | | | | |
|---|---|---|---|---|---|---|---|---|
| GS1625 | 5130 | GCCCAAACCGGCATGAGCACCCAAGTCGCACAG | 9719 | AQTGMSTQVAQ | 14308 | TGMSTQV | 0.084373 | -0.1586 |
| SyS2865 | 5131 | GCCCAAATGGGTGTGAAGGCGGATATTGCACAG | 9720 | AQMGVKADIAQ | 14309 | MGVKADI | 0.084327 | 0.025771 |
| SyS2866 | 5132 | GCCCAACAATTCAAAGGCATCACCCAAGCACAG | 9721 | AQQFKGITQAQ | 14310 | QFKGITQ | 0.084326 | -0.01044 |
| SyS2867 | 5133 | GCCCAACACAACAACAGCCCACCCACGCACAG | 9722 | AQHNNSPTHAQ | 14311 | HNNSPTH | 0.084074 | -0.23618 |
| SyS2868 | 5134 | GCCCAAGACAGCAACTTCACCGCGCGCACAG | 9723 | AQDSNFTSAAQ | 14312 | DSNFTSA | 0.083991 | -0.23133 |
| SyP83 | 5135 | GCCCAAGCGGTTCCGCATATGGGTACGGCACAG | 9724 | AQAVPHMGTAQ | 14313 | AVPHMGT | 0.083983 | -0.04282 |
| SyS2869 | 5136 | GCCCAAGTCGTCAGCCCCAACCTCATGGCACAG | 9725 | AQVVSPNLMAQ | 14314 | VVSPNLM | 0.083952 | -0.22891 |
| SyS2870 | 5137 | GCCCAACCCTTCCCCAAAACCCTCGACGCACAG | 9726 | AQPFPKTLDAQ | 14315 | PFPKTLD | 0.08395 | -0.19353 |
| GP233 | 5138 | GCCCAACAGAGTGCGGGTCTTGCGGAGGCACAG | 9727 | AQQSAGLAEAQ | 14316 | QSAGLAE | 0.083906 | -0.07245 |
| GS1627 | 5139 | GCCCAAGGCAAAGCCCACGACCTCGCCGCACAG | 9728 | AQGKAHDLAAQ | 14317 | GKAHDLA | 0.083898 | -0.17672 |
| GS1629 | 5140 | GCCCAACAAAGAATCAGCACCAACGCCGCACAG | 9729 | AQQRISTNAAQ | 14318 | QRISTNA | 0.083603 | -0.08402 |
| SyS2872 | 5141 | GCCCAATGGCTCACCACCGGCAGCAGCGCACAG | 9730 | AQWLTTGSSAQ | 14319 | WLTTGSS | 0.083427 | -0.22064 |
| SyS2873 | 5142 | GCCCAATACAGAGCCCAAGGCCCCCTCGCACAG | 9731 | AQYRAQGPLAQ | 14320 | YRAQGPL | 0.083416 | -0.18284 |
| SyS2874 | 5143 | GCCCAAGTGATGAAGAGGTATGATGAGGCACAG | 9732 | AQVMKRYDEAQ | 14321 | VMKRYDE | 0.083375 | -0.17799 |
| GS1631 | 5144 | GCCCAACTCGAATACAGCCAAAGAGACGCACAG | 9733 | AQLEYSQRDAQ | 14322 | LEYSQRD | 0.083359 | -0.18368 |
| SyS2876 | 5145 | GCCCAACTCCAAAAAGTCCACCTCGGCGCACAG | 9734 | AQLQKVHLGAQ | 14323 | LQKVHLG | 0.083283 | -0.16587 |
| GP234 | 5146 | GCCCAACGTTCTCATTCCATCCTTCGGCACAG | 9735 | AQRSHSHPSAQ | 14324 | RSHSHPS | 0.083166 | -0.07405 |
| SyS2878 | 5147 | GCCCAACACACTTCACCAGCACCGGCGCACAG | 9736 | AQHTFTSTGAQ | 14325 | HTFTSTG | 0.082801 | -0.06161 |
| GS1632 | 5148 | GCCCAATCTGTTGGTAGTGGTCCTGGTGCACAG | 9737 | AQSVGSGPGAQ | 14326 | SVGSGPG | 0.082658 | -0.1765 |
| SyS2880 | 5149 | GCCCAACAAAGCTTCAACGGCAGCAACGCACAG | 9738 | AQQSFNGSNAQ | 14327 | QSFNGSN | 0.08265 | -0.22557 |
| SyS2881 | 5150 | GCCCAAGTCACCGCCATCAGAGGCGCCGCACAG | 9739 | AQVTAIRGAAQ | 14328 | VTAIRGA | 0.082407 | -0.14105 |
| GS1634 | 5151 | GCCCAATTGGGAAGAGTCTTATAGTGCACAG | 9740 | AQLGKTSYSAQ | 14329 | LGKTSYS | 0.082225 | -0.12353 |
| SyS2882 | 5152 | GCCCAAAGCTACGATGGCGATGGCTTCTGCACAG | 9741 | AQSTMAMASAQ | 14330 | STMAMAS | 0.082049 | -0.13139 |
| SyS2883 | 5153 | GCCCAAGCTTCTGGTAGGTCTTCTGTGCACAG | 9742 | AQASGRSSAAQ | 14331 | ASGRSSA | 0.081913 | -0.13556 |
| SyS2884 | 5154 | GCCCAAGGCAGAACCCCCGCGGTCGAAGCACAG | 9743 | AQGRTPAVEAQ | 14332 | GRTPAVE | 0.081913 | -0.14283 |
| SyS2885 | 5155 | GCCCAAGGCAGAATCGACGTCAGCAGCGCACAG | 9744 | AQGRIDVSSAQ | 14333 | GRIDVSS | 0.081913 | -0.16223 |
| SyS2886 | 5156 | GCCCAAACCCCCAAAGTCAACAGCAGCGCACAG | 9745 | AQTPKVNSSAQ | 14334 | TPKVNSS | 0.081913 | -0.18648 |
| SyS2887 | 5157 | GCCCAAAGTGTTCGGAATTCGACTACTGCACAG | 9746 | AQSVRNSTTAQ | 14335 | SVRNSTT | 0.081913 | -0.1986 |
| SyS2888 | 5158 | GCCCAAGTTAATGGTGCTCAGCAGATTGCACAG | 9747 | AQVNGAQQIAQ | 14336 | VNGAQQI | 0.081913 | -0.20588 |
| SyS2889 | 5159 | GCCCAAAACAGAGCCGAAAGCTTCAGAGCACAG | 9748 | AQNRAESFRAQ | 14337 | NRAESFR | 0.081913 | -0.22042 |
| SyS2891 | 5160 | GCCCAACAACGACAGCCAGCGTCAGAGCACAG | 9749 | AQHDRASVRAQ | 14338 | HDRASVR | 0.081913 | -0.22285 |
| GS1637 | 5161 | GCCCAAGACAGCCCCAGCAGAGGCAGAGCACAG | 9750 | AQDSPSRGRAQ | 14339 | DSPSRGR | 0.081895 | -0.13812 |

FIG. 33 (Continued)

| | | | | | |
|---|---|---|---|---|---|
| GS1638 | GCCCAAAGCAACAACATCCACAGCAAAGCACAG | 5162 | AQSNNIIHSKAQ | 14340 | SNNIIHSK | 0.081895 | -0.13812 |
| GS1639 | GCCCAAATCAACAACACATCGTCATCCCGCACAG | 5163 | AQINNIVIPAQ | 14341 | INNIVIP | 0.081806 | -0.18149 |
| GS1640 | GCCCAAATTCGGAGTTCTGATGAGACGGCACAG | 5164 | AQIRSSDETAQ | 14342 | IRSSDET | 0.081637 | -0.17201 |
| SyS2893 | GCCCAAAACATGCCCAGCTCGTCGCCGCACACAG | 5165 | AQNMPSLVAAQ | 14343 | NMPSLVA | 0.081507 | -0.07591 |
| GP235 | GCCCAAAATAGGACGGCTGGAGTCTATTGCACAG | 5166 | AQNRTLESIAQ | 14344 | NRTLESI | 0.081383 | -0.06975 |
| SyS2894 | GCCCAACCCAACAACAACAACCAACCGCACAG | 5167 | AQPQHNNQPAQ | 14345 | PQHNNQP | 0.081218 | -0.05341 |
| GS1643 | GCCCAACTCGGCTACAACGCCCACCCGCACAG | 5168 | AQLGYNAHPAQ | 14346 | LGYNAHP | 0.080886 | -0.12719 |
| SyS2897 | GCCCAACTCAAACACCAATACGACGGCGCACAG | 5169 | AQIKHQYDGAQ | 14347 | LKHQYDG | 0.080743 | -0.13435 |
| GS1644 | GCCCAACACTACAGCCCCACCAGAGAAGCACAG | 5170 | AQHYSPTREAQ | 14348 | HYSPTRE | 0.08058 | -0.13312 |
| GS1646 | GCCCAAAGCTACAGAAGCACCAGCGACGCACAG | 5171 | AQSYRSTSDAQ | 14349 | SYRSTSD | 0.080284 | -0.106 |
| SyS2898 | GCCCAAGTTACGCCTACTGCGGCTCTTGCACAG | 5172 | AQVTPTAALAQ | 14350 | VTPTAAL | 0.080182 | -0.22926 |
| SyS2899 | GCCCAATTGGAGCAGCGGTATAGTTCTGCACAG | 5173 | AQLEQRYSSAQ | 14351 | LEQRYSS | 0.080126 | -0.21194 |
| SyS2900 | GCCCAAATGAATAATATTAGGCAGTCTGCACAG | 5174 | AQMNNIRQSAQ | 14352 | MNNIRQS | 0.080126 | -0.21194 |
| GS1647 | GCCCAAAGTAGTCGTAATGATGCTTCTGCACAG | 5175 | AQSSRNDASAQ | 14353 | SSRNDAS | 0.079783 | -0.10036 |
| SyS2902 | GCCCAAGGCACCGACAGAAAACCCTTCGCACAG | 5176 | AQGTDRKPFAQ | 14354 | GTDRKPF | 0.07975 | -0.21202 |
| SyS2903 | GCCCAAAGAGTCAACAAAGAAGACAGAGCACAG | 5177 | AQRVNKEDRAQ | 14355 | RVNKEDR | 0.079514 | -0.2231 |
| SyS2904 | GCCCAAACCGGCAGAAGCCTCGCCACCGCACAG | 5178 | AQTGRSLATAQ | 14356 | TGRSLAT | 0.079216 | -0.16466 |
| SyS2905 | GCCCAAATGAAGTCTTCGACGTCGAATGCACAG | 5179 | AQMKSSTSNAQ | 14357 | MKSSTSN | 0.07906 | -0.22557 |
| GS1651 | GCCCAAAGACACGACCTCGCCAGCAACGCACAG | 5180 | AQRHDLASNAQ | 14358 | RHDLASN | 0.078859 | -0.16909 |
| SyS2906 | GCCCAATTGATGGCGGGTGTCTACTCCGGCACAG | 5181 | AQLMAVSTPAQ | 14359 | LMAVSTP | 0.078782 | -0.09648 |
| SyS2907 | GCCCAAAGAGAGAAGGCATCTACACCCTGCACAG | 5182 | AQREGIYTLAQ | 14360 | REGIYTL | 0.078638 | -0.1783 |
| SyS2910 | GCCCAAGACAACAAAGGCAGCCTCAGCGCACAG | 5183 | AQDNKGSLSAQ | 14361 | DNKGSLS | 0.078127 | -0.14438 |
| SyS2914 | GCCCAAAAGGCCAAGTCACCCACGGCGCACAG | 5184 | AQKGQVTHGAQ | 14362 | KGQVTHG | 0.077531 | -0.22434 |
| SyS2915 | GCCCAAAGTAAGACTCTGAATAATCTTGCACAG | 5185 | AQSKTLNNLAQ | 14363 | SKTLNNL | 0.077419 | -0.06551 |
| SyS2916 | GCCCAAAGGAATCCGCAGGTTCCTACTGCACAG | 5186 | AQRNPQVPTAQ | 14364 | RNPQVPT | 0.076921 | -0.20224 |
| SS210 | GCCCAAAGTGCGAATGCGTCTAATACTGCACAG | 5187 | AQSANASNTAQ | 14365 | SANASNT | 0.076865 | -0.34975 |
| GS1654 | GCCCAAGGCTACATGAAACCCGCCATCGCACAG | 5188 | AQGYMKPAIAQ | 14366 | GYMKPAI | 0.076811 | -0.13236 |
| SyS2917 | GCCCAAAGCAGCCACCAGGCACGGCCCACCGCACAG | 5189 | AQSSHGPTPAQ | 14367 | SSHGPTP | 0.076743 | -0.15738 |
| GS1655 | GCCCAAAGCAAGCACCAGAAACCCCCCAAGCACAG | 5190 | AQSTRNPPQAQ | 14368 | STRNPPQ | 0.076738 | -0.17386 |
| GS1656 | GCCCAACTCAACAGAATCAACGAACAAGCACAG | 5191 | AQLNRINEQAQ | 14369 | LNRINEQ | 0.076662 | -0.15138 |
| SyS2918 | GCCCAAGGGCGCCGCCAAAAGCCAAAACGCACAG | 5192 | AQGAAKSQNAQ | 14370 | GAAKSQN | 0.076533 | -0.22064 |
| SyS2919 | GCCCAACTCCCCACCCTCCACGCCCCGCACAG | 5193 | AQLPTLHGPAQ | 14371 | LPTLHGP | 0.076416 | -0.16951 |

FIG. 33 (Continued)

| | | | | | | | | |
|---|---|---|---|---|---|---|---|---|
| SyS2920 | 5194 | GCCCAAGTCCCAGCACCATCAAAGGGCGCACAG | 9783 | AQVPSTIKGAQ | 14372 | VPSTIKG | 0.076072 | -0.06158 |
| GS1658 | 5195 | GCCCAAACGTCGTCTATGCGGGAGTCGGCACAG | 9784 | AQTSSMRESAQ | 14373 | TSSMRES | 0.076046 | -0.15574 |
| SyS2921 | 5196 | GCCCAACTCATGAGCAGCAACAACGCCGCACAG | 9785 | AQLMSSNNAAQ | 14374 | LMSSNNA | 0.076028 | 0.036405 |
| SyS2922 | 5197 | GCCCAAGCCAAAACCCAAAGCGCCACCGCACAG | 9786 | AQAKTQSATAQ | 14375 | AKTQSAT | 0.076006 | -0.23173 |
| SyS2923 | 5198 | GCCCAAAAGGAGGGGCAGTCTAGGTATGCACAG | 9787 | AQKEGQSRYAQ | 14376 | KEGQSRY | 0.076006 | -0.23173 |
| SyS2924 | 5199 | GCCCAAAAAGTCAACAGCAGCGGCCACCGCACAG | 9788 | AQKVNSSATAQ | 14377 | KVNSSAT | 0.075872 | -0.15657 |
| GS1659 | 5200 | GCCCAAAGAACCACCAGCCTCGTCGCCGCACAG | 9789 | AQRTTSLVAAQ | 14378 | RTTSLVA | 0.075859 | -0.16814 |
| GS1660 | 5201 | GCCCAAATGACTAATCAGAGTGCGCATGCACAG | 9790 | AQMTNQSAHAQ | 14379 | MTNQSAH | 0.075702 | -0.09086 |
| GS1661 | 5202 | GCCCAACCCCACATCAGAGGCGAAAACGCACAG | 9791 | AQPHIRGENAQ | 14380 | PHIRGEN | 0.075512 | -0.1774 |
| SyS2925 | 5203 | GCCCAAAGAACCCAAAGCAGCATCAGCGCACAG | 9792 | AQRTQSSISAQ | 14381 | RTQSSIS | 0.075407 | -0.11999 |
| SyS2927 | 5204 | GCCCAAATGTTTACGACGACGGGTGCGGCACAG | 9793 | AQMFTTGAAQ | 14382 | MFTTGA | 0.075331 | 0.191298 |
| GS1662 | 5205 | GCCCAAAGCAACATCAAACTCATGGCCGCACAG | 9794 | AQSNIKLMAAQ | 14383 | SNIKLMA | 0.075323 | -0.15001 |
| GS1663 | 5206 | GCCCAATCGACTCAGGGTACTCGGGATGCACAG | 9795 | AQSTQGTRDAQ | 14384 | STQGTRD | 0.075323 | -0.17577 |
| SyS2929 | 5207 | GCCCAAATTTTGTCGGGGCGTAATGGTGCACAG | 9796 | AQILSGRNGAQ | 14385 | ILSGRNG | 0.07519 | -0.16587 |
| GP238 | 5208 | GCCCAAGGGCTGAAGGTGTCTGGGTCTGCACAG | 9797 | AQGLKVSGSAQ | 14386 | GLKVSGS | 0.075124 | -0.0719 |
| GS1666 | 5209 | GCCCAAACCGGCGCCAACCTCCCAACGCACAG | 9798 | AQTGANLPNAQ | 14387 | TGANLPN | 0.074952 | -0.18368 |
| SyS2933 | 5210 | GCCCAATACAGCCTCAGCATGCCCAACGCACAG | 9799 | AQYSLSMPNAQ | 14388 | YSLSMPN | 0.074455 | -0.19846 |
| SyS2934 | 5211 | GCCCAAACTTTTGAGAGGAAGGCTGCGGCACAG | 9800 | AQTFERKAAAQ | 14389 | TFERKAA | 0.07445 | -0.18527 |
| GS1667 | 5212 | GCCCAACTCGGCAGAGCCAGCAGCGTCGCACAG | 9801 | AQLGRASSVAQ | 14390 | LGRASSV | 0.074286 | -0.18637 |
| SyS2936 | 5213 | GCCCAAAGAACCAAAACCAGCGACGGCGCACAG | 9802 | AQRTKTSDGAQ | 14391 | RTKTSDG | 0.074203 | -0.15738 |
| SyS2937 | 5214 | GCCCAACTCAACCCCACCTCGGCCCGCACAG | 9803 | AQLNPHLGPAQ | 14392 | LNPHLGP | 0.074203 | -0.15738 |
| SyS2938 | 5215 | GCCCAAATCATGCCCAACACAACCATGGCACAG | 9804 | AQIMPNNTMAQ | 14393 | IMPNNTM | 0.074133 | -0.1923 |
| SyS2940 | 5216 | GCCCAACATAAGAGTGATAGTGGTTATGCACAG | 9805 | AQHKSDSGYAQ | 14394 | HKSDSGY | 0.073819 | -0.10745 |
| GS1670 | 5217 | GCCCAAGGATCGGCTGAATAAGAATAGTGCACAG | 9806 | AQDRLNKNSAQ | 14395 | DRLNKNS | 0.073374 | -0.03379 |
| GS1671 | 5218 | GCCCAAATGAGCGGCGGCGGCAGCAAAGCACAG | 9807 | AQMSGGSSKAQ | 14396 | MSGGSSK | 0.073582 | -0.18547 |
| GS1673 | 5219 | GCCCAACAGCGTGAGCAGGGGAATGCTGCACAG | 9808 | AQQREQGNAAQ | 14397 | QREQGNA | 0.073506 | -0.07984 |
| SyS2941 | 5220 | GCCCAAGGTGGTGGTAATGTGACGTCGGCACAG | 9809 | AQGGGNVTSAQ | 14398 | GGGNVTS | 0.073363 | -0.11899 |
| GP239 | 5221 | GCCCAAAATCTGAAGAATGCGGTATGTTGCACAG | 9810 | AQNLKNAYVAQ | 14399 | NLKNAYV | 0.073205 | -0.06961 |
| SyS2942 | 5222 | GCCCAAAGCAAGAGCAAAAACGACAGACCCGGCGCACAG | 9811 | AQSKNDRPGAQ | 14400 | SKNDRPG | 0.073138 | -0.12344 |
| SyS2943 | 5223 | GCCCAAAGAGAGGCAGCGGCCAAGAACATCGCACAG | 9812 | AQRGSGQDIAQ | 14401 | RGSGQDI | 0.0731 | -0.15374 |
| SyS2944 | 5224 | GCCCAAGTCGGCAGCAACACCAGCTACGCACAG | 9813 | AQVGSNTSYAQ | 14402 | VGSNTSY | 0.073063 | -0.03729 |
| SyS2946 | 5225 | GCCCAAGCCCCAGAATCGGCAGCACCGCACAG | 9814 | AQSPRIGSTAQ | 14403 | SPRIGST | 0.072976 | -0.21436 |

FIG. 33 (Continued)

| | | | | | | | | |
|---|---|---|---|---|---|---|---|---|
| SyS2947 | 5226 | GCCCAAGGTACTTTGAAGGAGACTAGTGCACAG | 9815 | AQGTLKETSAQ | 14404 | GTLKETS | 0.072976 | -0.21436 |
| SyS2948 | 5227 | GCCCAAAGCATCCAAAGAACCGTCGCCGCACAG | 9816 | AQSIQRTVAAQ | 14405 | SIQRTVA | 0.072957 | -0.12829 |
| SyS2950 | 5228 | GCCCAAGAGAGGCGAAAGCAACGGCACCGCACAG | 9817 | AQRGESNGTAQ | 14406 | RGESNGT | 0.072864 | -0.13071 |
| SyS2951 | 5229 | GCCCAAGAACCCAGCAACGCCAGAGTCGCACAG | 9818 | AQEPSNARVAQ | 14407 | EPSNARV | 0.072852 | -0.21448 |
| GS1674 | 5230 | GCCCAAAGCCAAGCCACCATGAACAAAGCACAG | 9819 | AQSQATMNKAAQ | 14408 | SQATMNK | 0.072824 | -0.03657 |
| SyS2952 | 5231 | GCCCAAGCCCAAGGCACCAGCACCACCGCACAG | 9820 | AQAQGTSTTAQ | 14409 | AQGTSTT | 0.072774 | 0.021058 |
| SyS2953 | 5232 | GCCCAATACATGAGCAAAAACAACCTCGCACAG | 9821 | AQYMSKNNLAQ | 14410 | YMSKNNL | 0.072703 | -0.08453 |
| GP241 | 5233 | GCCCAAAATACGACGAATATGTCGAAGGCACAG | 9822 | AQNTTNMSKAQ | 14411 | NTTNMSK | 0.072684 | -0.06642 |
| GS1675 | 5234 | GCCCAATCGAAGGCTTCTAAGACTGAGGCACAG | 9823 | AQSKASKTEAQ | 14412 | SKASKTE | 0.072653 | -0.15764 |
| SyS2955 | 5235 | GCCCAAATGGCTGGTTCTATTGTTACTGCACAG | 9824 | AQMAGSIVTAQ | 14413 | MAGSIVT | 0.072511 | -0.22164 |
| SyS2956 | 5236 | GCCCAAGTGAATTCGAGTCAGACTCCTGCACAG | 9825 | AQVNSSQTPAQ | 14414 | VNSSQTP | 0.07248 | -0.17875 |
| SyP88 | 5237 | GCCCAAACTCGTAGTGCTTCTTCTTGATGCACAG | 9826 | AQTRSALLDAQ | 14415 | TRSALLD | 0.07245 | -0.03959 |
| SyS2958 | 5238 | GCCCAAGGGATTAGTTATTCGCCTTCTGCACAG | 9827 | AQGISYSPSAQ | 14416 | GISYSPS | 0.072408 | -0.17433 |
| SyS2959 | 5239 | GCCCAACATGGGAGGGAGGTTCCGCCAGGCACAG | 9828 | AQHGREVPQAQ | 14417 | HGREVPQ | 0.07239 | 0.073051 |
| GS1677 | 5240 | GCCCAAACCAGAAGCGCCGACAACAGAGCACAG | 9829 | AQTRSADNRAQ | 14418 | TRSADNR | 0.072342 | -0.09862 |
| SyS2962 | 5241 | GCCCAATCTGGGAATTCGTCGCGTGGTGCACAG | 9830 | AQSGNSSRGAQ | 14419 | SGNSSRG | 0.0723 | -0.20216 |
| SyS2963 | 5242 | GCCCAAACGACGAAGGGGAATCCTTCGGCACAG | 9831 | AQTTKGNPSAQ | 14420 | TTKGNPS | 0.071966 | -0.20345 |
| GS1679 | 5243 | GCCCAAGAACATGAGAAGCACCAGAGACGCACAG | 9832 | AQDMRSTRDAQ | 14421 | DMRSTRD | 0.071824 | -0.16842 |
| SyS2964 | 5244 | GCCCAACTGGGTAATTCGTTGCCGGCTGCACAG | 9833 | AQLGNSLPAAQ | 14422 | LGNSLPA | 0.071809 | -0.02082 |
| GS1680 | 5245 | GCCCAATTGACTAGTATGTCGATTCCTGCACAG | 9834 | AQLTSMSIPAQ | 14423 | LTSMSIP | 0.071702 | -0.1756 |
| SyS2967 | 5246 | GCCCAAGGCACCCACATCAAACAAGCCGCACAG | 9835 | AQGTHIKQAAQ | 14424 | GTHIKQA | 0.071536 | -0.18527 |
| GS1681 | 5247 | GCCCAAACTCAGGGTCGTATTGTTAGTGCACAG | 9836 | AQTQGRIVSAQ | 14425 | TQGRIVS | 0.071228 | -0.1296 |
| SyS2970 | 5248 | GCCCAACTCGGCGGCAACAACACCCTCGCACAG | 9837 | AQLGGNNTLAQ | 14426 | LGGNNTL | 0.071141 | -0.11838 |
| SyS2971 | 5249 | GCCCAAATGTCTGCGAATAATGGTCGTGCACAG | 9838 | AQMSANNGRAQ | 14427 | MSANNGR | 0.071102 | -0.0887 |
| GP242 | 5250 | GCCCAAGTTACTAATCCGATGAGTGCGGCACAG | 9839 | AQVTNPMSAAQ | 14428 | VTNPMSA | 0.070957 | -0.07086 |
| SyS2972 | 5251 | GCCCAAGAGGCTTATAAGTCTACGTCGGCACAG | 9840 | AQEAYKSTSAQ | 14429 | EAYKSTS | 0.070916 | -0.17193 |
| SyS2975 | 5252 | GCCCAAAGACCCAACAACCAAGGCCAAGCACAG | 9841 | AQRPNNQGQAQ | 14430 | RPNNQGQ | 0.070759 | -0.15288 |
| SyS2976 | 5253 | GCCCAAATGAATTTTGCGGGTAGTGGTGCACAG | 9842 | AQMNFAGSGAQ | 14431 | MNFAGSG | 0.07066 | -0.13071 |
| GP243 | 5254 | GCCCAAAAGACTAATCATAGTTCGTCTGCACAG | 9843 | AQKTNHSSSAQ | 14432 | KTNHSSS | 0.070635 | -0.06975 |
| SyS2977 | 5255 | GCCCAAAATGGGTATGGGTCGCAGACGGCACAG | 9844 | AQNGYGSQTAQ | 14433 | NGYGSQT | 0.070529 | -0.0094 |
| SyS2978 | 5256 | GCCCAAAAAACCGGCCACCAATTCACCGCACAG | 9845 | AQKTGHQFTAQ | 14434 | KTGHQFT | 0.070429 | -0.21818 |
| SyS2979 | 5257 | GCCCAAACCGCCAGAACCCTCCAACTCGCACAG | 9846 | AQTARTLQLAQ | 14435 | TARTLQL | 0.070336 | -0.1247 |

FIG. 33 (Continued)

| | | | | | | | |
|---|---|---|---|---|---|---|---|
| SS213 | GCCCAACAAGCCAGCACCACCAAATCGCACAG | 9847 | AQQASTTQIAQ | 14436 | QASTTQI | 0.070288 | -0.3987 |
| SyS2980 | GCCCAAACTGCTTTTGATACGCCGTGGTGCACAG | 9848 | AQTAFDTRGAQ | 14437 | TAFDTRG | 0.070216 | -0.0582 |
| SyS2981 | GCCCAAGTCAACAGCCACGTCGCCAGAGCACAG | 9849 | AQVNSHVARAQ | 14438 | VNSHVAR | 0.070107 | 0.01137 |
| SyS2983 | GCCCAAAGTCCGCTTCATTCTAATACGGCACAG | 9850 | AQSPLHSNTAQ | 14439 | SPLHSNT | 0.069894 | -0.20951 |
| SyS2984 | GCCCAACTCAGCAGAGTCACCATCAACGCACAG | 9851 | AQLSRVTINAQ | 14440 | LSRVTIN | 0.069886 | -0.1307 |
| SyS2987 | GCCCAAACTACTGCAGCATAATGTGGATTCGGCACAG | 9852 | AQTQHNVDSAQ | 14441 | TQHNVDS | 0.069682 | -0.21448 |
| SyS2988 | GCCCAAACCTTCCAAACCAGCAACAGCGCACAG | 9853 | AQTFQTSNSAQ | 14442 | TFQTSNS | 0.069368 | 0.003859 |
| SyS2989 | GCCCAAAGTAATCATGTTAGTGTTAATGCACAG | 9854 | AQSNHVSVNAQ | 14443 | SNHVSVN | 0.069358 | -0.15496 |
| SyS2990 | GCCCAAATGCTCCACAGCAGCATCACCGCACAG | 9855 | AQMLHSSITAQ | 14444 | MLHSSIT | 0.069253 | -0.2231 |
| GS1685 | GCCCAACTGAAGGCTACTGATGGGTCGGCACAG | 9856 | AQLKATDGSAQ | 14445 | LKATDGS | 0.068961 | -0.16753 |
| GS1686 | GCCCAACTCGGCAACATGCACAACATGGCACAG | 9857 | AQLGNMHNMAQ | 14446 | LGNMHNM | 0.068637 | -0.10508 |
| SyS2993 | GCCCAAATCAACAGACTCATCAGCGGCGCACAG | 9858 | AQINRLISGAQ | 14447 | INRLISG | 0.068598 | 0.031034 |
| SyS2994 | GCCCAAACCAGAAGCAACCTCGCCAGCGCACAG | 9859 | AQTRSNLASAQ | 14448 | TRSNLAS | 0.068554 | -0.15288 |
| SyS2995 | GCCCAACATTCGAATGGTGTTAGGGGGGCACAG | 9860 | AQHSNGVRGAQ | 14449 | HSNGVRG | 0.06839 | -0.09686 |
| SyS2997 | GCCCAAGCCGGCAACCCCAGAGAAAAAGCACAG | 9861 | AQAGNPREKAQ | 14450 | AGNPREK | 0.068322 | -0.12337 |
| SyS2999 | GCCCAAAGAGCCAGAGACGTCGACGAAGCACAG | 9862 | AQRARDVDEAQ | 14451 | RARDVDE | 0.067899 | -0.17678 |
| SS217 | GCCCAAGTCAGCAACGGCCCCAGCCTCGCACAG | 9863 | AQVSNGPSLAQ | 14452 | VSNGPSL | 0.067877 | -0.37204 |
| GS1687 | GCCCAAGCGAATCAGAGGGGTGTTGGGGCACAG | 9864 | AQANQRGVGAQ | 14453 | ANQRGVG | 0.067791 | -0.14599 |
| GS1688 | GCCCAAATGAGAAGCGAAACCCTCAACGCACAG | 9865 | AQMRSETLNAQ | 14454 | MRSETLN | 0.06777 | -0.171 |
| GS1689 | GCCCAAAAACCCAGCAGCCAACTCCTCGCACAG | 9866 | AQKPSSQLLAQ | 14455 | KPSSQLL | 0.067749 | -0.10538 |
| SyS3000 | GCCCAAAGCCTCAGACCCCAGCAGAGCACAG | 9867 | AQSLRPHDRAQ | 14456 | SLRPHDR | 0.067635 | -0.23376 |
| SyS3002 | GCCCAAGGTTCGAATGCTTCGAAGTATGCACAG | 9868 | AQGSNASKYAQ | 14457 | GSNASKY | 0.067496 | -0.09073 |
| GS1690 | GCCCAAACCAACAGAGACCTCGGCCCCGCACAG | 9869 | AQTNRDLGPAQ | 14458 | TNRDLGP | 0.067362 | -0.23618 |
| SyS3004 | GCCCAATGGGGTCTACTGCGGGTGCTGCACAG | 9870 | AQWGSTAGAAQ | 14459 | WGSTAGA | 0.067211 | -0.14795 |
| SyS3005 | GCCCAAATCAGCGGCGCGGCGACAGAACCGCACAG | 9871 | AQISGADRTAQ | 14460 | ISGADRT | 0.067202 | -0.06067 |
| SyS3007 | GCCCAAAGCGCCGTCAGAAGCCCATCGCACAG | 9872 | AQSAVRSPIAQ | 14461 | SAVRSPI | 0.067136 | -0.18648 |
| GS1693 | GCCCAAAGAGTCAGCCACACGAAACCGCACAG | 9873 | AQRVSHTETAQ | 14462 | RVSHTET | 0.066771 | -0.12188 |
| SyS3008 | GCCCAAAAAGCCAACAGCCAAATCACCGCACAG | 9874 | AQKANSQITAQ | 14463 | KANSQIT | 0.066615 | -0.2268 |
| SyS3009 | GCCCAACCGAGTGTGTATCGTGAGCCTGCACAG | 9875 | AQPSVYREPAQ | 14464 | PSVYREP | 0.066506 | -0.19375 |
| SyS3010 | GCCCAAACCACCAACTTCGTCACCAGCGCACAG | 9876 | AQTTNFVTSAQ | 14465 | TTNFVTS | 0.066487 | -0.196 |
| SyS3011 | GCCCAAAACCTCATGCCCACCGACAGAGCACAG | 9877 | AQNLMPTDRAQ | 14466 | NLMPTDR | 0.066443 | -0.0508 |
| GS1695 | GCCCAACCAACCACCGGCCAGCAAGCACAG | 9878 | AQTNHTGSQAQ | 14467 | TNHTGSQ | 0.066407 | -0.16304 |

FIG. 33 (Continued)

| | | | | | | | | |
|---|---|---|---|---|---|---|---|---|
| GS1696 | 5290 | GCCCAACACTGGAACGGCACCAACCCGCACAG | 9879 | AQHWNGTNPAQ | 14468 | HWNGTNP | 0.066366 | -0.10986 |
| GS1697 | 5291 | GCCCAACATAAGTCTATTGGTCAGGAGGCACAG | 9880 | AQHKSIGQEAQ | 14469 | HKSIGQE | 0.066155 | -0.17768 |
| SyS3012 | 5292 | GCCCAAACTCGGCCGATTCCGATTAGTGCACAG | 9881 | AQTRPIPISAQ | 14470 | TRPIPIS | 0.065601 | -0.18769 |
| SyS3013 | 5293 | GCCCAAAACCCGGCATGAGCAGAATGGCACAG | 9882 | AQNPGMSRMAQ | 14471 | NPGMSRM | 0.065579 | -0.20345 |
| SyS3015 | 5294 | GCCCAAATTGCTAATCGGGTGTCGCCTGCACAG | 9883 | AQIANRVSPAQ | 14472 | IANRVSP | 0.065325 | -0.21325 |
| GP244 | 5295 | GCCCAAACGGCGGTTGGCGAATCAGAAGGCACAG | 9884 | AQTALANQKAQ | 14473 | TALANQK | 0.065317 | 0.093523 |
| SyS3016 | 5296 | GCCCAAACTTCGCTTTCTTCTTCTGCTGCACAG | 9885 | AQTSLSSSAAQ | 14474 | TSLSSSA | 0.06508 | -0.17118 |
| GS1700 | 5297 | GCCCAAGCTTTGACTGGTAATATGTCGGCACAG | 9886 | AQALTGNMSAQ | 14475 | ALTGNMS | 0.064735 | -0.13712 |
| GS1701 | 5298 | GCCCAAATGCAGAGAGAAGAATGTGCCGGCACAG | 9887 | AQMQTKNVPAQ | 14476 | MQTKNVP | 0.064729 | -0.16432 |
| GP246 | 5299 | GCCCAACAGGCGACTAAGACTAATGTTGCACAG | 9888 | AQQATKTNVAQ | 14477 | QATKTNV | 0.064527 | -0.07329 |
| GS1702 | 5300 | GCCCAACTCCACACCACCAGCAGCGTGCACAG | 9889 | AQLHTTSSVAQ | 14478 | LHTTSSV | 0.064309 | -0.06184 |
| GS1703 | 5301 | GCCCAATACGTCCAAAGCAGCAGCAACGCACAG | 9890 | AQYVQSSSNAQ | 14479 | YVQSSSN | 0.064226 | -0.18368 |
| SyS3017 | 5302 | GCCCAAACGATGAAGATTCGTACTGAGGCACAG | 9891 | AQTMKIRTEAQ | 14480 | TMKIRTE | 0.063807 | -0.19133 |
| SyS3019 | 5303 | GCCCAAAAGAGTCATTCGCCTGGGTCGGCACAG | 9892 | AQKSHSPGSAQ | 14481 | KSHSPGS | 0.063552 | -0.19375 |
| GP248 | 5304 | GCCCAAAAGGCGGTGGATCCTCCGAATGCACAG | 9893 | AQKAVDPPNAQ | 14482 | KAVDPPN | 0.06345 | -0.07301 |
| SyS3021 | 5305 | GCCCAAAATGCTCCTCCTATGAGTCCTGCACAG | 9894 | AQNAPPMSPAQ | 14483 | NAPPMSP | 0.063019 | -0.21194 |
| SyS3022 | 5306 | GCCCAAATCAACAAAAATGTTCACCCCGCACAG | 9895 | AQINKMFTPAQ | 14484 | INKMFTP | 0.062922 | -0.18245 |
| GS1704 | 5307 | GCCCAATATGTCTAAGGCGACTTTGGGTGCACAG | 9896 | AQYAKATLGAQ | 14485 | YAKATLG | 0.062788 | -0.15955 |
| GS1705 | 5308 | GCCCAACATCTTGCGCGCTCCGTCTGAGGCACAG | 9897 | AQHLARPSEAQ | 14486 | HLARPSE | 0.062657 | -0.14328 |
| SyS3024 | 5309 | GCCCAACAACTCAACAGCGACAGAAACGCACAG | 9898 | AQQLNSDRNAQ | 14487 | QLNSDRN | 0.062537 | -0.17678 |
| SyS3026 | 5310 | GCCCAAATGAGGCCTGATACTAGTTATGCACAG | 9899 | AQMRPDTSYAQ | 14488 | MRPDTSY | 0.061794 | -0.07565 |
| SyS3027 | 5311 | GCCCAAGGGCGTCGCCATGAGCAGGGCGCACAG | 9900 | AQGVAMSSGAQ | 14489 | GVAMSSG | 0.061421 | -0.22187 |
| SyS3028 | 5312 | GCCCAAGGTCATTCTAGGCCTGATCGGGCACAG | 9901 | AQGHSRPDRAQ | 14490 | GHSRPDR | 0.061217 | -0.21315 |
| SyS3029 | 5313 | GCCCAAGTCTTCCAAGCCACCAGAACCGCACAG | 9902 | AQVFQATRTAQ | 14491 | VFQATRT | 0.06105 | -0.14842 |
| SyP91 | 5314 | GCCCAAACTTCGTTGACGTCGTATACTGCACAG | 9903 | AQTSLTSYTAQ | 14492 | TSLTSYT | 0.06097 | -0.04186 |
| SyS3032 | 5315 | GCCCAAAAACTCAACACCGGCGACATCGCACAG | 9904 | AQKLNTGDIAQ | 14493 | KLNTGDI | 0.06088 | -0.09377 |
| GS1708 | 5316 | GCCCAAAGAACCAACGAAACCATCGTCGCACAG | 9905 | AQRTNETIVAQ | 14494 | RTNETIV | 0.060773 | -0.10144 |
| SyS3033 | 5317 | GCCCAAAGACTCCAAAACAGCACCCCCGCACAG | 9906 | AQRLQNSTPAQ | 14495 | RLQNSTP | 0.060769 | -0.14526 |
| SyS3036 | 5318 | GCCCAAACGTGCGGCTTACTAGTGGGGCACAG | 9907 | AQTSRLTSGAQ | 14496 | TSRLTSG | 0.060537 | -0.18284 |
| SyS3037 | 5319 | GCCCAAAGCAACACCACCTTCAGCGCGCACAG | 9908 | AQSNTTFSAAQ | 14497 | SNTTFSA | 0.060537 | -0.218 |
| SyS3038 | 5320 | GCCCAAGACCAAAGAAGCAGCCGCCGCACAG | 9909 | AQDQRSSPAAQ | 14498 | DQRSSPA | 0.060474 | 0.074204 |
| GS1709 | 5321 | GCCCAAGTTGGGAGTGGTGGGTCTCGTGCACAG | 9910 | AQVGSGGSRAQ | 14499 | VGSGGSR | 0.060342 | -0.18149 |

FIG. 33 (Continued)

| | | | | | | |
|---|---|---|---|---|---|---|
| SyS3039 | 5322 | GCCCAAAGAAGCACCAACGCCCCAAGCGCACAG | 9911 | AQRSTNAPNAQ | 14500 RSTNAPN | 0.060253 | -0.18527 |
| GP249 | 5323 | GCCCAAATGGCGGGTCAGCAGCGGTTGGCACAG | 9912 | AQMAGQQRLAQ | 14501 MAGQQRL | 0.060214 | -0.07405 |
| GS1710 | 5324 | GCCCAAATTAGGAATTCTGCTCCTCTGCACAG | 9913 | AQIRNSAPPAQ | 14502 IRNSAPP | 0.060006 | -0.16753 |
| SyS3040 | 5325 | GCCCAACTGTCGACTAAGAGTTTAATGCACAG | 9914 | AQLSTKSFNAQ | 14503 LSTKSFN | 0.059895 | -0.0596 |
| GS1711 | 5326 | GCCCAATGGCGCGGGGTCGATTACTGCGGCACAG | 9915 | AQWPGSITAAQ | 14504 WPGSITA | 0.059836 | -0.1026 |
| SS224 | 5327 | GCCCAAACCGGCGGCGTCCACGCCCAAGCACAG | 9916 | AQTGGVHAQAQ | 14505 TGGVHAQ | 0.059719 | -0.36534 |
| GS1713 | 5328 | GCCCAATCTGAGAGGTCGTCTATGGCTGCACAG | 9917 | AQSERSSMAAQ | 14506 SERSSMA | 0.059554 | -0.17386 |
| SyS3042 | 5329 | GCCCAATTTCAGAATGGTCGGAATAATGCACAG | 9918 | AQFQNGRNNAQ | 14507 FQNGRNN | 0.05943 | -0.22527 |
| SyS3045 | 5330 | GCCCAAGGCGGCAGCAGACTCCCCAAGCACAG | 9919 | AQGGSRLPQAQ | 14508 GGSRLPQ | 0.059246 | 0.005703 |
| SyS3047 | 5331 | GCCCAAGGCGGCAACAGCCTCAGCGTCGCACAG | 9920 | AQGGNSLSVAQ | 14509 GGNSLSV | 0.058708 | -0.19739 |
| SyS3048 | 5332 | GCCCAATCGAAGAAGATTGATCATGGTGCACAG | 9921 | AQSKKIDHGAQ | 14510 SKKIDHG | 0.058708 | -0.19739 |
| SyS3049 | 5333 | GCCCAATATCGTGATACGTTGGCGGCTGCACAG | 9922 | AQYRDTLAAAQ | 14511 YRDTLAA | 0.05864 | -0.10104 |
| GS1715 | 5334 | GCCCAACTCCACAGCGGGCGAAAGAAACGCACAG | 9923 | AQLHSGERNAQ | 14512 LHSGERN | 0.058356 | -0.13213 |
| SyS3050 | 5335 | GCCCAAATTATGCCTCATGGTTCGCCTGCACAG | 9924 | AQIMPHGSPAQ | 14513 IMPHGSP | 0.05825 | -0.17629 |
| SyS3051 | 5336 | GCCCAAACCGCCAGAACCCTCAACATGGCACAG | 9925 | AQTARTLNMAQ | 14514 TARTLNM | 0.05825 | -0.12147 |
| SyP93 | 5337 | GCCCAAGCTAGTGTTCAGGGCATAGTGCACAG | 9926 | AQASVQGHSAQ | 14515 ASVQGHS | 0.058222 | -0.04362 |
| SyS3054 | 5338 | GCCCAATTGAATAATGCTGGGAGGGCGGCACAG | 9927 | AQLNNAGRAAQ | 14516 LNNAGRA | 0.058102 | -0.20216 |
| SyS3056 | 5339 | GCCCAAGGCCTCAGAGGCAGCCACGCGCACAG | 9928 | AQGLRGSHAAQ | 14517 GLRGSHA | 0.058027 | -0.15011 |
| SyS3057 | 5340 | GCCCAATTTGTGCGTGATTCTTATTCGGCACAG | 9929 | AQFVRDSYSAQ | 14518 FVRDSYS | 0.057988 | -0.1214 |
| GS1716 | 5341 | GCCCAAGGCAGATTCACCGGCACCGAAGCACAG | 9930 | AQGRFTGTEAQ | 14519 GRFTGTE | 0.057942 | -0.17577 |
| SP53 | 5342 | GCCCAACGTCAGAATCCGATTGAGCTTGCACAG | 9931 | AQRQNPIELAQ | 14520 RQNPIEL | 0.057876 | -0.05124 |
| SyS3058 | 5343 | GCCCAAGTCAGAGAGACAAATTCGGCACCGCACAG | 9932 | AQVRDKFGTAQ | 14521 VRDKFGT | 0.057761 | -0.15253 |
| GS1717 | 5344 | GCCCAACTCCCCAGCAACAGCAACAGAGCACAG | 9933 | AQLPSNSNRAQ | 14522 LPSNSNR | 0.057489 | -0.18547 |
| SyS3061 | 5345 | GCCCAAGTCAGACAAGAAACACACCAGCGCACAG | 9934 | AQVRQEHTSAQ | 14523 VRQEHTS | 0.057485 | -0.13639 |
| SyS3062 | 5346 | GCCCAAATCAGACTACAGCAAAGCAACACCGCACAG | 9935 | AQIRQGPTNAQ | 14524 IRQGPTN | 0.057472 | -0.22434 |
| SyS3063 | 5347 | GCCCAAGACTACAGCAAAAGCAACACCGCACAG | 9936 | AQDYSKSNTAQ | 14525 DYSKSNT | 0.057421 | -0.11995 |
| SyS3064 | 5348 | GCCCAAATGTCGAATGTTAATGTTTCGGCACAG | 9937 | AQMSNVNVSAQ | 14526 MSNVNVS | 0.057014 | -0.22891 |
| SyS3066 | 5349 | GCCCAAATGAGCAGCGGCAGAAGCCTCGCACAG | 9938 | AQMSSGRSLAQ | 14527 MSSGRSL | 0.056536 | -0.21194 |
| SyS3067 | 5350 | GCCCAAGGCCTCAGAGACATCAGAGCGCACAG | 9939 | AQGLRDIRAAQ | 14528 GLRDIRA | 0.056134 | -0.21436 |
| SyS3068 | 5351 | GCCCAACTGATTTCTGCTCATAAGGGTGCACAG | 9940 | AQLISAHKGAQ | 14529 LISAHKG | 0.056125 | -0.18984 |
| SyS3069 | 5352 | GCCCAACCCATCAACACCACCGCGCCGCACAG | 9941 | AQPINTHAAAQ | 14530 PINTHAA | 0.055919 | -0.03722 |
| SyS3070 | 5353 | GCCCAAATGCCTCATGTGGGGAATGCTGCACAG | 9942 | AQMPHVGNAAQ | 14531 MPHVGNA | 0.055761 | -0.196 |

FIG. 33 (Continued)

| | | | | | | | |
|---|---|---|---|---|---|---|---|
| SyS3071 | 5354 | GCCCAATATGGTTCTTCTGCGATTAATGCACAG | 9943 | AQYGSSAINAQ | 14532 | YGSSAIN | 0.055471 | -0.22557 |
| SyS3073 | 5355 | GCCCAACATGCTTCTATGCCTAGTTCTGCACAG | 9944 | AQHASMPSSAQ | 14533 | HASMPSS | 0.055168 | -0.08783 |
| SyS3074 | 5356 | GCCCAATTTGGGGAGAATGCTCGTTTGCACAG | 9945 | AQFGENARFAQ | 14534 | FGENARF | 0.055162 | -0.131 |
| SyS3076 | 5357 | GCCCAATCTAGGCATGATTTGCCTTCTGCACAG | 9946 | AQSRHDLPSAQ | 14535 | SRHDLPS | 0.055032 | -0.20224 |
| SyS3077 | 5358 | GCCCAACGGTCGCAGGGTGCGAATATGGCACAG | 9947 | AQRSQGANMAQ | 14536 | RSQGANM | 0.054873 | -0.14214 |
| SyS3078 | 5359 | GCCCAAGCCAACAGCAACAGCCACAGCGCACAG | 9948 | AQANSNSHSAQ | 14537 | ANSNSHS | 0.054709 | 0.06627 |
| GP255 | 5360 | GCCCAACAGGCTAGGCAGAATCAGGGTGCACAG | 9949 | AQQARQNQGAQ | 14538 | QARQNQG | 0.054577 | -0.06905 |
| GS1723 | 5361 | GCCCAAGGTGTGGCTAGTAATACGACGGCACAG | 9950 | AQGVASNTTAQ | 14539 | GVASNTT | 0.054331 | -0.12484 |
| GS1724 | 5362 | GCCCAAAAGTATAGTTCTTCTCAGAGTGCACAG | 9951 | AQKYSSSQSAQ | 14540 | KYSSSQS | 0.054225 | -0.16528 |
| SyS3081 | 5363 | GCCCAAAGCGCCAAAACCCTCAACACCGCACAG | 9952 | AQSAKTLNTAQ | 14541 | SAKTLNT | 0.054008 | -0.06036 |
| SyS3082 | 5364 | GCCCAAGGCATCAGAACCAACGCCGCACAG | 9953 | AQGIRTTNAAQ | 14542 | GIRTTNA | 0.053754 | -0.12222 |
| GP257 | 5365 | GCCCAAATGAATACGACGATTAATAGGGCACAG | 9954 | AQMNTTINRAQ | 14543 | MNTTINR | 0.053729 | -0.06843 |
| SyS3083 | 5366 | GCCCAACTCAAAAACACCAGCCTCCCGCACAG | 9955 | AQLKNTSLPAQ | 14544 | LKNTSLP | 0.053711 | -0.19254 |
| GS1725 | 5367 | GCCCAAACTAATCGTGCTGCTACGATGGCACAG | 9956 | AQTNRAATMAQ | 14545 | TNRAATM | 0.053552 | -0.07849 |
| SyS3084 | 5368 | GCCCAACACGGCTACCCAAGTCCCGCACAG | 9957 | AQHGYPNVPAQ | 14546 | HGYPNVP | 0.053161 | -0.20955 |
| SyS3085 | 5369 | GCCCAATGGGGCTACAGAGGCGCCGAAGCACAG | 9958 | AQWGYRGAEAQ | 14547 | WGYRGAE | 0.053019 | -0.20683 |
| SyS3086 | 5370 | GCCCAACTCCTCGTCACCAACACCAGCGCACAG | 9959 | AQLLVTNTSAQ | 14548 | LLVTNTS | 0.052911 | -0.20586 |
| SP54 | 5371 | GCCCAAAAGAATCGTCTTCCTCCTGATGCACAG | 9960 | AQKNRLPPDAQ | 14549 | KNRLPPD | 0.052816 | -0.05331 |
| GP259 | 5372 | GCCCAATATCGTTCGCAGGAGCATCCGGCACAG | 9961 | AQYRSQEHPAQ | 14550 | YRSQEHP | 0.052745 | -0.07356 |
| GS1728 | 5373 | GCCCAACACGGCGGGCAGAGTCAGCCCGCACAG | 9962 | AQHGGRVSPAQ | 14551 | HGGRVSP | 0.052674 | -0.08274 |
| SP55 | 5374 | GCCCAAGGCAGAATAGGCTTGCTTCGGCACAG | 9963 | AQGQNRLASAQ | 14552 | GQNRLAS | 0.052585 | -0.05282 |
| GS1729 | 5375 | GCCCAACAGTCGGTTTCTGCTACGAGGGCACAG | 9964 | AQQSVSATRAQ | 14553 | QSVSATR | 0.052569 | -0.11912 |
| GS1730 | 5376 | GCCCAACAACAAGACCCATCCCCAAGCCGCACAG | 9965 | AQQRPIPQAAQ | 14554 | QRPIPQA | 0.052511 | -0.09282 |
| GP260 | 5377 | GCCCAACAGAGAGGGCGGATTGGTATTGGAGGCACAG | 9966 | AQQRAIGIEAQ | 14555 | QRAIGIE | 0.052081 | -0.06454 |
| GS1731 | 5378 | GCCCAATTTGGGCCATGTGGTGGTATTAATGCACAG | 9967 | AQFGHVGINAQ | 14556 | FGHVGIN | 0.052078 | -0.15412 |
| SyS3088 | 5379 | GCCCAATTTGAGCATGTTCGTTCGGAGGCACAG | 9968 | AQFEHVRSEAQ | 14557 | FEHVRSE | 0.051845 | -0.23618 |
| SyS3089 | 5380 | GCCCAAAAAGCGTCACCAGCAACACCGCACAG | 9969 | AQKSVTSNTAQ | 14558 | KSVTSNT | 0.051777 | -0.061 |
| SyS3090 | 5381 | GCCCAACTCACCGGCAACGTCACCGCCGCACAG | 9970 | AQLTGNVTAAQ | 14559 | LTGNVTA | 0.051576 | -0.21448 |
| GS1732 | 5382 | GCCCAAAATCATGCGCAGGGTAAGAGTGTTGCACAG | 9971 | AQNHAYPSAAQ | 14560 | NHAYPSA | 0.051489 | -0.16034 |
| SyS3091 | 5383 | GCCCAAATGCCGCAGGGTAAGAGTGTTGCACAG | 9972 | AQMPQGKSVAQ | 14561 | MPQGKSV | 0.051435 | -0.18163 |
| SyS3092 | 5384 | GCCCAACTCAGAACCGCCGCCACCAGCGCACAG | 9973 | AQLRTAATSAQ | 14562 | LRTAATS | 0.051386 | -0.23012 |
| SyS3095 | 5385 | GCCCAAGATTCTCAGCATCGGGTTTCTGCACAG | 9974 | AQDSQHRVSAQ | 14563 | DSQHRVS | 0.05101 | -0.15253 |

FIG. 33 (Continued)

| | | | | | | | | |
|---|---|---|---|---|---|---|---|---|
| SyS3096 | 5386 | GCCCAATTCCTCAACGAACACACCGTGCACAG | 9975 | AQFLNEHTVAQ | 14564 | FLNEHTV | 0.050937 | -0.10186 |
| SyS3098 | 5387 | GCCCAAAACAGCACCGGCACCAGCATGGCACAG | 9976 | AQNSTGTSMAQ | 14565 | NSTGTSM | 0.050651 | -0.03019 |
| SyP98 | 5388 | GCCCAACACATAGTCCTCCTATGTCGGCGGCACAG | 9977 | AQHSPPMSAAQ | 14566 | HSPPMSA | 0.05057 | -0.0435 |
| SyS3099 | 5389 | GCCCAATTGATGTCGCAGCGTCCTACGGCACAG | 9978 | AQLMSQRPTAQ | 14567 | LMSQRPT | 0.050441 | -0.22649 |
| SyS3100 | 5390 | GCCCAAAACACCAACGTCAACCCCCGCACAG | 9979 | AQNTNVNPPAQ | 14568 | NTNVNPP | 0.050347 | -0.18042 |
| SyS3104 | 5391 | GCCCAATGGGGTGGTTATTCTTCGGGTGCACAG | 9980 | AQWGGYSSAAQ | 14569 | WGGYSSA | 0.050081 | -0.2231 |
| GS1733 | 5392 | GCCCAATACAGCCTCAACCCAGCGGCGGCACAG | 9981 | AQYSLNPSGAQ | 14570 | YSLNPSG | 0.050057 | -0.05463 |
| GS1734 | 5393 | GCCCAAAAGAAAGCAAAGACAAGAGAGTCGCACAG | 9982 | AQKESKDRVAQ | 14571 | KESKDRV | 0.050049 | -0.18054 |
| SyS3105 | 5394 | GCCCAAAAGCTGGTGTGCAGTCCTGATGCACAG | 9983 | AQKLVSSPDAQ | 14572 | KLVSSPD | 0.049827 | -0.16829 |
| SyS3106 | 5395 | GCCCAAAACACCGCCAGCCACAACGCCGCACAG | 9984 | AQNTASHNAAQ | 14573 | NTASHNA | 0.049827 | -0.16829 |
| SyS3107 | 5396 | GCCCAAGACATGAGCAACAAAACCTACGCACAG | 9985 | AQDMSNKTYAQ | 14574 | DMSNKTY | 0.049793 | -0.19133 |
| SyS3108 | 5397 | GCCCAACTCGTCCACAAAGACTTCCCGCACAG | 9986 | AQLVHKDFPAQ | 14575 | LVHKDFP | 0.049712 | -0.21571 |
| SyS3109 | 5398 | GCCCAAAAACCGCCCTCGCCCAAAACGCACAG | 9987 | AQKPALAQNAQ | 14576 | KPALAQN | 0.049542 | -0.23296 |
| GS1735 | 5399 | GCCCAAGGCAACGCGCCAACCAGCAAAGCACAG | 9988 | AQGNAQPSKAQ | 14577 | GNAQPSK | 0.049521 | -0.09141 |
| SyS3110 | 5400 | GCCCAAAGAGTCGCCCACACCGAAAACGCACAG | 9989 | AQRVAHTENAQ | 14578 | RVAHTEN | 0.049496 | -0.10715 |
| SyS3111 | 5401 | GCCCAAGTTTCTGCGTCTTTATGGGGGCACAG | 9990 | AQVSASFMAAQ | 14579 | VSASFMA | 0.049437 | -0.02125 |
| SyS3112 | 5402 | GCCCAACGGGGTGCTGACGGCTGATGCTGCACAG | 9991 | AQRVLTADAAQ | 14580 | RVLTADA | 0.049329 | -0.08038 |
| GS1737 | 5403 | GCCCAACCGTCGTCGGCCACAAACAAGCACAG | 9992 | AQTVVGTKQAQ | 14581 | TVVGTKQ | 0.049239 | -0.16241 |
| SyS3113 | 5404 | GCCCAACTTGCGAGGACGCAGCCTTCTGCACAG | 9993 | AQLARTQPSAQ | 14582 | LARTQPS | 0.049237 | -0.21679 |
| GS1738 | 5405 | GCCCAAATGTCAGTAGTCATTCTGCTGCACAG | 9994 | AQMSSSHSAAQ | 14583 | MSSSHSA | 0.049163 | -0.17768 |
| GP261 | 5406 | GCCCAACCGTCTTCGAAGTCTCCGTCGGCACAG | 9995 | AQPSSKSPSAQ | 14584 | PSSKSPS | 0.049142 | -0.0728 |
| GP262 | 5407 | GCCCAATATTCTGGTGCGATGTCGGTGGCACAG | 9996 | AQYSGAMSVAQ | 14585 | YSGAMSV | 0.049076 | -0.06114 |
| SyS3114 | 5408 | GCCCAACCGCCGCCTACGAAGTCGTATGCACAG | 9997 | AQPPPTKSYAQ | 14586 | PPPTKSY | 0.048985 | -0.00892 |
| SyP100 | 5409 | GCCCAATCTGCGCGCATGCTACGACGGCACAG | 9998 | AQSAPHATTAQ | 14587 | SAPHATT | 0.048581 | -0.04347 |
| SyS3116 | 5410 | GCCCAAGCTTCTAAGCCTATGGTTGCTGCACAG | 9999 | AQASKPMVAAQ | 14588 | ASKPMVA | 0.04844 | -0.2277 |
| SyS3117 | 5411 | GCCCAAACCCTCACCTACGGCGACAGAGCACAG | 10000 | AQTLTYGDRAQ | 14589 | TLTYGDR | 0.048421 | -0.20709 |
| SyS3118 | 5412 | GCCCAAGCCAGAAGCGACAGCAAAGACGCACAG | 10001 | AQARSDSKDAQ | 14590 | ARSDSKD | 0.048221 | -0.17505 |
| SyS3119 | 5413 | GCCCAAATGAGCAAAGCCGCCAGCCTCGCACAG | 10002 | AQMSKAASLAQ | 14591 | MSKAASL | 0.047752 | -0.19496 |
| SyS3121 | 5414 | GCCCAAAGCACCCACACCAGCGCCGTCGCACAG | 10003 | AQSTHTSAVAQ | 14592 | STHTSAV | 0.047188 | -0.1233 |
| GS1742 | 5415 | GCCCAAACTGCTCGTCTTCAGGATGGTGCACAG | 10004 | AQTARLQDGAQ | 14593 | TARLQDG | 0.047164 | -0.13739 |
| SyS3122 | 5416 | GCCCAAAGAACCCGTCCTCGGCCAACCCGCACAG | 10005 | AQRPVLGQPAQ | 14594 | RPVLGQP | 0.047021 | -0.22649 |
| SyS3123 | 5417 | GCCCAAGCCAGCTTCAAAACCGAAGTCGCACAG | 10006 | AQASFKTEVAQ | 14595 | ASFKTEV | 0.046975 | -0.08471 |

FIG. 33 (Continued)

| | | | | | | | | |
|---|---|---|---|---|---|---|---|---|
| GS1743 | 5418 | GCCCAAGTCACCAGAACCGTCAACGCCGCACAG | 10007 | AQVTRTVNAAQ | 14596 | VTRTVNA | 0.046915 | -0.16663 |
| SyS3125 | 5419 | GCCCAAGACCACGCCAGAAGCGGCGGCGCACAG | 10008 | AQDHARSGGAQ | 14597 | DHARSGG | 0.046836 | -0.21571 |
| GS1744 | 5420 | GCCCAAGACGACGCATTTGACGCGGTGAGTGCACAG | 10009 | AQTTHLTVSAQ | 14598 | TTHLTVS | 0.046543 | -0.10586 |
| SyS3126 | 5421 | GCCCAAGTCCCAAAAGCAACGGCACCGCACAG | 10010 | AQVPKSNGTAQ | 14599 | VPKSNGT | 0.046485 | -0.16708 |
| SyS3127 | 5422 | GCCCAAGACTCGGCGTCGGCCCGAAGCACAG | 10011 | AQRLGVGPEAQ | 14600 | RLGVGPE | 0.046192 | -0.17557 |
| SyS3128 | 5423 | GCCCAAAACAACAGACAAACCAGCGACGACGCACAG | 10012 | AQNNRQTSDAQ | 14601 | NNRQTSD | 0.046184 | -0.14302 |
| SyS3129 | 5424 | GCCCAAAGATTCACCAACAACAAGAAGCCGCACAG | 10013 | AQRFTNNEAAQ | 14602 | RFTNNEA | 0.045922 | 0.054373 |
| SyS3131 | 5425 | GCCCAAAGTTCGCATCAGATGCGGGGGGCACAG | 10014 | AQSSHQMRGAQ | 14603 | SSHQMRG | 0.045403 | -0.18648 |
| GS1745 | 5426 | GCCCAAACTACGATGGGGACGATGTTGGCACAG | 10015 | AQTTMGTMLAQ | 14604 | TTMGTML | 0.044961 | -0.14435 |
| SyS3133 | 5427 | GCCCAAACCAACGGCGGCGTCCCCATCGCACAG | 10016 | AQTNGGVPIAQ | 14605 | TNGGVPI | 0.04489 | -0.09496 |
| SyS3135 | 5428 | GCCCAAAAAAGCAACGAAGGCAACGGCGGCACAG | 10017 | AQKSNEGNGAQ | 14606 | KSNEGNG | 0.044718 | -0.06873 |
| SyS3137 | 5429 | GCCCAAAACGTCGCCATGACCACCCTCGCACAG | 10018 | AQNVAMTTLAQ | 14607 | NVAMTTL | 0.044662 | 0.069739 |
| SyS3138 | 5430 | GCCCAATACAGCGGCCACACCCCCATGGCACAG | 10019 | AQYSGHTPMAQ | 14608 | YSGHTPM | 0.044417 | 0.00379 |
| GP266 | 5431 | GCCCAAGGTACTCCGAATCGGGGCTGGCACAG | 10020 | AQGTPNRALAQ | 14609 | GTPNRAL | 0.0441 | -0.06683 |
| SyS3141 | 5432 | GCCCAAAGAAGCGGCCCACCCACCCGCCACAG | 10021 | AQRSGPTQPAQ | 14610 | RSGPTQP | 0.043925 | -0.19375 |
| SyS3142 | 5433 | GCCCAAATCTTCAACCTCAAACAAGACGCACAG | 10022 | AQIFNLKQDAQ | 14611 | IFNLKQD | 0.043579 | -0.0447 |
| SyS3143 | 5434 | GCCCAACACGCCATGAGCCTCAGCCCGCACAG | 10023 | AQHAMSLSPAQ | 14612 | HAMSLSP | 0.04335 | -0.14871 |
| SyS3144 | 5435 | GCCCAAGGCGAAAGCATGCTCAGAGAAGCACAG | 10024 | AQSESMLREAQ | 14613 | SESMLRE | 0.043343 | 0.006658 |
| SyS3146 | 5436 | GCCCAACTCCCCAGACCCCCCAAGCCGCACAG | 10025 | AQLPRPPQAAQ | 14614 | LPRPPQA | 0.043059 | -0.22187 |
| GP268 | 5437 | GCCCAACTTGGTCTTGGGGCTTTGTCTGCACAG | 10026 | AQLGLGALSAQ | 14615 | LGLGALS | 0.042709 | -0.07245 |
| SyS3148 | 5438 | GCCCAAATTCCTAAGTCGGCGGATATTGCACAG | 10027 | AQIPKSADIAQ | 14616 | IPKSADI | 0.042447 | -0.09151 |
| SyS3150 | 5439 | GCCCAAGCTCAGTCGTTGCGTACTATGGCACAG | 10028 | AQAQSLRTMAQ | 14617 | AQSLRTM | 0.042077 | -0.19113 |
| SyP103 | 5440 | GCCCAAATGCTTACTAGTTCGTTGGATGCACAG | 10029 | AQMLTSSLDAQ | 14618 | MLTSSLD | 0.041856 | -0.03909 |
| SyS3151 | 5441 | GCCCAAATCTACAGAGACAACGAAAGAGCACAG | 10030 | AQIYRDNERAQ | 14619 | IYRDNER | 0.041758 | -0.20345 |
| SyS3155 | 5442 | GCCCAAAGCCCCCCACCATGCCGCCGCACAG | 10031 | AQSPPTMPAAQ | 14620 | SPPTMPA | 0.041298 | -0.18769 |
| SyS3156 | 5443 | GCCCAACCTATGAGGAGTGGTACGCCTGCACAG | 10032 | AQPMRSGTPAQ | 14621 | PMRSGTP | 0.041276 | -0.10941 |
| GS1750 | 5444 | GCCCAACTCCTCAGCAAAAGCAGCGAAGCACAG | 10033 | AQLLSKSSEAQ | 14622 | LLSKSSE | 0.041269 | 0.009441 |
| SyS3157 | 5445 | GCCCAAACCGCCAACTTCCAAGAAAGAGCACAG | 10034 | AQTANFQERAQ | 14623 | TANFQER | 0.041022 | -0.22406 |
| GS1751 | 5446 | GCCCAAAGCGGCAACAGACACCCGTCACCGCACAG | 10035 | AQSGNRPVTAQ | 14624 | SGNRPVT | 0.040905 | -0.17381 |
| SyS3158 | 5447 | GCCCAACTGAATCAGGTTGATAGTCGTGCACAG | 10036 | AQLNQVDSRAQ | 14625 | LNQVDSR | 0.040817 | -0.14836 |
| SyS3159 | 5448 | GCCCAAATTACGCCGAGTTCTAGTAAGGCACAG | 10037 | AQITPSSSKAQ | 14626 | ITPSSSK | 0.040646 | -0.20224 |
| SyS3160 | 5449 | GCCCAAGATGTTTCGCTTACTAAGGCGGCACAG | 10038 | AQDVSLTKAAQ | 14627 | DVSLTKA | 0.040618 | -0.17351 |

FIG. 33 (Continued)

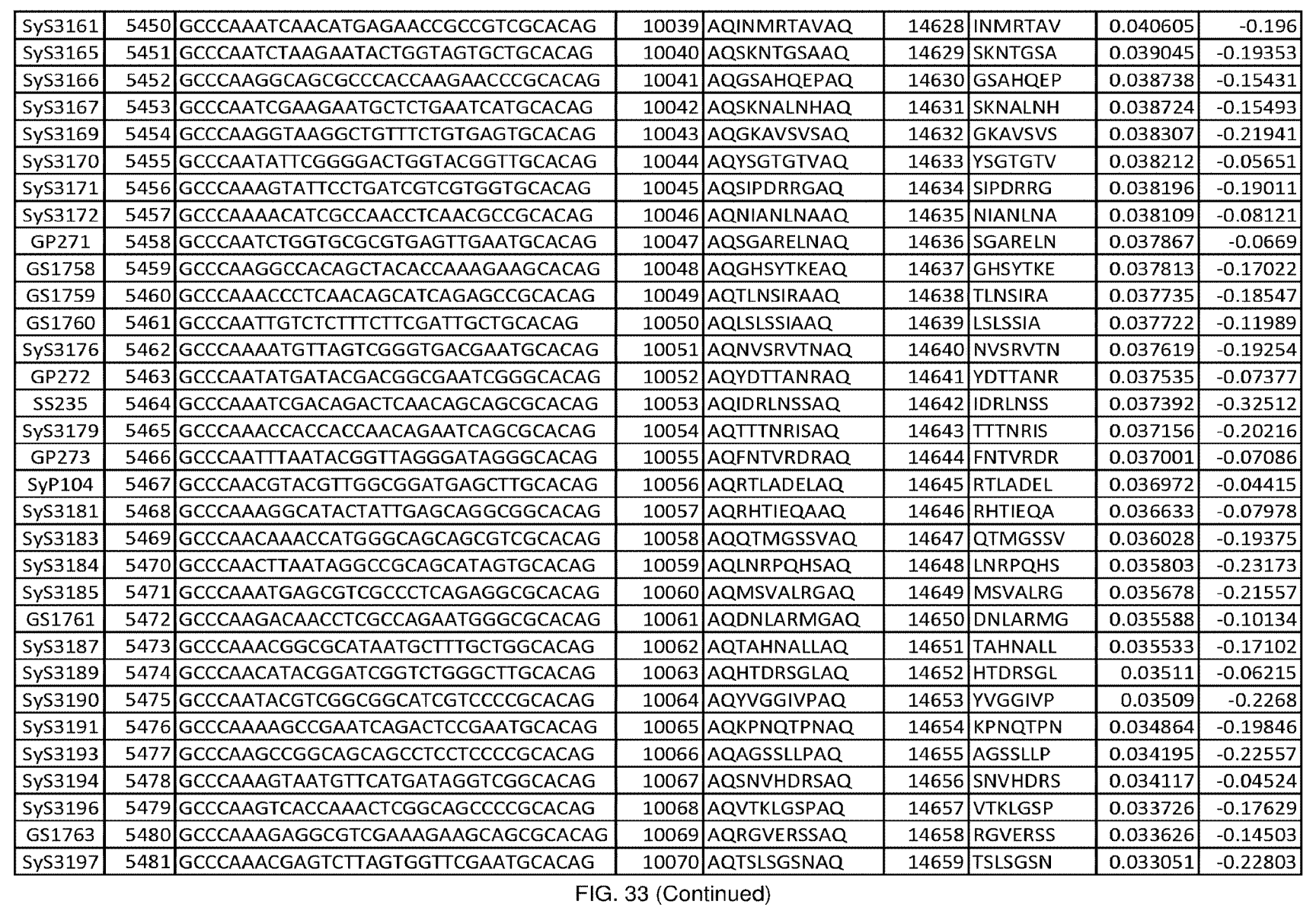

| | | | | | | | | |
|---|---|---|---|---|---|---|---|---|
| SyS3161 | 5450 | GCCCAAATCAACACATGAGAACCGCCGTCGCACAG | 10039 | AQINMRTAVAQ | 14628 | INMRTAV | 0.040605 | -0.196 |
| SyS3165 | 5451 | GCCCAATCTAAGAATACTGGTAGTGCTGCACAG | 10040 | AQSKNTGSAAQ | 14629 | SKNTGSA | 0.039045 | -0.19353 |
| SyS3166 | 5452 | GCCCAAGGCAGCGCCCACCAAGAACCGCACAG | 10041 | AQGSAHQEPAQ | 14630 | GSAHQEP | 0.038738 | -0.15431 |
| SyS3167 | 5453 | GCCCAATCGAAGAATGCTCTGAATCATGCACAG | 10042 | AQSKNALNHAQ | 14631 | SKNALNH | 0.038724 | -0.15493 |
| SyS3169 | 5454 | GCCCAAGGTAAGGCTGTTTCTGTGAGTGCACAG | 10043 | AQGKAVSVSAQ | 14632 | GKAVSVS | 0.038307 | -0.21941 |
| SyS3170 | 5455 | GCCCAATATTCGGGGACTGGTACGGTTGCACAG | 10044 | AQYSGTGTVAQ | 14633 | YSGTGTV | 0.038212 | -0.05651 |
| SyS3171 | 5456 | GCCCAAAGTATTCCTGATCGTCGTGGTGCACAG | 10045 | AQSIPDRRGAQ | 14634 | SIPDRRG | 0.038196 | -0.19011 |
| SyS3172 | 5457 | GCCCAAAACATCGCCAACCTCAACGCCGCACAG | 10046 | AQNIANLNAAQ | 14635 | NIANLNA | 0.038109 | -0.08121 |
| GP271 | 5458 | GCCCAATCTGGTGCGGTGAGTTGAATGCACAG | 10047 | AQSGARELNAQ | 14636 | SGARELN | 0.037867 | -0.0669 |
| GS1758 | 5459 | GCCCAAGGCCACAGCTACACCAAGAAGCACAG | 10048 | AQGHSYTKEAQ | 14637 | GHSYTKE | 0.037813 | -0.17022 |
| GS1759 | 5460 | GCCCAAACCCTCAACAGCATCAGAGCCGCACAG | 10049 | AQTLNSIRAAQ | 14638 | TLNSIRA | 0.037735 | -0.18547 |
| GS1760 | 5461 | GCCCAATTGTCTCTTCTTCGATTGCTGCACAG | 10050 | AQLSLSSIAAQ | 14639 | LSLSSIA | 0.037722 | -0.11989 |
| SyS3176 | 5462 | GCCCAAAATGTTAGTCGGGTGACGAATGCACAG | 10051 | AQNVSRVTNAQ | 14640 | NVSRVTN | 0.037619 | -0.19254 |
| GP272 | 5463 | GCCCAATATGATACGGACAGGCGAATCGGGCACAG | 10052 | AQYDTTANRAQ | 14641 | YDTTANR | 0.037535 | -0.07377 |
| SS235 | 5464 | GCCCAAATCGACAGACTCAACAGCAGCGCACAG | 10053 | AQIDRLNSSAQ | 14642 | IDRLNSS | 0.037392 | -0.32512 |
| SyS3179 | 5465 | GCCCAAACCACCACCAACAGAATCAGCGCACAG | 10054 | AQTTTNRISAQ | 14643 | TTTNRIS | 0.037156 | -0.20216 |
| GP273 | 5466 | GCCCAATTTAATACGGTTAGGGATAGGGCACAG | 10055 | AQFNTVRDRAQ | 14644 | FNTVRDR | 0.037001 | -0.07086 |
| SyP104 | 5467 | GCCCAACGTACGTTGGCGGATGAGCTTGCACAG | 10056 | AQRTLADELAQ | 14645 | RTLADEL | 0.036972 | -0.04415 |
| SyS3181 | 5468 | GCCCAAAGGCATACTATTGAGCAGGCGGCACAG | 10057 | AQRHTIEQAAQ | 14646 | RHTIEQA | 0.036633 | -0.07978 |
| SyS3183 | 5469 | GCCCAACAAACCATGGGCAGCAGCGTCGCACAG | 10058 | AQQTMGSSVAQ | 14647 | QTMGSSV | 0.036028 | -0.19375 |
| SyS3184 | 5470 | GCCCAACTTAATAGGCCGCAGCATAGTGCACAG | 10059 | AQINRPQHSAQ | 14648 | LNRPQHS | 0.035803 | -0.23173 |
| SyS3185 | 5471 | GCCCAAATGAGCGTCGCCCTCAGAGGCGCACAG | 10060 | AQMSVALRGAQ | 14649 | MSVALRG | 0.035678 | -0.21557 |
| GS1761 | 5472 | GCCCAAGACAACCTCGCCAGAATGGGCGCACAG | 10061 | AQDNLARMGAQ | 14650 | DNLARMG | 0.035588 | -0.10134 |
| SyS3187 | 5473 | GCCCAAACGGCGCATAATGCTTTGCTGGCACAG | 10062 | AQTAHNALLAQ | 14651 | TAHNALL | 0.035533 | -0.17102 |
| SyS3189 | 5474 | GCCCAACAACATACGGATCGGCGGCATCGCACAG | 10063 | AQHTDRSGLAQ | 14652 | HTDRSGL | 0.03511 | -0.06215 |
| SyS3190 | 5475 | GCCCAATACGTCGGGCGGCATCGTCCCGCACAG | 10064 | AQYVGGIVPAQ | 14653 | YVGGIVP | 0.03509 | -0.2268 |
| SyS3191 | 5476 | GCCCAAAAGCCGAATCAGACTCCGAATGCACAG | 10065 | AQKPNQTPNAQ | 14654 | KPNQTPN | 0.034864 | -0.19846 |
| SyS3193 | 5477 | GCCCAAGCCGGCAGCAGCCTCCTCCCCGCACAG | 10066 | AQAGSSLLPAQ | 14655 | AGSSLLP | 0.034195 | -0.22557 |
| SyS3194 | 5478 | GCCCAAAGTAATGTTCATGATAGGTCGGCACAG | 10067 | AQSNVHDRSAQ | 14656 | SNVHDRS | 0.034117 | -0.04524 |
| SyS3196 | 5479 | GCCCAAAGTCACCAAACTCGGCAGCCCGCACAG | 10068 | AQVTKLGSPAQ | 14657 | VTKLGSP | 0.033726 | -0.17629 |
| GS1763 | 5480 | GCCCAAAGAGGGCGTCGAAAGAAGCAGCGCACAG | 10069 | AQRGVERSSAQ | 14658 | RGVERSS | 0.033626 | -0.14503 |
| SyS3197 | 5481 | GCCCAAAACGAGTCTTAGTGGTTCGAATGCACAG | 10070 | AQTSLSGSNAQ | 14659 | TSLSGSN | 0.033051 | -0.22803 |

FIG. 33 (Continued)

| | | | | | | | |
|---|---|---|---|---|---|---|---|
| SyS3198 | 5482 | GCCCAACTCAGCCTCAGCACCAACAACGCACAG | 10071 | AQLSLSTNNAQ | 14660 | LSLSTNN | 0.03277 | -0.20588 |
| GS1766 | 5483 | GCCCAACTCGGCCAAATCACCAGACCGCACAG | 10072 | AQLGQITRPAQ | 14661 | LGQITRP | 0.032735 | -0.13666 |
| SyS3199 | 5484 | GCCCAAAATGCGTCTCCTGGGAGTAGTGCACAG | 10073 | AQNASPGSSAQ | 14662 | NASPGSS | 0.032455 | -0.15335 |
| SyS3200 | 5485 | GCCCAAATGAAGGCGAATAGTCTTTCGGCACAG | 10074 | AQMKANSLSAQ | 14663 | MKANSLS | 0.032347 | -0.16951 |
| SyS3201 | 5486 | GCCCAACATAAGGGGATGGCGAATTCGGCACAG | 10075 | AQHKGMANSAQ | 14664 | HKGMANS | 0.032108 | -0.14425 |
| GS1769 | 5487 | GCCCAAGGCAGAAACAACTACCCGACGCACAG | 10076 | AQGRNNYPDAQ | 14665 | GRNNYPD | 0.031842 | -0.09188 |
| SyS3204 | 5488 | GCCCAACTCCCGACCAAAAATGGCAAGCACAG | 10077 | AQLPDQKWQAQ | 14666 | LPDQKWQ | 0.031415 | -0.21325 |
| SyS3206 | 5489 | GCCCAAGGCGTCAACAACAGAGGCAGCGCACAG | 10078 | AQGVNNRGSAQ | 14667 | GVNNRGS | 0.0313 | 0.063353 |
| GS1771 | 5490 | GCCCAAAACAGAAATCGGCATGCAACCGCACAG | 10079 | AQNRIGMQPAQ | 14668 | NRIGMQP | 0.031094 | -0.07541 |
| SyS3208 | 5491 | GCCCAAGAGAAGGTGCCGAGTCTGAATGCACAG | 10080 | AQEKVPSLNAQ | 14669 | EKVPSLN | 0.031014 | -0.23012 |
| GS1772 | 5492 | GCCCAAGGCAGAGACAGCAGCAACCCGCACAG | 10081 | AQGRDSSNPAQ | 14670 | GRDSSNP | 0.030896 | -0.10468 |
| SyS3209 | 5493 | GCCCAAACGGCAGACCCAACCTCATGGCACAG | 10082 | AQTGRPNLMAQ | 14671 | TGRPNLM | 0.030687 | -0.22649 |
| SyS3212 | 5494 | GCCCAAGTGCGCGGCAGAAGCCCATGCACAG | 10083 | AQVAGRSPMAQ | 14672 | VAGRSPM | 0.030511 | -0.16344 |
| SyS3213 | 5495 | GCCCAACTCCCCACGTCAGCGTCCCGCACAG | 10084 | AQLPHVSVPAQ | 14673 | LPHVSVP | 0.030241 | -0.19618 |
| SyS3214 | 5496 | GCCCAACTCAGAACCGGCAGCTTCGCCGCACAG | 10085 | AQLRTGSFAAQ | 14674 | LRTGSFA | 0.029936 | -0.16587 |
| SyS3216 | 5497 | GCCCAAGGCGGGTGTTTCTAGTGGGAGTGCACAG | 10086 | AQAGVSSGSAQ | 14675 | AGVSSGS | 0.029244 | -0.14892 |
| GS1773 | 5498 | GCCCAATGGAGAGACAGCGGCCACGGCGCACAG | 10087 | AQWRDSGHGAQ | 14676 | WRDSGHG | 0.029219 | -0.16663 |
| SyS3217 | 5499 | GCCCAAAGCTTCGGCAACGACCGTCGCACAG | 10088 | AQSFGNRPVAQ | 14677 | SFGNRPV | 0.029098 | -0.20093 |
| SyS3218 | 5500 | GCCCAAAAAGTCAGCCACAACGGCGACGCACAG | 10089 | AQKVSHNGDAQ | 14678 | KVSHNGD | 0.029043 | -0.13435 |
| SyS3220 | 5501 | GCCCAAAACACCCCCTACGTCCAAGCACAG | 10090 | AQNTPPYVQAQ | 14679 | NTPPYVQ | 0.028913 | -0.09322 |
| SyS3222 | 5502 | GCCCAAAAGAAGGATAATAATCAGCCGCACAG | 10091 | AQKKDNNQPAQ | 14680 | KKDNNQP | 0.028636 | -0.07058 |
| GS1774 | 5503 | GCCCAAACTATTAAGTCTTTGCCTGTGGCACAG | 10092 | AQTIKSLPVAQ | 14681 | TIKSLPV | 0.028464 | -0.08628 |
| GS1775 | 5504 | GCCCAAATTAATGCGATGCGTCGCAGGCACAG | 10093 | AQINAMRSQAQ | 14682 | INAMRSQ | 0.028288 | -0.12055 |
| SyS3223 | 5505 | GCCCAAGGCAACAGCATCGCCAAAGGCGCACAG | 10094 | AQGNSIAKGAQ | 14683 | GNSIAKG | 0.028156 | -0.14283 |
| GP279 | 5506 | GCCCAAGTTACTACTCCTAAGGCTTTGCACAG | 10095 | AQVTTPKAFAQ | 14684 | VTTPKAF | 0.028102 | -0.07259 |
| SyS3224 | 5507 | GCCCAAGGCAGCGTCGCCGGCAGAGAGCACAG | 10096 | AQGSVAGSRAQ | 14685 | GSVAGSR | 0.028078 | -0.18614 |
| GS1777 | 5508 | GCCCAAAGTGCTAATAATGCTCCTAAGGCACAG | 10097 | AQSANNAPKAQ | 14686 | SANNAPK | 0.027939 | -0.14408 |
| GS1778 | 5509 | GCCCAAGGCAACGACTCAACCCCTCCCGCACAG | 10098 | AQDRLNPLPAQ | 14687 | DRLNPLP | 0.027045 | -0.07977 |
| GS1779 | 5510 | GCCCAAAGAAGAAACCACCACCGACGTCGCACAG | 10099 | AQRNQPTDVAQ | 14688 | RNQPTDV | 0.026888 | -0.09709 |
| SyS3227 | 5511 | GCCCAAACCCAAGTCGGCAGCGGCCCCGCACAG | 10100 | AQTQVGSGPAQ | 14689 | TQVGSGP | 0.026786 | 0.288018 |
| GS1780 | 5512 | GCCCAACTGAGTCAGGTTTCGGAGGCCGGCACAG | 10101 | AQLSQVSRPAQ | 14690 | LSQVSRP | 0.02663 | -0.1747 |
| SyS3228 | 5513 | GCCCAAAACGGCGCCAACCTTCCAAATGGCACAG | 10102 | AQNGANLQMAQ | 14691 | NGANLQM | 0.026629 | -0.03438 |

FIG. 33 (Continued)

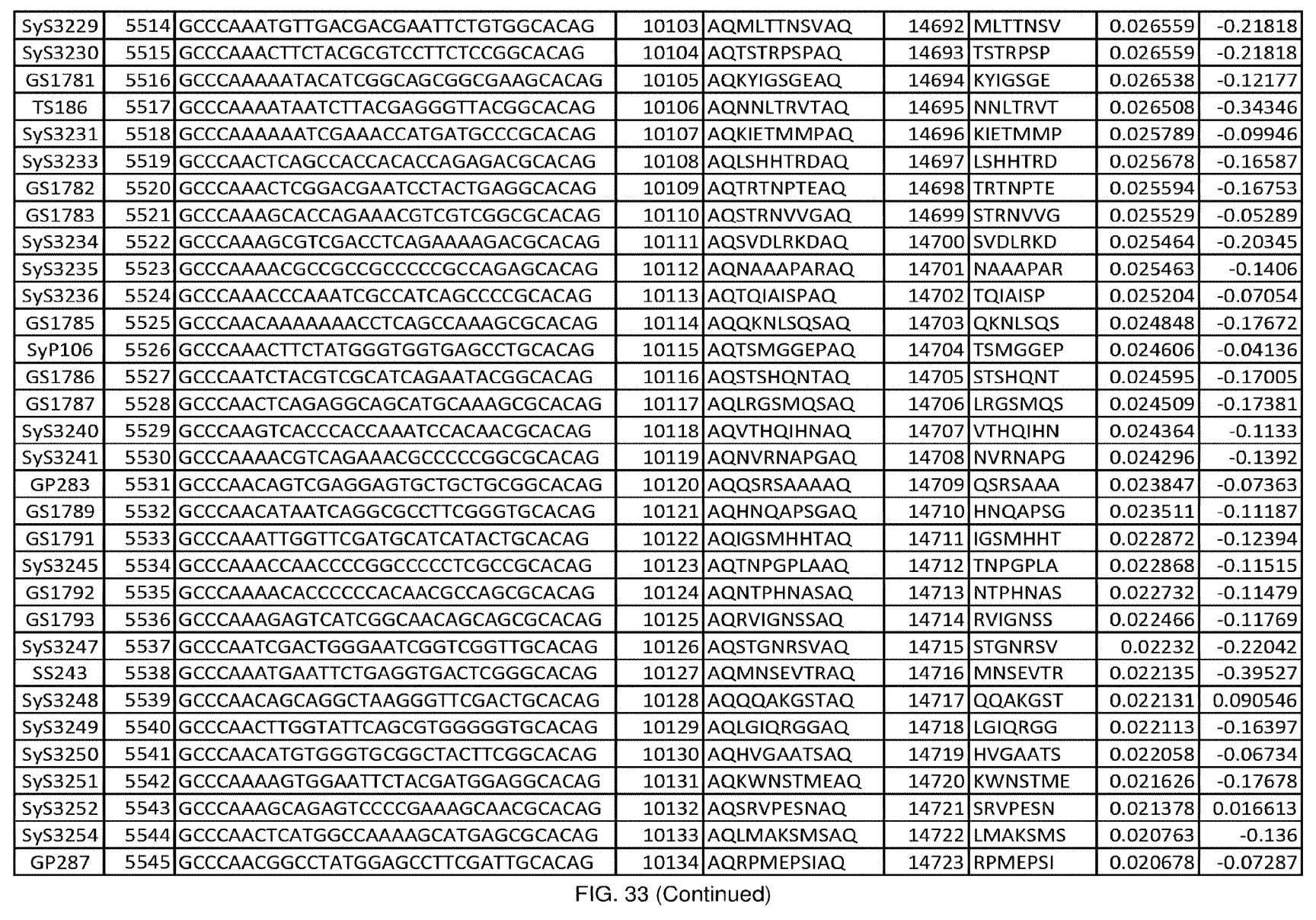

| | | | | | | | |
|---|---|---|---|---|---|---|---|
| SyS3229 | 5514 | GCCCAAATGTTGACGACGAATTCTGTGGCACAG | 10103 | AQMLTTNSVAQ | 14692 | MLTTNSV | 0.026559 | -0.21818 |
| SyS3230 | 5515 | GCCCAAACTTCTACGCGTCCTTCTCCGGCACAG | 10104 | AQTSTRPSPAQ | 14693 | TSTRPSP | 0.026559 | -0.21818 |
| GS1781 | 5516 | GCCCAAAATACATCGGCGGCGAAGCACAG | 10105 | AQKYIGSGEAQ | 14694 | KYIGSGE | 0.026538 | -0.12177 |
| TS186 | 5517 | GCCCAAAATAATCTTACGAGGGTTACGGCACAG | 10106 | AQNNLTRVTAQ | 14695 | NNLTRVT | 0.026508 | -0.34346 |
| SyS3231 | 5518 | GCCCAAAAAATCGAAACCATGATGCCCGCACAG | 10107 | AQKIETMMPAQ | 14696 | KIETMMP | 0.025789 | -0.09946 |
| SyS3233 | 5519 | GCCCAACTCAGCCACCACCAGAGACGCACAG | 10108 | AQLSHHTRDAQ | 14697 | LSHHTRD | 0.025678 | -0.16587 |
| GS1782 | 5520 | GCCCAAACTCGGACGAATCCTACTGAGGCACAG | 10109 | AQTRTNPTEAQ | 14698 | TRTNPTE | 0.025594 | -0.16753 |
| GS1783 | 5521 | GCCCAAAGCACCAGAAACGTCGTCGGCGCACAG | 10110 | AQSTRNVVGAQ | 14699 | STRNVVG | 0.025529 | -0.05289 |
| SyS3234 | 5522 | GCCCAAAGCGTCGACCTCAGAAAAGAGCACAG | 10111 | AQSVDLRKDAQ | 14700 | SVDLRKD | 0.025464 | -0.20345 |
| SyS3235 | 5523 | GCCCAAAACGCCGCGCCCCCGCCAGAGCACAG | 10112 | AQNAAAPARAQ | 14701 | NAAAPAR | 0.025463 | -0.1406 |
| SyS3236 | 5524 | GCCCAAACCCAAATCGCCATCAGCCCGCACAG | 10113 | AQTQIAISPAQ | 14702 | TQIAISP | 0.025204 | -0.07054 |
| GS1785 | 5525 | GCCCAACAAAAAAACCTCAGCCAAAGCGCACAG | 10114 | AQQKNLSQSAQ | 14703 | QKNLSQS | 0.024848 | -0.17672 |
| SyP106 | 5526 | GCCCAAACTTCTATGGGTGGTGAGCCTGCACAG | 10115 | AQTSMGGEPAQ | 14704 | TSMGGEP | 0.024606 | -0.04136 |
| GS1786 | 5527 | GCCCAATCTACGTCGCATCAGAATACGGCACAG | 10116 | AQSTSHQNTAQ | 14705 | STSHQNT | 0.024595 | -0.17005 |
| GS1787 | 5528 | GCCCAACTCAGAGGCAGCATGCAAAGCGCACAG | 10117 | AQLRGSMQSAQ | 14706 | LRGSMQS | 0.024509 | -0.17381 |
| SyS3240 | 5529 | GCCCAAGTCACCCACCAAATCCACAACGCACAG | 10118 | AQVTHQIHNAQ | 14707 | VTHQIHN | 0.024364 | -0.1133 |
| SyS3241 | 5530 | GCCCAAAACGTCAGAAAACGCCCCGGCGCACAG | 10119 | AQNVRNAPGAQ | 14708 | NVRNAPG | 0.024296 | -0.1392 |
| GP283 | 5531 | GCCCAACAGTCGAGGAGTGCTGCTGGGCACAG | 10120 | AQQSRSAAAAQ | 14709 | QSRSAAA | 0.023847 | -0.07363 |
| GS1789 | 5532 | GCCCACAACATAATCAGGCGCGCCTTCGGGGTGCACAG | 10121 | AQHNQAPSGAQ | 14710 | HNQAPSG | 0.023511 | -0.11187 |
| GS1791 | 5533 | GCCCAAATTGGTTCGATGCATCATACTGCACAG | 10122 | AQIGSMHHTAQ | 14711 | IGSMHHT | 0.022872 | -0.12394 |
| SyS3245 | 5534 | GCCCAAACCAACCCCGCCCCCTCGCCACAG | 10123 | AQTNPGPLAAQ | 14712 | TNPGPLA | 0.022868 | -0.11515 |
| GS1792 | 5535 | GCCCAAAACACCCCCACAAGCGCAGCGCACAG | 10124 | AQNTPHNASAQ | 14713 | NTPHNAS | 0.022732 | -0.11479 |
| GS1793 | 5536 | GCCCAAAGAGTCATCGGCAACAGCAGCGCACAG | 10125 | AQRVIGNSSAQ | 14714 | RVIGNSS | 0.022466 | -0.11769 |
| SyS3247 | 5537 | GCCCAATCGACTGGGAATCGGTCGGTTGCACAG | 10126 | AQSTGNRSVAQ | 14715 | STGNRSV | 0.02232 | -0.22042 |
| SS243 | 5538 | GCCCAAATGAATTCTGAGGTGACTCGGGCACAG | 10127 | AQMNSEVTRAQ | 14716 | MNSEVTR | 0.022135 | -0.39527 |
| SyS3248 | 5539 | GCCCAACAGCAGGCTAAGGGTTCGACTGCACAG | 10128 | AQQQAKGSTAQ | 14717 | QQAKGST | 0.022131 | 0.090546 |
| SyS3249 | 5540 | GCCCAACTTGGTATTCAGCGTGGGGGTGCACAG | 10129 | AQLGIQRGGAQ | 14718 | LGIQRGG | 0.022113 | -0.16397 |
| SyS3250 | 5541 | GCCCAACATGTGGGTGCGGCTACTTCGGCACAG | 10130 | AQHVGAATSAQ | 14719 | HVGAATS | 0.022058 | -0.06734 |
| SyS3251 | 5542 | GCCCAAAAGTGGAATTCTACGATGGAGGCACAG | 10131 | AQKWNSTMEAQ | 14720 | KWNSTME | 0.021626 | -0.17678 |
| SyS3252 | 5543 | GCCCAAAGCAGAGTCCCGAAAGCAACGCACAG | 10132 | AQSRVPESNAQ | 14721 | SRVPESN | 0.021378 | 0.016613 |
| SyS3254 | 5544 | GCCCAACTCATGGCCAAAAGCATGAGCGCACAG | 10133 | AQLMAKSMSAQ | 14722 | LMAKSMS | 0.020763 | -0.136 |
| GP287 | 5545 | GCCCAACGGCCTATGGAGCCTTCGATTGCACAG | 10134 | AQRPMEPSIAQ | 14723 | RPMEPSI | 0.020678 | -0.07287 |

FIG. 33 (Continued)

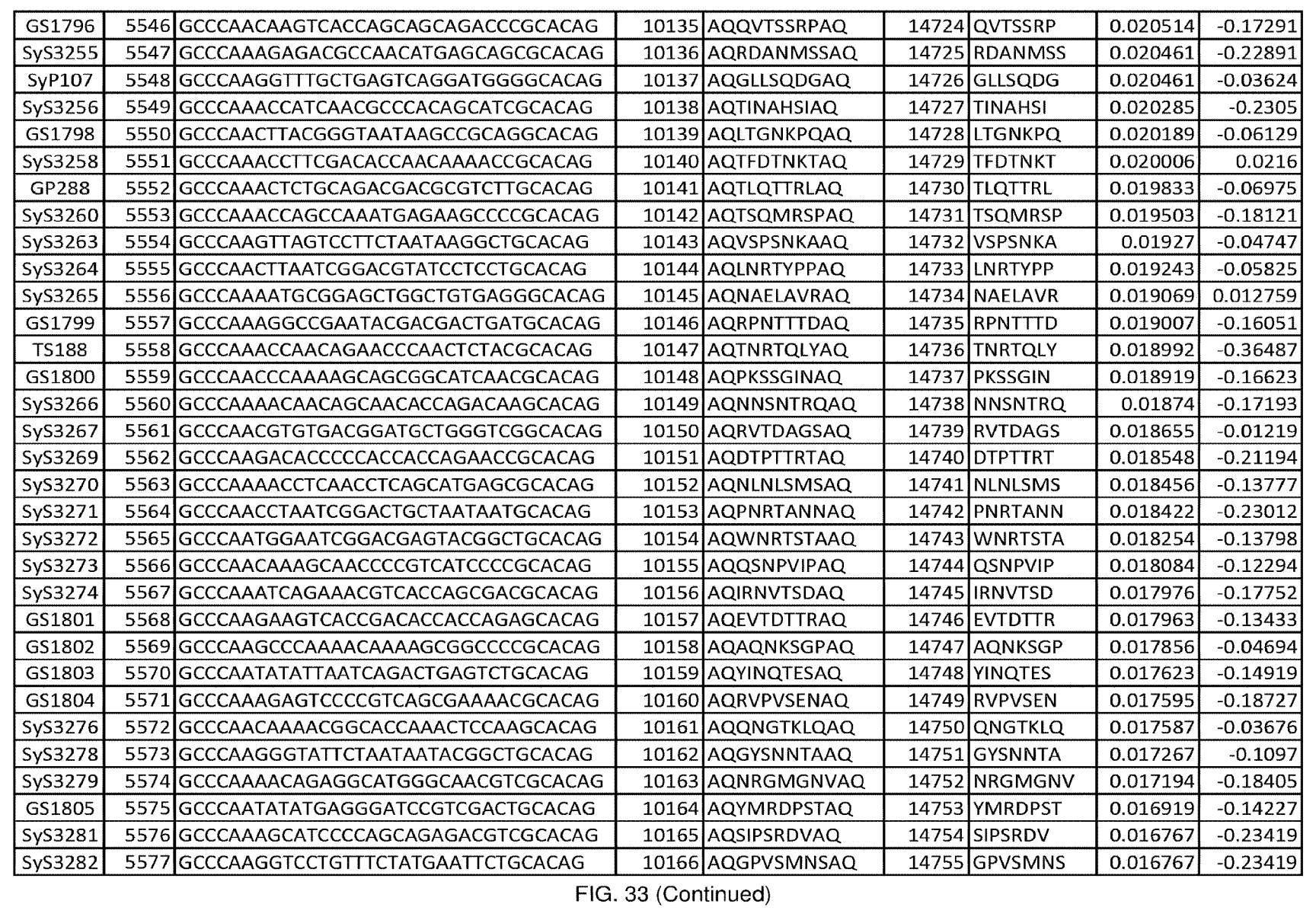

| | | | | | | | |
|---|---|---|---|---|---|---|---|
| GS1796 | 5546 | GCCCAACAAGTCACCAGCAGCAGACCCGCACAG | 10135 | AQQVTSSRPAQ | 14724 | QVTSSRP | 0.020514 | -0.17291 |
| SyS3255 | 5547 | GCCCAAAGAGAGCGCCAACATGAGCAGCGCACAG | 10136 | AQRDANMSSAQ | 14725 | RDANMSS | 0.020461 | -0.22891 |
| SyP107 | 5548 | GCCCAAGGTTTGCTGAGTCAGGATGGGGCACAG | 10137 | AQGLLSQDGAQ | 14726 | GLLSQDG | 0.020461 | -0.03624 |
| SyS3256 | 5549 | GCCCAAACCATCAACGCCCACAGCATCGCACAG | 10138 | AQTINAHSIAQ | 14727 | TINAHSI | 0.020285 | -0.2305 |
| GS1798 | 5550 | GCCCAACTTACGGGTAATAAGCCGCAGGCACAG | 10139 | AQLTGNKPQAQ | 14728 | LTGNKPQ | 0.020189 | -0.06129 |
| SyS3258 | 5551 | GCCCAAACCTTGCACCAACAAAACCGCACAG | 10140 | AQTFDTNKTAQ | 14729 | TFDTNKT | 0.020006 | 0.0216 |
| GP288 | 5552 | GCCCAAACTCTGCAGACGACGCGTCTTGCACAG | 10141 | AQTLQTRLAQ | 14730 | TLQTTRL | 0.019833 | -0.06975 |
| SyS3260 | 5553 | GCCCAAACCAGCCAAATGAGAAGCCCCGCACAG | 10142 | AQTSQMRSPAQ | 14731 | TSQMRSP | 0.019503 | -0.18121 |
| SyS3263 | 5554 | GCCCAAGTTAGTCCTTCTAATAAGGCTGCACAG | 10143 | AQVSPSNKAAQ | 14732 | VSPSNKA | 0.01927 | -0.04747 |
| SyS3264 | 5555 | GCCCAACTTAATCGGACGTATCCTCCTGCACAG | 10144 | AQLNRTYPPAQ | 14733 | LNRTYPP | 0.019243 | -0.05825 |
| SyS3265 | 5556 | GCCCAAAATGCGGAGCTGGCTGTGTGAGGGCACAG | 10145 | AQNAELAVRAQ | 14734 | NAELAVR | 0.019069 | 0.012759 |
| GS1799 | 5557 | GCCCAAAGGCCGAATACGACGACTGATGCACAG | 10146 | AQRPNTTTDAQ | 14735 | RPNTTTD | 0.019007 | -0.16051 |
| TS188 | 5558 | GCCCAAAACCAACAGAACCCAACTCTACGCACAG | 10147 | AQTNRTQLYAQ | 14736 | TNRTQLY | 0.018992 | -0.36487 |
| GS1800 | 5559 | GCCCAACCCAAAAGCAGCGGCATCAACGCACAG | 10148 | AQPKSSGINAQ | 14737 | PKSSGIN | 0.018919 | -0.16623 |
| SyS3266 | 5560 | GCCCAAAACAACAGCAACACCAGACAAGCACAG | 10149 | AQNNSNTRQAQ | 14738 | NNSNTRQ | 0.01874 | -0.17193 |
| SyS3267 | 5561 | GCCCAAGCGTGTGACGGATGCTGGGTCGGCACAG | 10150 | AQRVTDAGSAQ | 14739 | RVTDAGS | 0.018655 | -0.01219 |
| SyS3269 | 5562 | GCCCAAGACACCCCCACCACCAGAACCGCACAG | 10151 | AQDTPTTRTAQ | 14740 | DTPTTRT | 0.018548 | -0.21194 |
| SyS3270 | 5563 | GCCCAAAACCTCAACCTCAGCATGAGCGCACAG | 10152 | AQNLNLSMSAQ | 14741 | NLNLSMS | 0.018456 | -0.13777 |
| SyS3271 | 5564 | GCCCAACCTAATCGGACTGCTAATAATGCACAG | 10153 | AQPNRTANNAQ | 14742 | PNRTANN | 0.018422 | -0.23012 |
| SyS3272 | 5565 | GCCCAATGGAATCGGACGAGTACGGCTGCACAG | 10154 | AQWNRTSTAAQ | 14743 | WNRTSTA | 0.018254 | -0.13798 |
| SyS3273 | 5566 | GCCCAACAAAGCAACCCCGTCATCCCCGCACAG | 10155 | AQQSNPVIPAQ | 14744 | QSNPVIP | 0.018084 | -0.12294 |
| SyS3274 | 5567 | GCCCAAATCAGAAAGTCACCAGCGACGCACAG | 10156 | AQIRNVTSDAQ | 14745 | IRNVTSD | 0.017976 | -0.17752 |
| GS1801 | 5568 | GCCCAAGAAGTCACCGACACCACCAGAGCACAG | 10157 | AQEVTDTTRAQ | 14746 | EVTDTTR | 0.017963 | -0.13433 |
| GS1802 | 5569 | GCCCAAGCCCAAAACAAAGGCGGCCCCGCACAG | 10158 | AQAQNKSGPAQ | 14747 | AQNKSGP | 0.017856 | -0.04694 |
| GS1803 | 5570 | GCCCAATATATTAATCAGACTGAGTCTGCACAG | 10159 | AQYINQTESAQ | 14748 | YINQTES | 0.017623 | -0.14919 |
| GS1804 | 5571 | GCCCAAAGAGTCCCCGTCAGCGAAAACGCACAG | 10160 | AQRVPVSENAQ | 14749 | RVPVSEN | 0.017595 | -0.18727 |
| SyS3276 | 5572 | GCCCAACAACAAAACGGCACCAAACTCCAAGCACAG | 10161 | AQQNGTKLQAQ | 14750 | QNGTKLQ | 0.017587 | -0.03676 |
| SyS3278 | 5573 | GCCCAAGGGTATTCTAATAATACGGCTGCACAG | 10162 | AQGYSNNTAAQ | 14751 | GYSNNTA | 0.017267 | -0.1097 |
| SyS3279 | 5574 | GCCCAAAACAGAGGCATGGGCAACGTCGCACAG | 10163 | AQNRGMGNVAQ | 14752 | NRGMGNV | 0.017194 | -0.18405 |
| GS1805 | 5575 | GCCCAATATATGAGGGATCCGTCGACTGCACAG | 10164 | AQYMRDPSTAQ | 14753 | YMRDPST | 0.016919 | -0.14227 |
| SyS3281 | 5576 | GCCCAAAGCATCCCCAGCAGAGACGTCGCACAG | 10165 | AQSIPSRDVAQ | 14754 | SIPSRDV | 0.016767 | -0.23419 |
| SyS3282 | 5577 | GCCCAAGGTCCTGTTTCTATGAATTCTGCACAG | 10166 | AQGPVSMNSAQ | 14755 | GPVSMNS | 0.016767 | -0.23419 |

FIG. 33 (Continued)

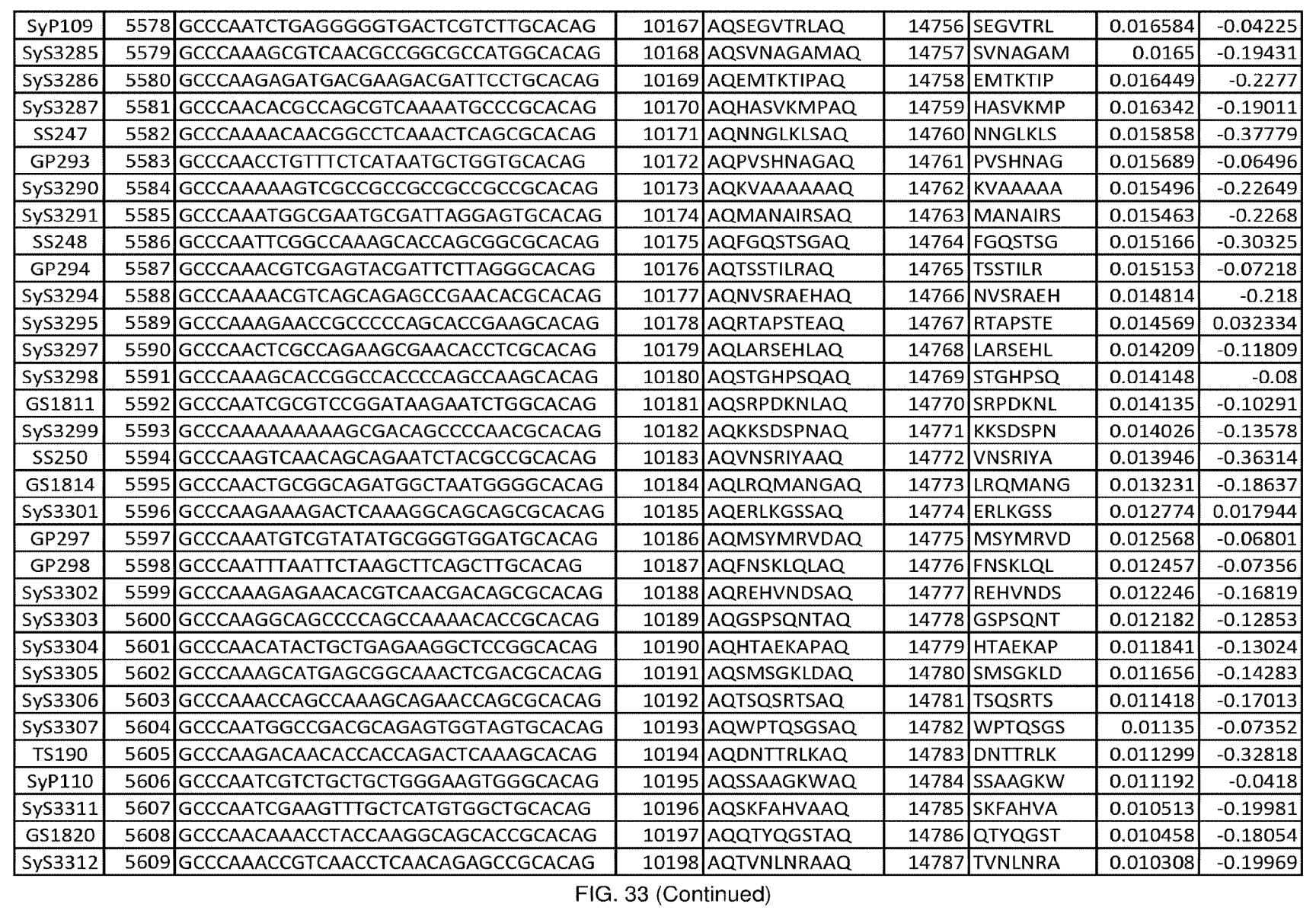

| | | | | | | | | |
|---|---|---|---|---|---|---|---|---|
| SyP109 | 5578 | GCCCAATCTGAGGGGGTGACTCGTCTTGCACAG | 10167 | AQSEGVTRLAQ | 14756 | SEGVTRL | 0.016584 | -0.04225 |
| SyS3285 | 5579 | GCCCAAAGCGTCAACGCCGGCGCCATGGCACAG | 10168 | AQSVNAGAMAQ | 14757 | SVNAGAM | 0.0165 | -0.19431 |
| SyS3286 | 5580 | GCCCAAGAGATGACGAAGACGATTCCTGCACAG | 10169 | AQEMIKTIPAQ | 14758 | EMIKTIP | 0.016449 | -0.2277 |
| SyS3287 | 5581 | GCCCAACACGCCAGCGTCAAAATGCCGCACAG | 10170 | AQHASVKMPAQ | 14759 | HASVKMP | 0.016342 | -0.19011 |
| SS247 | 5582 | GCCCAAAACAACGGCCTCAAACTCAGCGCACAG | 10171 | AQNNGLKLSAQ | 14760 | NNGLKLS | 0.015858 | -0.37779 |
| GP293 | 5583 | GCCCAACCTGTTTCTCATAATGCTGGTGCACAG | 10172 | AQPVSHNAGAQ | 14761 | PVSHNAG | 0.015689 | -0.06496 |
| SyS3290 | 5584 | GCCCAAAAAGTCGCCGCCGCCGCCGCACAG | 10173 | AQKVAAAAAQ | 14762 | KVAAAAA | 0.015496 | -0.22649 |
| SyS3291 | 5585 | GCCCAAATGGCGAATGCGATTAGGAGTGCACAG | 10174 | AQMANAIRSAQ | 14763 | MANAIRS | 0.015463 | -0.2268 |
| SS248 | 5586 | GCCCAATTCGGCCAAAGCACCAGCGGCGCACAG | 10175 | AQFGQSTSGAQ | 14764 | FGQSTSG | 0.015166 | -0.30325 |
| GP294 | 5587 | GCCCAAACGTCGAGTACGATTCTTAGGGCACAG | 10176 | AQTSSTILRAQ | 14765 | TSSTILR | 0.015153 | -0.07218 |
| SyS3294 | 5588 | GCCCAAAAACGTCAGCAGAGCCGAACACGCACAG | 10177 | AQNVSRAEHAQ | 14766 | NVSRAEH | 0.014814 | -0.218 |
| SyS3295 | 5589 | GCCCAAAGAACCGCCCCAGCACCGAAGCACAG | 10178 | AQRTAPSTEAQ | 14767 | RTAPSTE | 0.014569 | 0.032334 |
| SyS3297 | 5590 | GCCCAACTCGCCAGAAGCGAACACCTCGCACAG | 10179 | AQLARSEHLAQ | 14768 | LARSEHL | 0.014209 | -0.11809 |
| SyS3298 | 5591 | GCCCAAAGCACCGGCCACCCAGCCAAGCACAG | 10180 | AQSTGHPSQAQ | 14769 | STGHPSQ | 0.014148 | -0.08 |
| GS1811 | 5592 | GCCCAATCGCGTCCGGATAAGAATCTGGCACAG | 10181 | AQSRPDKNLAQ | 14770 | SRPDKNL | 0.014135 | -0.10291 |
| SyS3299 | 5593 | GCCCAAAAAAAGCGACAGCCCAACGCACAG | 10182 | AQKKSDSPNAQ | 14771 | KKSDSPN | 0.014026 | -0.13578 |
| SS250 | 5594 | GCCCAAGTCAACAGCAGAATCTACGCCGCACAG | 10183 | AQVNSRIYAAQ | 14772 | VNSRIYA | 0.013946 | -0.36314 |
| GS1814 | 5595 | GCCCAACTGCGGCAGAGATGGCTAATGGGGCACAG | 10184 | AQLRQMANGAQ | 14773 | LRQMANG | 0.013231 | -0.18637 |
| SyS3301 | 5596 | GCCCAAGAAAGACTCAAAGGCAGCAGCGCACAG | 10185 | AQERLKGSSAQ | 14774 | ERLKGSS | 0.012774 | 0.017944 |
| GP297 | 5597 | GCCCAAATGTCGTATATGCGGGTGGATGCACAG | 10186 | AQMSYMRVDAQ | 14775 | MSYMRVD | 0.012568 | -0.06801 |
| GP298 | 5598 | GCCCAATTTAATTCTAAGCTTCAGCTTGCACAG | 10187 | AQFNSKLQLAQ | 14776 | FNSKLQL | 0.012457 | -0.07356 |
| SyS3302 | 5599 | GCCCAAAGAGAACAGTCAACGACAGCGGCACAG | 10188 | AQREHVNDSAQ | 14777 | REHVNDS | 0.012246 | -0.16819 |
| SyS3303 | 5600 | GCCCAAGGCAGCCCAGCCAAAACACCGCACAG | 10189 | AQGSPSQNTAQ | 14778 | GSPSQNT | 0.012182 | -0.12853 |
| SyS3304 | 5601 | GCCCAACATACTGCTGAGAAGGCTCCGGCACAG | 10190 | AQHTAEKAPAQ | 14779 | HTAEKAP | 0.011841 | -0.13024 |
| SyS3305 | 5602 | GCCCAAAGCATGAGCGGCAAACTGACGCACAG | 10191 | AQSMSGKLDAQ | 14780 | SMSGKLD | 0.011656 | -0.14283 |
| SyS3306 | 5603 | GCCCAAACCAGCCAAAGCAGAACCAGCGCACAG | 10192 | AQTSQSRTSAQ | 14781 | TSQSRTS | 0.011418 | -0.17013 |
| SyS3307 | 5604 | GCCCAATGGCCGACGCAGAGTGGTAGTGCACAG | 10193 | AQWPTQSGSAQ | 14782 | WPTQSGS | 0.01135 | -0.07352 |
| TS190 | 5605 | GCCCAAGACAACACCACCAGACTCAAAGCACAG | 10194 | AQDNTTRLKAQ | 14783 | DNTTRLK | 0.011299 | -0.32818 |
| SyP110 | 5606 | GCCCAATCGTCTGCTGGGAAGTGGGCACAG | 10195 | AQSSAAGKWAQ | 14784 | SSAAGKW | 0.011192 | -0.0418 |
| SyS3311 | 5607 | GCCCAATCGAAGTTTGCTCATGTGGCTGCACAG | 10196 | AQSKFAHVAAQ | 14785 | SKFAHVA | 0.010513 | -0.19981 |
| GS1820 | 5608 | GCCCAACAACAAACCTACCAAGGCAGCACCGCACAG | 10197 | AQQTYQGSTAQ | 14786 | QTYQGST | 0.010458 | -0.18054 |
| SyS3312 | 5609 | GCCCAAACCGTCAACCTCAACAGAGCGCCGCACAG | 10198 | AQTVNLNRAAQ | 14787 | TVNLNRA | 0.010308 | -0.19969 |

FIG. 33 (Continued)

| | | | | | | | | |
|---|---|---|---|---|---|---|---|---|
| SyS3313 | 5610 | GCCCAAAGATACGGCAGCAGCCTCCCGCACAG | 10199 | AQRYGSSLPAQ | 14788 | RYGSSLP | 0.009869 | -0.21072 |
| GS1822 | 5611 | GCCCAAAGAAGCAACAGCAGCAGCAGCAACCTCGCACAG | 10200 | AQRSNSSNLAQ | 14789 | RSNSSNL | 0.009735 | -0.09744 |
| GS1823 | 5612 | GCCCAACAAGGCCCAGCATCAGAGACGCACAG | 10201 | AQQGPSIRDAQ | 14790 | QGPSIRD | 0.00931 | -0.17112 |
| GS1824 | 5613 | GCCCAATGGAGAGACCTGCCCCCCGTCGCACAG | 10202 | AQWRDLAPVAQ | 14791 | WRDLAPV | 0.009233 | -0.1186 |
| SyS3316 | 5614 | GCCCAACACAGCGACATCCAAAGACCCGCACAG | 10203 | AQHSDIQRPAQ | 14792 | HSDIQRP | 0.009085 | -0.01571 |
| GS1825 | 5615 | GCCCAATTGGGCGGCGATGACGAATGCTGCACAG | 10204 | AQLAAMTNAAQ | 14793 | LAAMTNA | 0.008985 | -0.10156 |
| SyS3317 | 5616 | GCCCAAAGCGCCAACCACACCACCGCACAG | 10205 | AQSANHTHTAQ | 14794 | SANHTHT | 0.008908 | -0.08086 |
| SyS3318 | 5617 | GCCCAAGGGAAGCTGTCGGTGGAGAATGCACAG | 10206 | AQGKLSVENAQ | 14795 | GKLSVEN | 0.008617 | -0.07767 |
| SyS3319 | 5618 | GCCCAAAAAACCGGCGCCAACCCCCCGCACAG | 10207 | AQKPGANPPAQ | 14796 | KPGANPP | 0.008265 | -0.07573 |
| GP301 | 5619 | GCCCAACTTACTGAGGGTCGTCATGATGCACAG | 10208 | AQLTEGRHDAQ | 14797 | LTEGRHD | 0.008187 | -0.07148 |
| SyP112 | 5620 | GCCCAACTTGGGTGAATATTTATCGGCACAG | 10209 | AQLGSNIYPAQ | 14798 | LGSNIYP | 0.00806 | -0.03861 |
| SyS3321 | 5621 | GCCCAAAACGGCGCCCACAGCAGCGAAGCACAG | 10210 | AQNGAHSSEAQ | 14799 | NGAHSSE | 0.007822 | -0.08193 |
| GS1826 | 5622 | GCCCAAAATACGATGGGTGGTGCGGGGCACAG | 10211 | AQNTMGGAAAQ | 14800 | NTMGGAA | 0.007814 | -0.14962 |
| SyS3322 | 5623 | GCCCAAGAGAACCCCATCGGCCAACCCGCACAG | 10212 | AQRTPIGQPAQ | 14801 | RTPIGQP | 0.007542 | -0.18648 |
| SyS3323 | 5624 | GCCCAATATAGTGTGGCTCAGCAGCCGGCACAG | 10213 | AQYSVAQQPAQ | 14802 | YSVAQQP | 0.007381 | -0.22064 |
| GP303 | 5625 | GCCCAACCTCATTCTAAGGGGATGCTTGCACAG | 10214 | AQPHSKGMLAQ | 14803 | PHSKGML | 0.007181 | -0.0685 |
| GS1827 | 5626 | GCCCAAGTTCGGCGCATGGGATGGGTGCACAG | 10215 | AQVPAHGMGMGAQ | 14804 | VPAHGMG | 0.007168 | -0.12619 |
| SyS3324 | 5627 | GCCCAAATTTGGTGGGGTTCCTCAGCGTGCACAG | 10216 | AQIGGVPQRAQ | 14805 | IGGVPQR | 0.007145 | -0.12889 |
| SyS3325 | 5628 | GCCCAAGTGCAGGGGACGGTTTCGAGGGCACAG | 10217 | AQVQGTVSRAQ | 14806 | VQGTVSR | 0.007118 | -0.15153 |
| SyS3326 | 5629 | GCCCAAAGTGGTGGGAGTGGTGCTCCTGCACAG | 10218 | AQSGGSGAPAQ | 14807 | SGGSGAP | 0.006964 | -0.05146 |
| SyS3327 | 5630 | GCCCAAAAAGTCCCACCCAAACGAAGCACAG | 10219 | AQKVPTQTEAQ | 14808 | KVPTQTE | 0.006686 | -0.09626 |
| SyS3328 | 5631 | GCCCAAATTTCGACGATGAAGCCTAGTGCACAG | 10220 | AQISTMKPSAQ | 14809 | ISTMKPS | 0.006591 | -0.15981 |
| SyS3329 | 5632 | GCCCAAAGCAGAGTCGTCGAACAAGCCGCACAG | 10221 | AQSRVVEQAAQ | 14810 | SRVVEQA | 0.006345 | -0.21818 |
| SyS3331 | 5633 | GCCCAAGTCCTCAGCAGACAAAGCACCGCACAG | 10222 | AQVLSRQSTAQ | 14811 | VLSRQST | 0.006155 | -0.23376 |
| SyS3332 | 5634 | GCCCAAGTCGTCACCACCACCAGCAGCATGGCACAG | 10223 | AQVVTTSSMAQ | 14812 | VVTTSSM | 0.006155 | -0.23376 |
| SyP114 | 5635 | GCCCAAAGTACGGGTTCTTCGGGGTTTGGCACAG | 10224 | AQSTGSSGLAQ | 14813 | STGSSGL | 0.006086 | -0.04068 |
| TS192 | 5636 | GCCCAACCCAACAGAGCCGCCAACAACGCACAG | 10225 | AQPNRAANNAQ | 14814 | PNRAANN | 0.005926 | -0.37804 |
| SyS3333 | 5637 | GCCCAATATCCTGTTAATAGTCAGCCTGCACAG | 10226 | AQYPVNSQPAQ | 14815 | YPVNSQP | 0.005608 | -0.22042 |
| SyS3334 | 5638 | GCCCAAAAAGCGCCAGCCCCTACGACGCACAG | 10227 | AQKSASPYDAQ | 14816 | KSASPYD | 0.005437 | -0.08849 |
| GS1830 | 5639 | GCCCAAAGCAAAAGTGGGGCGCCGGCACAG | 10228 | AQSKSWGAAAQ | 14817 | SKSWGAA | 0.005259 | -0.13947 |
| SyS3335 | 5640 | GCCCAATCTGCGATGCTGAAGGTTGATGCACAG | 10229 | AQSAMLKVDAQ | 14818 | SAMLKVD | 0.005199 | -0.20339 |
| SP62 | 5641 | GCCCAACGGAGTCAGACGATTCAGGCTGCACAG | 10230 | AQRSQTIQAAQ | 14819 | RSQTIQA | 0.004569 | -0.05254 |

FIG. 33 (Continued)

| | | | | | | | | |
|---|---|---|---|---|---|---|---|---|
| SyS3336 | 5642 | GCCCAACCCAGCAGCAGACTCGGCGACGCACAG | 10231 | AQPSRLGDAQ | 14820 | PSSRLGD | 0.004505 | 0.004214 |
| GS1831 | 5643 | GCCCAAATCGGCCCCAGAGGCACCCAAGCACAG | 10232 | AQIGPRGTQAQ | 14821 | IGPRGTQ | 0.004293 | -0.15764 |
| SyS3337 | 5644 | GCCCAAGCAGCAGCAAAGGCAATACCTCGCACAG | 10233 | AQASKGQYLAQ | 14822 | ASKGQYL | 0.004037 | -0.23497 |
| GP306 | 5645 | GCCCAAGTTAGGACTCTTACTGTTGATGCACAG | 10234 | AQVRTLTVDAQ | 14823 | VRTLTVD | 0.003991 | -0.06489 |
| SyS3339 | 5646 | GCCCAACGTGGGAATGCTGCGAATGAGGCACAG | 10235 | AQRGNAANEAQ | 14824 | RGNAANE | 0.003862 | -0.12561 |
| SyS3340 | 5647 | GCCCAATTCGGCAGCCACCCCAGCGTCGCACAG | 10236 | AQFGSHPSVAQ | 14825 | FGSHPSV | 0.003469 | -0.2231 |
| GP309 | 5648 | GCCCAAGGTCATCCGACTCCTGTTAATGCACAG | 10237 | AQGHPTPVNAQ | 14826 | GHPTPVN | 0.003421 | -0.06822 |
| GS1833 | 5649 | GCCCAAAGCCTCAACCCGTCAGAATGGCACAG | 10238 | AQSLNPVRMAQ | 14827 | SLNPVRM | 0.002868 | -0.1138 |
| GP312 | 5650 | GCCCAAAGTATTCGGGGTCAGCCTTTGCACAG | 10239 | AQSIRGQPFAQ | 14828 | SIRGQPF | 0.002583 | -0.07405 |
| GS1835 | 5651 | GCCCAAACCGCCAAATTCAACCAAGGCGCACAG | 10240 | AQTAKFNQGAQ | 14829 | TAKFNQG | 0.002515 | -0.11596 |
| SyS3342 | 5652 | GCCCAATTGATTTCGACGCATGATATGGCACAG | 10241 | AQLISTHDMAQ | 14830 | LISTHDM | 0.002485 | -0.14369 |
| SyS3345 | 5653 | GCCCAACAAAGCAGAGACAACATCAGAGCACAG | 10242 | AQQSRDNIRAQ | 14831 | QSRDNIR | 0.002214 | -0.11916 |
| SyS3346 | 5654 | GCCCAAAACAACGGCAACAAAGGCTTCGCACAG | 10243 | AQNNGNKGFAQ | 14832 | NNGNKGF | 0.002093 | -0.21325 |
| GP315 | 5655 | GCCCAAAATGTGAATTATGATGGGCGGGCACAG | 10244 | AQNVNYDGRAQ | 14833 | NVNYDGR | 0.001863 | -0.07225 |
| GS1841 | 5656 | GCCCAATTCATGAAAGGCGCCAGCGCCGCACAG | 10245 | AQFMKGASAAQ | 14834 | FMKGASA | 0.001531 | -0.15945 |
| SyS3349 | 5657 | GCCCAACTCGCCACCAGCACCCAAATGGCACAG | 10246 | AQLATSTQMAQ | 14835 | LATSTQM | 0.001488 | -0.218 |
| SyS3350 | 5658 | GCCCAAGTTCATGGTGGGTATTCGGCTGCACAG | 10247 | AQVHGGYSAAQ | 14836 | VHGGYSA | 0.001485 | -0.22434 |
| SS254 | 5659 | GCCCAAAGAGGCAGCAGCGAACCCATGCAAGCACAG | 10248 | AQRGSEPMQAQ | 14837 | RGSEPMQ | 0.001241 | -0.3679 |
| GP317 | 5660 | GCCCAAGGTCTGCGTACGAGTGGGACGCGGCACAG | 10249 | AQGLRTSGTAQ | 14838 | GLRTSGT | 0.001025 | -0.06413 |
| SyS3351 | 5661 | GCCCAACTCTACAAAGGCGGGCGTCAGCGCACAG | 10250 | AQLYKGGVSAQ | 14839 | LYKGGVS | 0.000806 | -0.23012 |
| SyS3353 | 5662 | GCCCAAATGAAAACCCACCACAGCCCCCGCACAG | 10251 | AQMKTHSPPAQ | 14840 | MKTHSPP | 0.000291 | -0.09473 |

FIG. 33 (Continued)

| Enrich_rank (within libraries) | SEQ ID NO: | Sequence | SEQ ID NO: | 11 mer Amino Acid | SEQ ID NO: | 7 mer Amino acid | Brain-mean-enrichment score (log10) | Brain-mean-standardized-read count (RC) |
|---|---|---|---|---|---|---|---|---|
| TS32 | 14841 | GCCCAAAGCAACAGCATCAGACTCGTCGCACAG | 14881 | AQSNSIRLVAQ | 14921 | SNSIRLV | 0.763114 | 1.058208 |
| TS70 | 14842 | GCCCAACCCAACACCATCAGAAACGTCGCACAG | 14882 | AQPNTIRNVAQ | 14922 | PNTIRNV | 0.660528 | 0.629407 |
| SyS52 | 14843 | GCCCAAACCAGCCTCGGCTACAGCAGCGCACAG | 14883 | AQTSLGYSSAQ | 14923 | TSLGYSS | 0.727167 | 0.736367 |
| SyS140 | 14844 | GCCCAAATGGGCGGCGACCACAGAACCGCACAG | 14884 | AQMGADHRTAQ | 14924 | MGADHRT | 0.548749 | 0.159265 |
| SyS58 | 14845 | GCCCAAGGTGATAATAGTCTGACTAGGGCACAG | 14885 | AQGDNSLTRAQ | 14925 | GDNSLTR | 0.717624 | 0.075033 |
| SyS201 | 14846 | GCCCAAACCCCCAAAGCCAAGAAATGGCACAG | 14886 | AQTPQSQEMAQ | 14926 | TPQSQEM | 0.494147 | 0.127468 |
| SyS61 | 14847 | GCCCAAAGCGGCGTCAGCACCACCGACGCACAG | 14887 | AQSGVSTTDAQ | 14927 | SGVSTTD | 0.711249 | -0.01534 |
| SyS97 | 14848 | GCCCAAGAAGGCCTCGGCAACGCCGCCGCACAG | 14888 | AQEGLGNAAAQ | 14928 | EGLGNAA | 0.59339 | -0.02116 |
| SyS176 | 14849 | GCCCAAAATTGCTGAGAATCTGAGTGCTGCACAG | 14889 | AQIAENLSAAQ | 14929 | IAENLSA | 0.517935 | -0.10864 |
| SyS154 | 14850 | GCCCAACTCGGCGACATCACCGGCTTCGCACAG | 14890 | AQLGDITGFAQ | 14930 | LGDITGF | 0.537047 | -0.10198 |
| SyS101 | 14851 | GCCCAAAGTCAGCTGCATAGGTTGCAGGCACAG | 14891 | AQSQLHRLQAQ | 14931 | SQLHRLQ | 0.588997 | -0.13052 |
| SyS45 | 14852 | GCCCAACCTATTATTACTATGCCTGCTGCACAG | 14892 | AQPITMPAAQ | 14932 | PIITMPA | 0.767318 | -0.10299 |
| SyS205 | 14853 | GCCCAATGGAGCCACAGCGAAAACAGCGCACAG | 14893 | AQWSHSENSAQ | 14933 | WSHSENS | 0.492196 | -0.02126 |
| SyS30 | 14854 | GCCCAATTGACTCAGCGAGACGGATGTTGCACAG | 14894 | AQLTQQTDVAQ | 14934 | LTQQTDV | 0.936974 | 0.055201 |
| SyS136 | 14855 | GCCCAAGGTATGAGTGGGGTTGCTCAGGCACAG | 14895 | AQGMSGVAQAQ | 14935 | GMSGVAQ | 0.552736 | -0.0578 |
| SyS128 | 14856 | GCCCAACCGACTAATATTATGCTTGATGCACAG | 14896 | AQPTNIMLDAQ | 14936 | PTNIMLD | 0.560313 | -0.07894 |
| SyS71 | 14857 | GCCCAAAAACCCACCCTCATCACCCTCGCACAG | 14897 | AQNPTLITLAQ | 14937 | NPTLITL | 0.655924 | 0.146275 |
| SyS100 | 14858 | GCCCAACCGGGTGGGGTTGACTCCGGCACAG | 14898 | AQPGGGLTPAQ | 14938 | PGGGLTP | 0.591748 | -0.07925 |
| SyS134 | 14859 | GCCCAAGATCGTGATTCTGTGCAGAATGCACAG | 14899 | AQDRDSVQNAQ | 14939 | DRDSVQN | 0.55654 | -0.05483 |
| SyS152 | 14860 | GCCCAACTTAATGGGTTGAATGTGTCTGCACAG | 14900 | AQLNGLNVSAQ | 14940 | LNGLNVS | 0.537505 | -0.02999 |
| SyS68 | 14861 | GCCCAAGCCAAACCAGCAACGACCCCGCACAG | 14901 | AQAQTSNDPAQ | 14941 | AQTSNDP | 0.669325 | 0.289379 |
| SyS137 | 14862 | GCCCAATCTGCGCTAATGTGACTATTGCACAG | 14902 | AQSAPNVTIAQ | 14942 | SAPNVTI | 0.551278 | 0.041441 |
| SyS129 | 14863 | GCCCAACCCAACATGAGCGCCATGATCGCACAG | 14903 | AQPNMSAMIAQ | 14943 | PNMSAMI | 0.559451 | 0.270198 |
| GS64 | 14864 | GCCCAATACAGCGCCGACAAAACCACCGCACAG | 14904 | AQYSADKTTAQ | 14944 | YSADKTT | 0.583168 | 0.057165 |

FIG. 34

| | | | | | | | | |
|---|---|---|---|---|---|---|---|---|
| SyS48 | 14865 | GCCCAACGTGTGGATGCGGTTTGAGTGCACAG | 14905 | AQRVDAVLSAQ | 14945 | RVDAVLS | 0.750458 | 0.650222 |
| SyS138 | 14866 | GCCCAAGGCACCGCCGCCGTCTTCACCGCCGCACAG | 14906 | AQGTAVFTAAQ | 14946 | GTAVFTA | 0.549912 | 0.15966 |
| SyS83 | 14867 | GCCCAAACCCTCAGCGCCCTCACCGCACAG | 14907 | AQTLSGALTAQ | 14947 | TLSGALT | 0.628275 | 0.306806 |
| SyS59 | 14868 | GCCCAACACGCCGACAACAGACTCAAAGCACAG | 14908 | AQHADNRLKAQ | 14948 | HADNRLK | 0.714815 | -0.04579 |
| SyS173 | 14869 | GCCCAAACTCAGGGTCCGGGTCCGAAGGCACAG | 14909 | AQTQGPGPKAQ | 14949 | TQGPGPK | 0.522239 | 0.297383 |
| SyS148 | 14870 | GCCCAAGTCGACGCCCTCAGCCACCATGGCACAG | 14910 | AQVDALSHMAQ | 14950 | VDALSHM | 0.539694 | 0.216373 |
| SyS162 | 14871 | GCCCAAACGGAATGATGCGATTCTGAATGCACAG | 14911 | AQRNDAILNAQ | 14951 | RNDAILN | 0.53456 | 0.251531 |
| SP47 | 14872 | GCCCAATTGACGGTGGCGGTTGAGACTGCACAG | 14912 | AQLTVAVETAQ | 14952 | LTVAVET | 0.139972 | -0.05361 |
| SS33 | 14873 | GCCCAAAGCCAAGCCATCGCCCCAAAGCACAG | 14913 | AQSQAIAPKAQ | 14953 | SQAIAPK | 0.51343 | -0.30374 |
| GS29 | 14874 | GCCCAAGTCCTCAGCGTCAACCACCTCGCACAG | 14914 | AQVLSVNHLAQ | 14954 | VLSVNHL | 0.765014 | 0.050802 |
| SyS84 | 14875 | GCCCAAAGCATCTACTACCACACGGAAGCACAG | 14915 | AQSIYYHTEAQ | 14955 | SIYYHTE | 0.618441 | -0.07907 |
| GS45 | 14876 | GCCCAAATGAACATCCTCAGAGAAGTCGCACAG | 14916 | AQMNILREVAQ | 14956 | MNILREV | 0.654097 | -0.09985 |
| GS84 | 14877 | GCCCAAAATATGCTTAAGCAGAGTGAGGCACAG | 14917 | AQNMLKQSEAQ | 14957 | NMLKQSE | 0.537354 | -0.06179 |
| GS113 | 14878 | GCCCAAATTCATGCCCATCAGCGGCGCACAG | 14918 | AQFMPISSAAQ | 14958 | FMPISSA | 0.50124 | -0.12446 |
| GS27 | 14879 | GCCCAAAAAGAATGCTCCGATGCCTGATGCACAG | 14919 | AQKNAPMPDAQ | 14959 | KNAPMPD | 0.772397 | 0.130152 |
| GS117 | 14880 | GCCCAAACCAACTACGACCTCAGAGCCGCACAG | 14920 | AQTNYDLRAAQ | 14960 | TNYDLRA | 0.494623 | -0.03099 |

FIG. 34 (Continued)

| Enrich_rank (within libraries) | SEQ ID NO: | Sequence (for 11 mer AA) | SEQ ID NO: | 11 mer Amino Acid | Liver-mean-enrichment score (log10) |
|---|---|---|---|---|---|
| TS1 | 14961 | GCCCAAAAAGCCTACAGCGGTCCAAGTCGCACAG | 15054 | AQKAYSVQVAQ | 1.15776 |
| TS2 | 14962 | GCCCAAAGAACCGCCAACGCCCTCGGCGCACAG | 15055 | AQRTANALGAQ | 0.802247 |
| TS3 | 14963 | GCCCAAGTGACGGGGGTTCGGATTGGGGCACAG | 15056 | AQVTGVRIGAQ | 0.75699 |
| TS4 | 14964 | GCCCAACCGCGGCCGGTGTGAATGGGGCACAG | 15057 | AQPRPVSNGAQ | 0.7305 |
| TS5 | 14965 | GCCCAATTCAGCGTCACCAGACAAGCCGCACAG | 15058 | AQFSVTRQAAQ | 0.718621 |
| TS6 | 14966 | GCCCAATACCCCACATGACCCACGACGCACAG | 15059 | AQYPHMTHDAQ | 0.655794 |
| TS7 | 14967 | GCCCAAAGCAGCAGACTCAGCGTCGGCGCACAG | 15060 | AQSSRLSVGAQ | 0.637971 |
| TS8 | 14968 | GCCCAACCGTTGAGTGGGGGTGTTCGTGCACAG | 15061 | AQPLSGGVRAQ | 0.598554 |
| TS9 | 14969 | GCCCAAGGGCTGAAGGTGTCTGGGTCTGCACAG | 15062 | AQGLKVSGSAQ | 0.569576 |
| TS10 | 14970 | GCCCAAAGCACCAGAAACGTCGTCGCGCACAG | 15063 | AQSTRNVVGAQ | 0.532567 |
| TS11 | 14971 | GCCCAAAGGCGGCACCAGAGAAGGCGCACAG | 15064 | AQSGGTREGAQ | 0.501512 |
| SyS1 | 14972 | GCCCAAGGGCTGAAGGTGTCTGGGTCTGCACAG | 15065 | AQGLKVSGSAQ | 0.777335 |
| SyS2 | 14973 | GCCCAAAACAACAACCAAAAAGTCTACGCACAG | 15066 | AQNNNQKVYAQ | 0.610002 |
| SyS3 | 14974 | GCCCAAAGGCTTGATAGGACTGGTTTGGCACAG | 15067 | AQRLDRTGLAQ | 0.585542 |
| SyS4 | 14975 | GCCCAAGTGGCGGGGTCTGACTGTTCAGGCACAG | 15068 | AQVAGLTVQAQ | 0.581695 |
| SyS5 | 14976 | GCCCAACATTCTGCGAAGACTATTGCGGCACAG | 15069 | AQHSAKTIAAQ | 0.579949 |
| SyS6 | 14977 | GCCCAAAGCATCAGAGCCCCGTCAGCGCACAG | 15070 | AQSIRAPVSAQ | 0.572426 |
| SyS7 | 14978 | GCCCAACCGTCGGCACCAGAACCAGCGCACAG | 15071 | AQPVGTRTSAQ | 0.560759 |
| SyS8 | 14979 | GCCCAAATCAACACCGCCAGCTACAAAGCACAG | 15072 | AQINTASYKAQ | 0.542125 |
| SyS9 | 14980 | GCCCAAGGGAGGACGGTGCAGGATAGGGCACAG | 15073 | AQGRTVQDRAQ | 0.528631 |
| SyS10 | 14981 | GCCCAAAGACTCACCAACAGCAACCAAGCACAG | 15074 | AQRLTNSNQAQ | 0.516161 |
| SyS11 | 14982 | GCCCAAATGATCAGAGGCACCAGCAGCGCACAG | 15075 | AQMIRGTSSAQ | 0.512891 |

FIG. 35

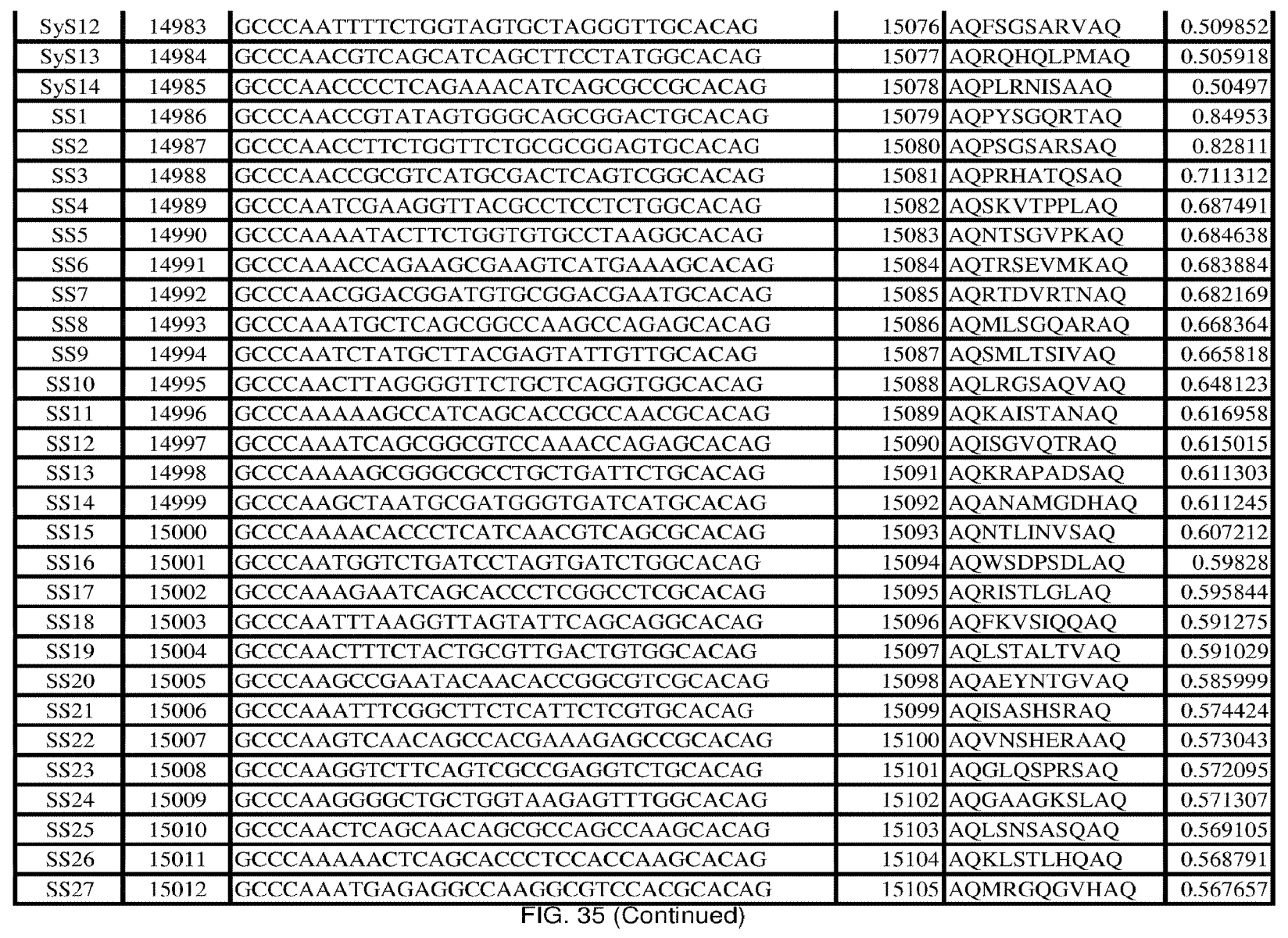

| | | | | | |
|---|---|---|---|---|---|
| SyS12 | 14983 | GCCCAATTTCTGGTAGTGCTAGGGTTGCACAG | 15076 | AQFSGSARVAQ | 0.509852 |
| SyS13 | 14984 | GCCCAACGTCAGCATCAGCTTCCTATGGCACAG | 15077 | AQRQHQLPMAQ | 0.505918 |
| SyS14 | 14985 | GCCCAACCCTCAGAAACATCAGCGCCGCACAG | 15078 | AQPLRNISAAQ | 0.50497 |
| SS1 | 14986 | GCCCAACGTATAGTGGGCAGCGGACTGCACAG | 15079 | AQPYSGQRTAQ | 0.84953 |
| SS2 | 14987 | GCCCAACCTTCTGGTTCTCCGCGGAGTGCACAG | 15080 | AQPSGSARSAQ | 0.82811 |
| SS3 | 14988 | GCCCAACCGCGTCATGCGACTCAGTCGGCACAG | 15081 | AQPRHATQSAQ | 0.711312 |
| SS4 | 14989 | GCCCAATCGAAGGTTACGCCTCCTCTGGCACAG | 15082 | AQSKVTPPLAQ | 0.687491 |
| SS5 | 14990 | GCCCAAAATACTTCTGGTGTGCTAAGGCACAG | 15083 | AQNTSGVPKAQ | 0.684638 |
| SS6 | 14991 | GCCCAAACCAGAAGCGAAGTCATGAAAGCACAG | 15084 | AQTRSEVMKAQ | 0.683884 |
| SS7 | 14992 | GCCCAACGGACGGATGTGCGGACGAATGCACAG | 15085 | AQRTDVRTNAQ | 0.682169 |
| SS8 | 14993 | GCCCAAATGCTCAGCGGCCAAGCCAGAGCACAG | 15086 | AQMLSGQARAQ | 0.668364 |
| SS9 | 14994 | GCCCAATCTATGCTTACGAGTATTGTTGCACAG | 15087 | AQSMLTSIVAQ | 0.665818 |
| SS10 | 14995 | GCCCAACTTAGGGGTTCTGCTCAGGTGGCACAG | 15088 | AQLRGSAQVAQ | 0.648123 |
| SS11 | 14996 | GCCCAAAAAGCCATCAGCACCGCCAACGCACAG | 15089 | AQKAISTANAQ | 0.616958 |
| SS12 | 14997 | GCCCAAATCAGCGGCGTCCAAACCAGAGCACAG | 15090 | AQISGVQTRAQ | 0.615015 |
| SS13 | 14998 | GCCCAAAAGCGGCGGCGCCTGCTGATTCTGCACAG | 15091 | AQKRAPADSAQ | 0.611303 |
| SS14 | 14999 | GCCCAAGCTAATGCGATGGGTGATCATGCACAG | 15092 | AQANAMGDHAQ | 0.611245 |
| SS15 | 15000 | GCCCAAAAACACCCTCATCAACGTCAGCGCACAG | 15093 | AQNTLINVSAQ | 0.607212 |
| SS16 | 15001 | GCCCAATGGTCTGATCTCTAGTGATCTGGCACAG | 15094 | AQWSDPSDLAQ | 0.59828 |
| SS17 | 15002 | GCCCAAAGAATCAGCACCCTCGGCCTCGCACAG | 15095 | AQRISTLGLAQ | 0.595844 |
| SS18 | 15003 | GCCCAATTTAAGGTTAGTATTCAGCAGGCACAG | 15096 | AQFKVSIQQAQ | 0.591275 |
| SS19 | 15004 | GCCCAACTTTCTACTGCGTTGACTGTGGCACAG | 15097 | AQLSTALTVAQ | 0.591029 |
| SS20 | 15005 | GCCCAAGCCGAATACAACACCGGCGTCGCACAG | 15098 | AQAEYNTGVAQ | 0.585999 |
| SS21 | 15006 | GCCCAAATTTCGGCTTCTCATTCTCGTGCACAG | 15099 | AQISASHSRAQ | 0.574424 |
| SS22 | 15007 | GCCCAAGTCAACAGCCACGAAAGAGCCGCACAG | 15100 | AQVNSHERAAQ | 0.573043 |
| SS23 | 15008 | GCCCAAGGTCTTCAGTCGCCGAGGTCTGCACAG | 15101 | AQGLQSPRSAQ | 0.572095 |
| SS24 | 15009 | GCCCAAGGGGCTGCTGGTAAGAGTTTGGCACAG | 15102 | AQGAAGKSLAQ | 0.571307 |
| SS25 | 15010 | GCCCAACTCAGCAACAGCGCCAAGCACACAG | 15103 | AQLSNSASQAQ | 0.569105 |
| SS26 | 15011 | GCCCAAAAACTCAGCACCCTCCACCAAGCACAG | 15104 | AQKLSTLHQAQ | 0.568791 |
| SS27 | 15012 | GCCCAATGAGAGAGGCCAAGGCGTCCACGCACAG | 15105 | AQMRGQGVHAQ | 0.567657 |

FIG. 35 (Continued)

| | | | | | |
|---|---|---|---|---|---|
| SS28 | 15013 | GCCCAACTTCCGGGTGGTGCCGAGGTTGGCACAG | 15106 | AQLPGGARLAQ | 0.564086 |
| SS29 | 15014 | GCCCAACTTGGTTCTGCGCTTACGAGGGCACAG | 15107 | AQLGSALTRAQ | 0.563314 |
| SS30 | 15015 | GCCCAAGGCACCACCAGAAGCCCCACCGCACAG | 15108 | AQGTTRSPTAQ | 0.560705 |
| SS31 | 15016 | GCCCAAGGTCATATTTCGGCGCTTGCGGCACAG | 15109 | AQGHISALAAQ | 0.552655 |
| SS32 | 15017 | GCCCAATCGATTTCCTCCTCGTACGGCACAG | 15110 | AQSISPPRTAQ | 0.550578 |
| SS33 | 15018 | GCCCAATTTCAGCAGGATACTTATCTGGCACAG | 15111 | AQFQQDTYLAQ | 0.548808 |
| SS34 | 15019 | GCCCAACTTCTTGCGACTGGGCTTAAGGCACAG | 15112 | AQLLATGLKAQ | 0.545453 |
| SS35 | 15020 | GCCCAACTTAAGGTTGCGTCTGGTTTGGCACAG | 15113 | AQLKVASGLAQ | 0.540598 |
| SS36 | 15021 | GCCCAATTCGACAACCCAACAACGTCGCACAG | 15114 | AQFDNPNNVAQ | 0.539231 |
| SS37 | 15022 | GCCCAATACCTCACCAGCGGCGGCTACGCACAG | 15115 | AQYLTSGGYAQ | 0.538789 |
| SS38 | 15023 | GCCCAAAGAGACACCGTCAGCAGATACGCACAG | 15116 | AQRDTVSRYAQ | 0.535765 |
| SS39 | 15024 | GCCCAAATCAACAAAGACAACAACCAAGCACAG | 15117 | AQINKDNNQAQ | 0.531458 |
| SS40 | 15025 | GCCCAAATGGCCAACCACCAGAAGCGCCGCACAG | 15118 | AQMANTRSAAQ | 0.525721 |
| SS41 | 15026 | GCCCAAGAAAGCATCCAACAACTCAGCGCACAG | 15119 | AQESIQQLSAQ | 0.525712 |
| SS42 | 15027 | GCCCAACTCACCAGAGTCGGCACCGTCGCACAG | 15120 | AQLTRVGTVAQ | 0.520831 |
| SS43 | 15028 | GCCCAAGTCAAGTCGCGCCATGAGAGCCGCACAG | 15121 | AQVQVAMRAAQ | 0.520831 |
| SS44 | 15029 | GCCCAAACGGCTGCGCATGTTAGTTATGCACAG | 15122 | AQTAAHVSYAQ | 0.520336 |
| SS45 | 15030 | GCCCAACCCAGCAGCGCCAGAGCCAGCGCACAG | 15123 | AQPSHARASAQ | 0.520336 |
| SS46 | 15031 | GCCCAAAAATGTGCCGACTTCGCGGGGCACAG | 15124 | AQNVPTSPRAQ | 0.520245 |
| SS47 | 15032 | GCCCAAAAAACCCAACTCGGCCAAATGGCACAG | 15125 | AQKTQLGQMAQ | 0.519843 |
| SS48 | 15033 | GCCCAAAAAGCCAACAGCCAAATCACCGCACAG | 15126 | AQKANSQITAQ | 0.519425 |
| SS49 | 15034 | GCCCAAAACAACAGCGGCCACATCAGCGCACAG | 15127 | AQNNSGHISAQ | 0.518228 |
| SS50 | 15035 | GCCCAATTTCTTCTTACTTCGGATCCGGCACAG | 15128 | AQFLLTSDPAQ | 0.515975 |
| SS51 | 15036 | GCCCAAGTTAAGACTGATCGGGTTCTGCACAG | 15129 | AQVKTDRVLAQ | 0.51183 |
| SS52 | 15037 | GCCCAAGTCAGCATCAGCGTCATGGGGCACAG | 15130 | AQVSISVMGAQ | 0.510987 |
| SS53 | 15038 | GCCCAAGCCGGCCTCGCCCACGCCACCGCACAG | 15131 | AQAGLAHATAQ | 0.510068 |
| SS54 | 15039 | GCCCAACGGACTACGGCTAATTCGCTTGCACAG | 15132 | AQRTTANSLAQ | 0.509233 |
| SS55 | 15040 | GCCCAATCGGTTCCTCCGAATAGGAATGCACAG | 15133 | AQSVPPNRNAQ | 0.508166 |
| SS56 | 15041 | GCCCAACACAGCGGCCCCACCAGCAGCGCACAG | 15134 | AQHSGPTSSAQ | 0.505295 |
| SS57 | 15042 | GCCCAAAAACCAACAACAACACCGTTCCTCGCACAG | 15135 | AQKTNNTVLAQ | 0.504377 |

FIG. 35 (Continued)

| | | | | |
|---|---|---|---|---|
| SS58 | 15043 | GCCCAACCCGCCAGAATCCCCGGCAGCGCACAG | 15136 | AQPARIPGSAQ | 0.50309 |
| SS59 | 15044 | GCCCAATTGTCTGCTCAGCTTCCGCGGGCACAG | 15137 | AQLSAQLPRAQ | 0.503052 |
| SS60 | 15045 | GCCCAAGTTGGTTCTAGTAATACGTATGCACAG | 15138 | AQVGSSNTYAQ | 0.502229 |
| SS61 | 15046 | GCCCAACTCATCAGCACCACCACAGAGCACAG | 15139 | AQLISTTHRAQ | 0.502083 |
| GS1 | 15047 | GCCCAATATGTTAATAGTGCTCCGAAGGCACAG | 15140 | AQYVNSAPKAQ | 0.551681 |
| GS2 | 15048 | GCCCAAAACAACAACCAAAAGTCTACGCACAG | 15141 | AQNNNQKVYAQ | 0.532399 |
| Gs3 | 15049 | GCCCAAGGCACCAAACCCACAGCCTCGCACAG | 15142 | AQGTKTHSLAQ | 0.518459 |
| GS4 | 15050 | GCCCAACCCATCAGCGCCAACAGACTCGCACAG | 15143 | AQPISANRLAQ | 0.512571 |
| GS5 | 15051 | GCCCAACACCCCAGCCTCAGACAAAGGCACAG | 15144 | AQHPSLRQSAQ | 0.508478 |
| GS6 | 15052 | GCCCAACCCCAACAGAGCGCCAACAACGCACAG | 15145 | AQPNRAANNAQ | 0.508143 |
| GS7 | 15053 | GCCCAACCCAGCCACGCCAGAGCCAGCGCACAG | 15146 | AQPSHARASAQ | 0.504054 |

FIG. 35 (Continued)

Acceptor Vector: rAAV-ΔCap-in-cis-lox2
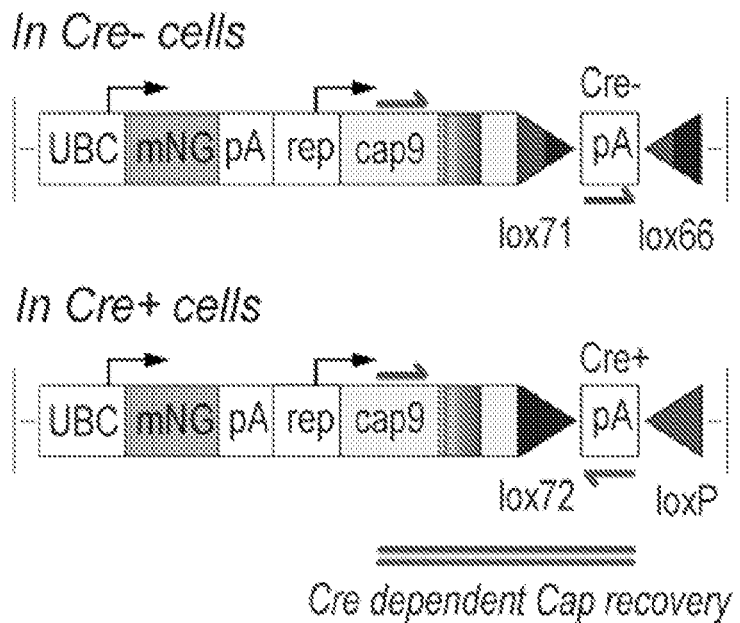
Rep-AAPΔCap Vector: Rep-AAP-ΔCap-in-trans
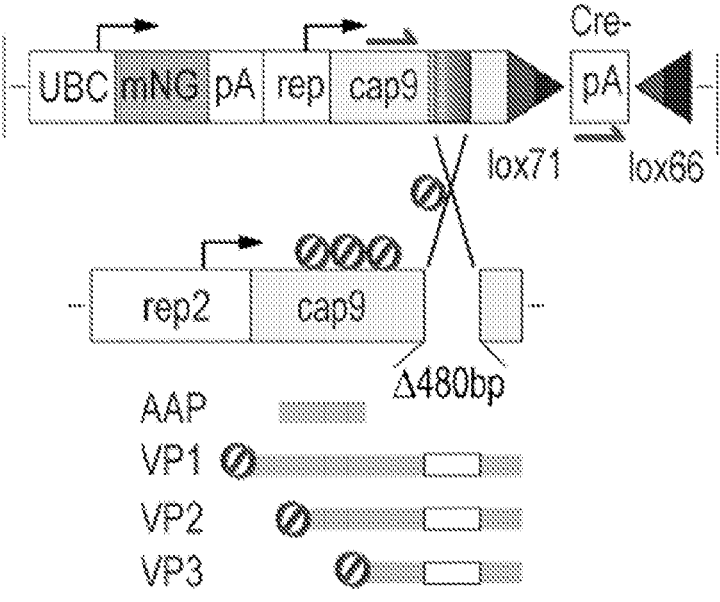
FIG. 36

Selective recovery of AAV genome in Cre+ cells using conventional PCR.

Process the recovered AAV genome for deep sequencing (NGS) by adding Read and Adaptor Sequences along with unique Barcodes (6 bases single barcode or 8 bases dual barcode).

Multiplexed AAV library analysis by deep sequencing all libraries with unique barcodes.

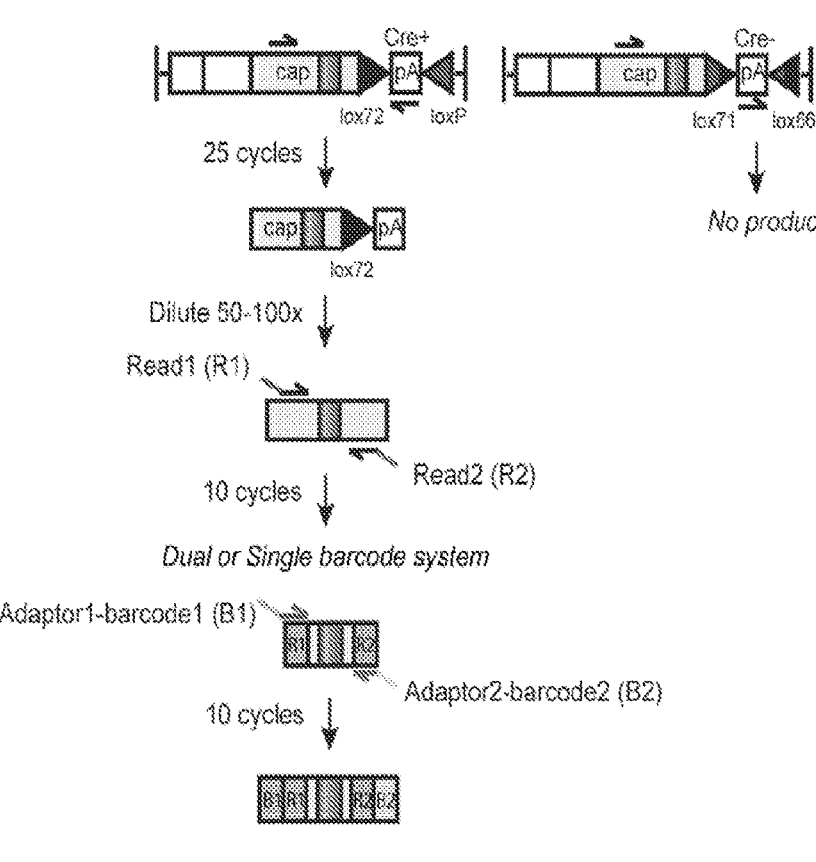

25 cycles

No product

Dilute 50-100x

Read1 (R1)
Read2 (R2)

10 cycles

Dual or Single barcode system

Adaptor1-barcode1 (B1)
Adaptor2-barcode2 (B2)

10 cycles

Deep Sequencing

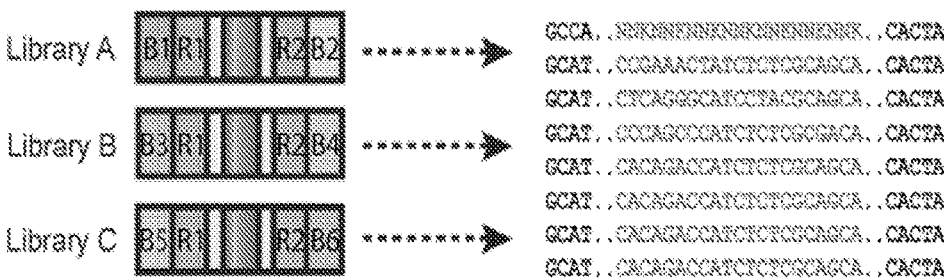

Library A
Library B
Library C

FIG. 37

*Library coverage*

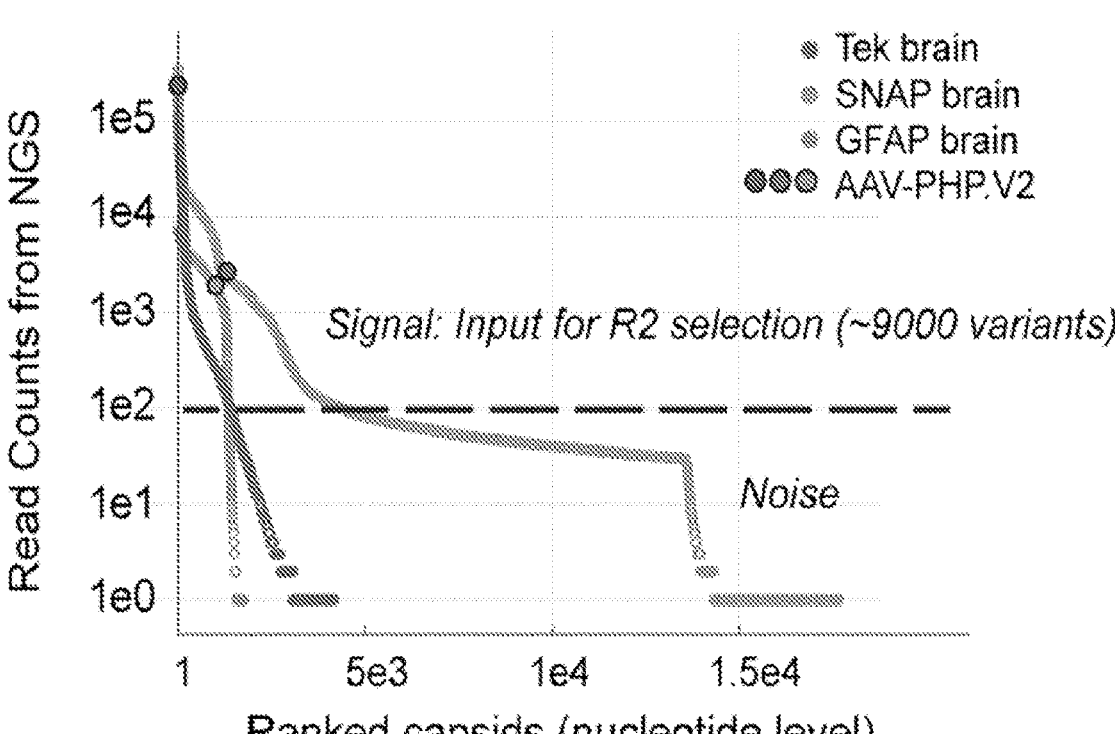
FIG. 40
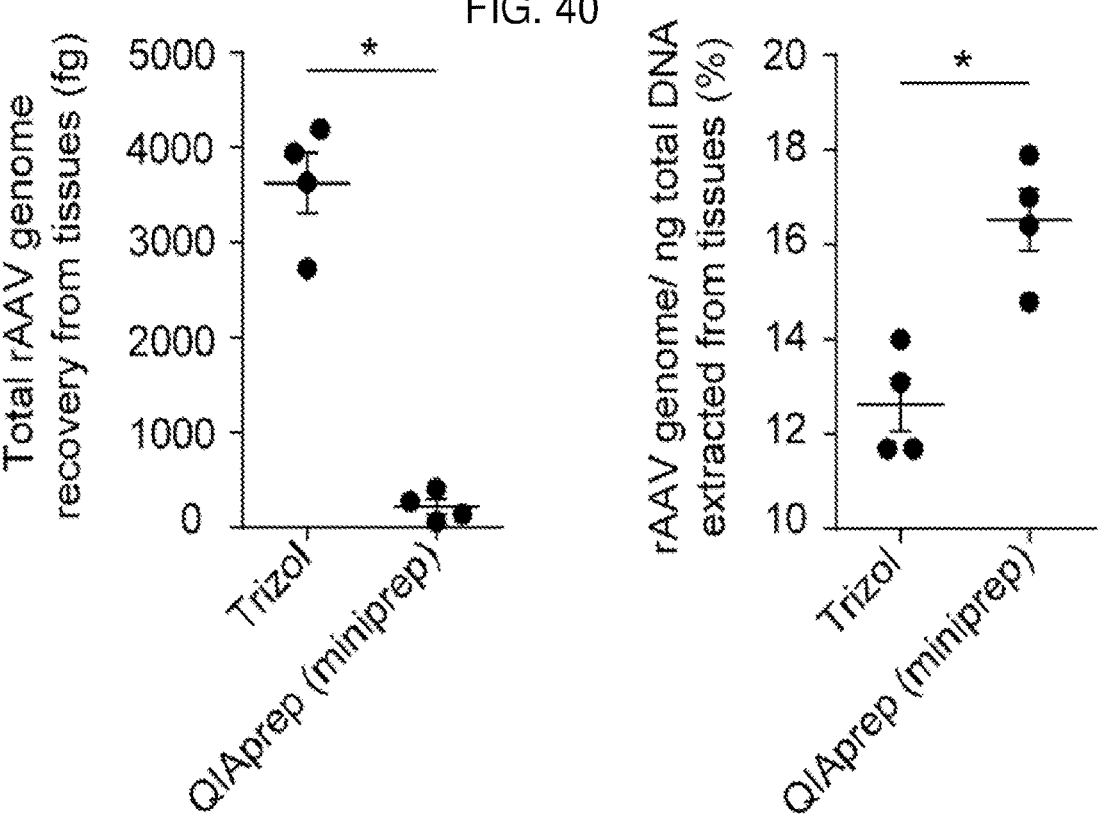
FIG. 41                                             FIG. 42

PCR pool

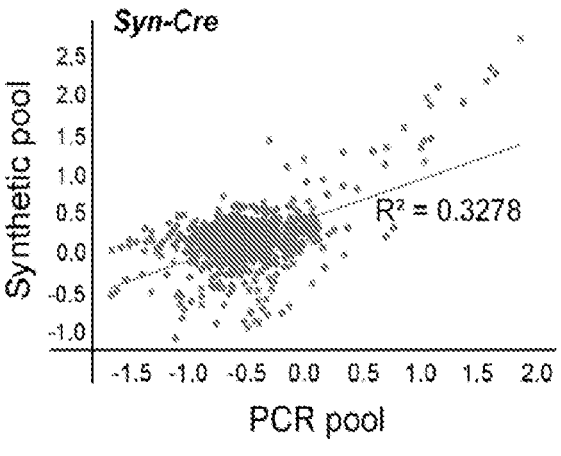
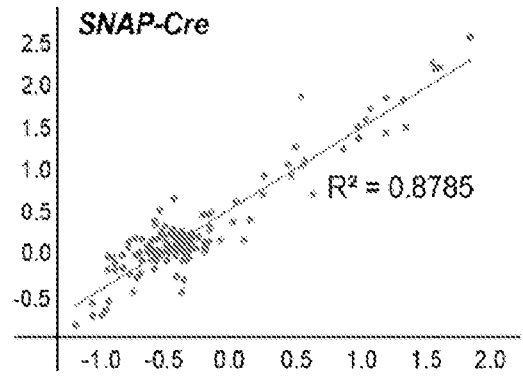
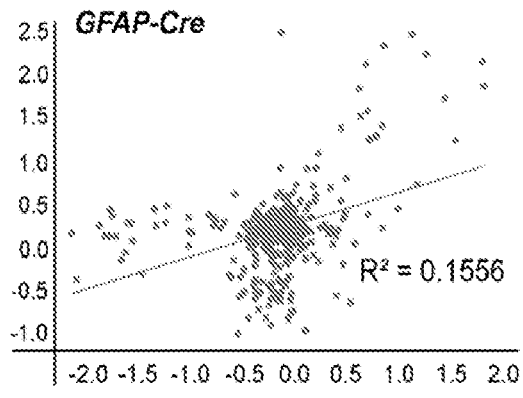
FIG. 49
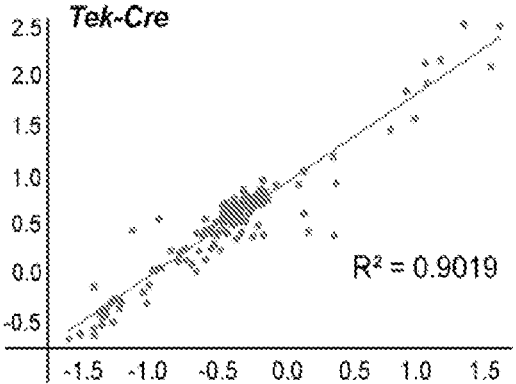

FIG. 53 (Continued)

*ssAAV-PHP.V1: Ple261-iCre*          *scAAV-PHP.V1: CB6/ CAG-EGFP*

Specific vascular cell transduction by ssAAV- and scAAV-PHP.V1

FIG. 58

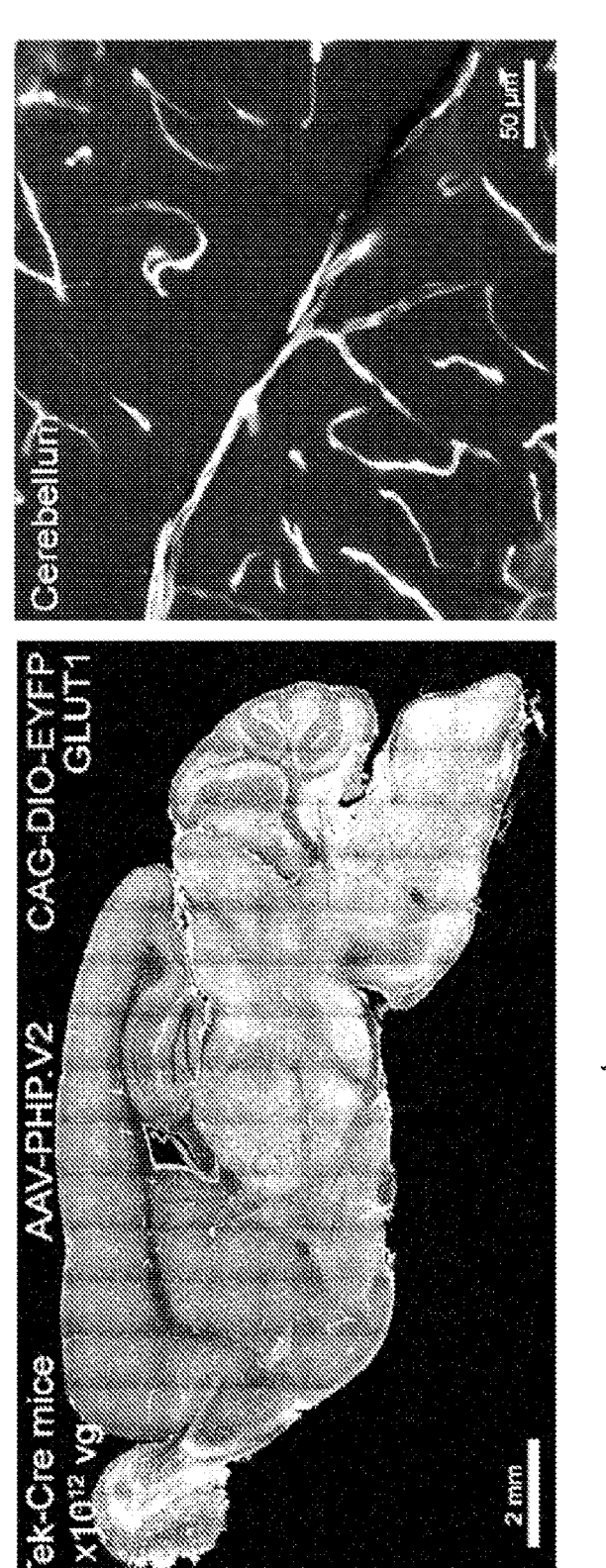
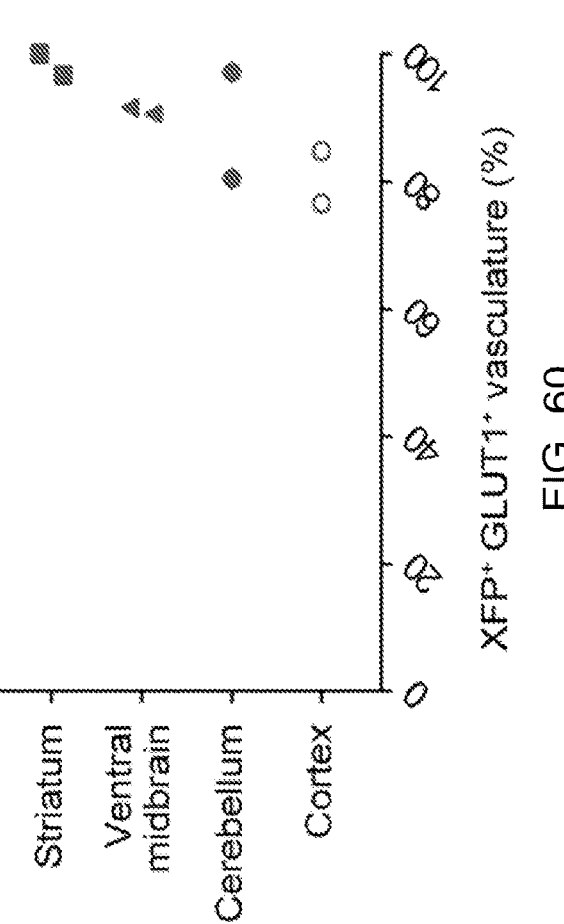
FIG. 60

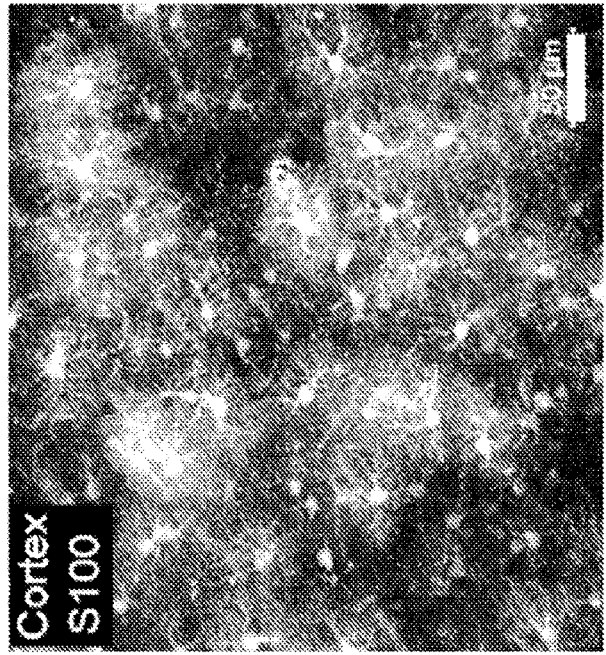
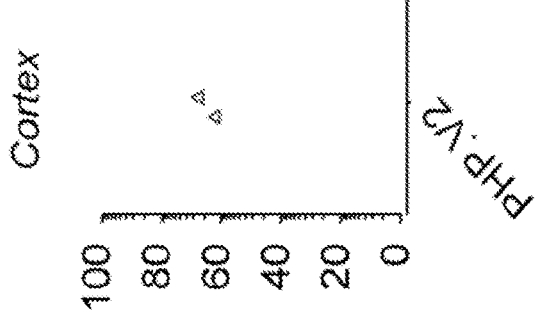
FIG. 61

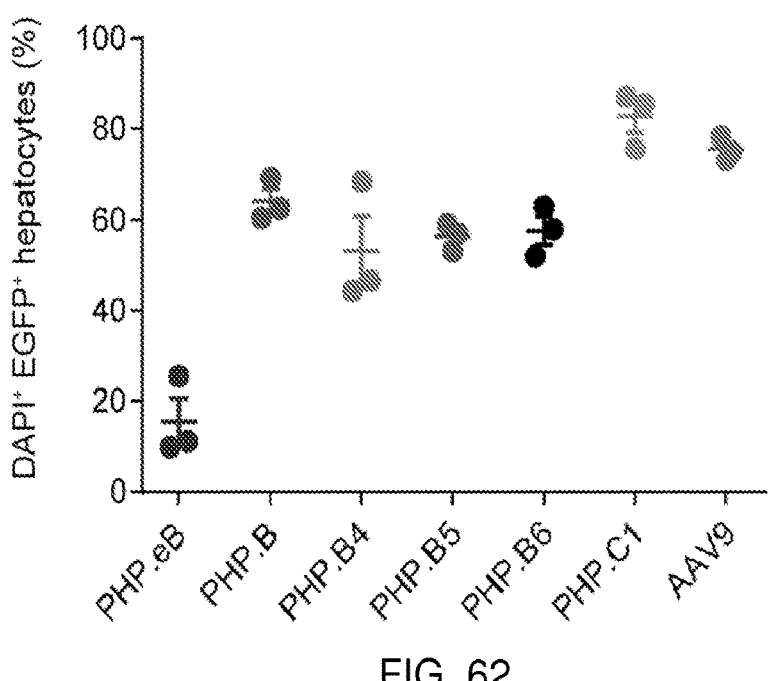
Liver hepatocytes
$1 \times 10^{11}$ vg/adult C57BL/6J
FIG. 62
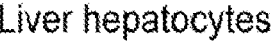
Synthetic pool: Positively enriched variants
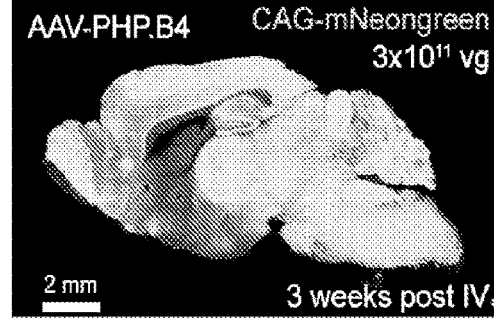
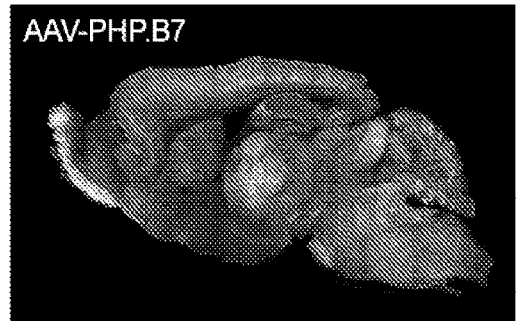
Synthetic pool: Negatively enriched variants
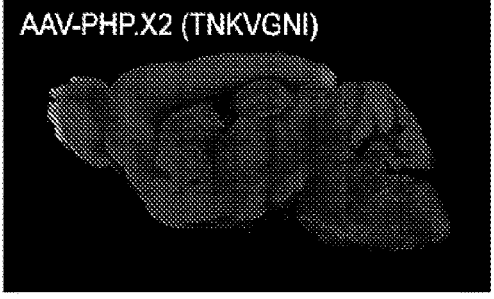
FIG. 63

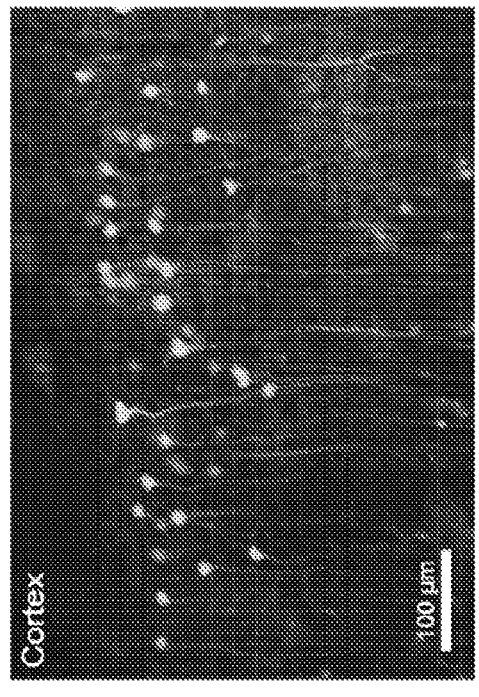
FIG. 64

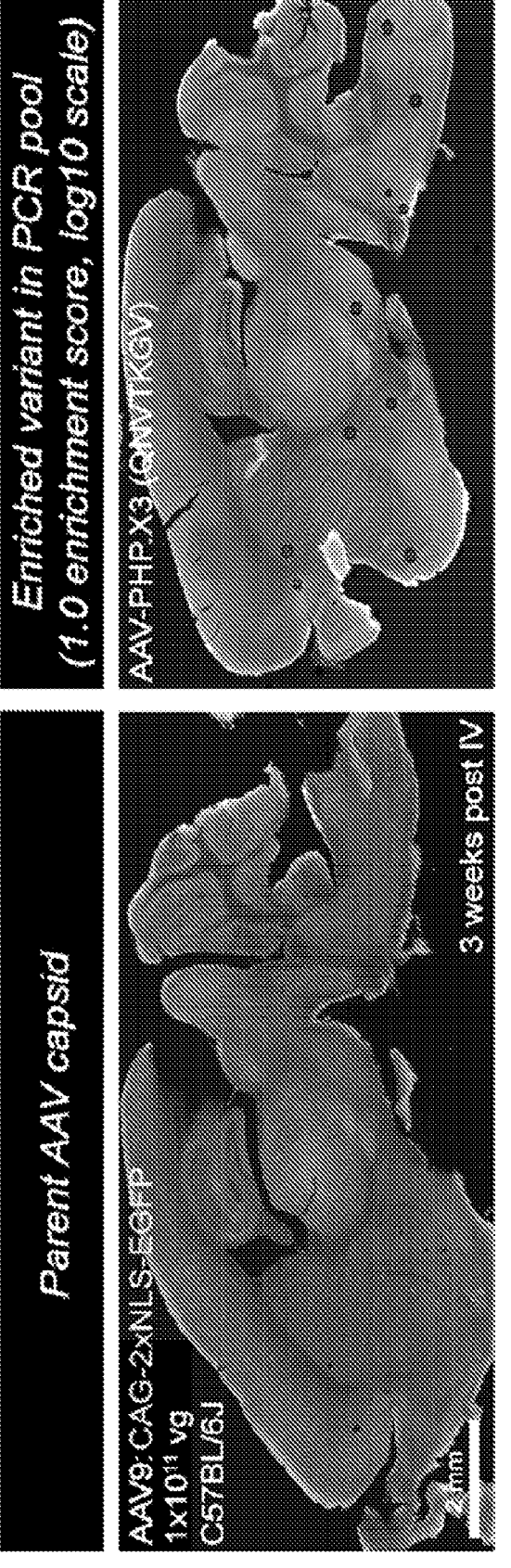
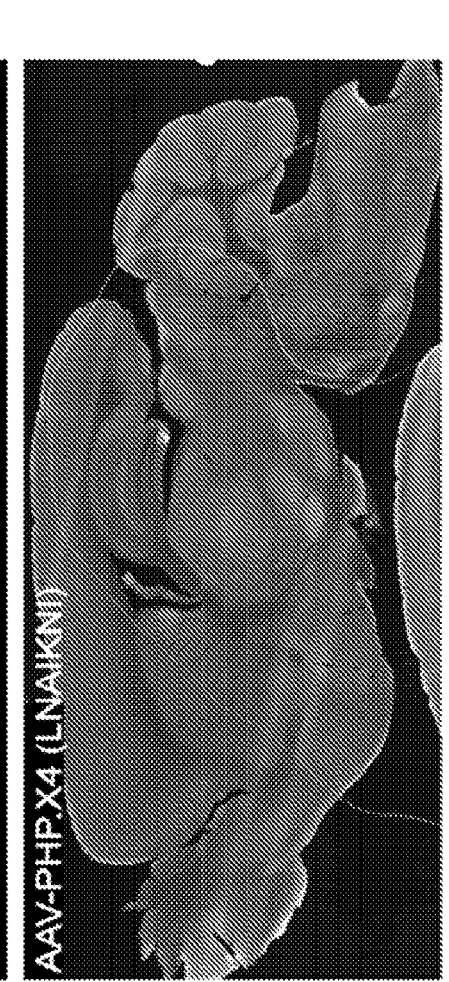
FIG. 65

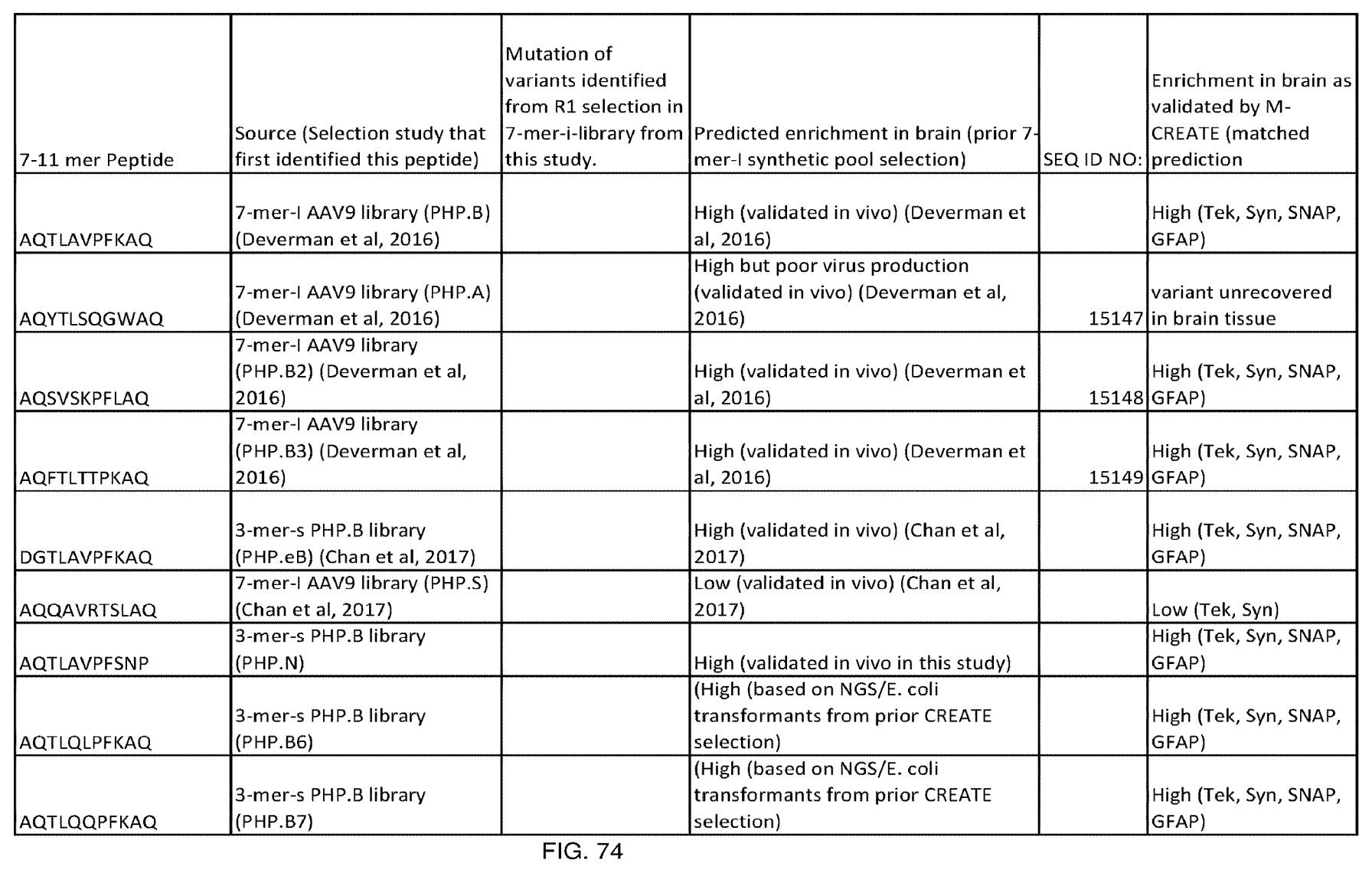

| 7-11 mer Peptide | Source (Selection study that first identified this peptide) | Mutation of variants identified from R1 selection in 7-mer-i-library from this study. | Predicted enrichment in brain (prior 7-mer-i synthetic pool selection) | SEQ ID NO: | Enrichment in brain as validated by M-CREATE (matched prediction) |
|---|---|---|---|---|---|
| AQTLAVPFKAQ | 7-mer-I AAV9 library (PHP.B) (Deverman et al, 2016) | | High (validated in vivo) (Deverman et al, 2016) | | High (Tek, Syn, SNAP, GFAP) |
| AQYTLSQGWAQ | 7-mer-I AAV9 library (PHP.A) (Deverman et al, 2016) | | High but poor virus production (validated in vivo) (Deverman et al, 2016) | 15147 | variant unrecovered in brain tissue |
| AQSVSKPFLAQ | 7-mer-I AAV9 library (PHP.B2) (Deverman et al, 2016) | | High (validated in vivo) (Deverman et al, 2016) | 15148 | High (Tek, Syn, SNAP, GFAP) |
| AQFTLTTPKAQ | 7-mer-I AAV9 library (PHP.B3) (Deverman et al, 2016) | | High (validated in vivo) (Deverman et al, 2016) | 15149 | High (Tek, Syn, SNAP, GFAP) |
| DGTLAVPFKAQ | 3-mer-s PHP.B library (PHP.eB) (Chan et al, 2017) | | High (validated in vivo) (Chan et al, 2017) | | High (Tek, Syn, SNAP, GFAP) |
| AQQAVRTSLAQ | 7-mer-I AAV9 library (PHP.S) (Chan et al, 2017) | | Low (validated in vivo) (Chan et al, 2017) | | Low (Tek, Syn) |
| AQTLAVPFSNP | 3-mer-s PHP.B library (PHP.N) | | High (validated in vivo in this study) | | High (Tek, Syn, SNAP, GFAP) |
| AQTLQLPFKAQ | 3-mer-s PHP.B library (PHP.B6) | | (High (based on NGS/E. coli transformants from prior CREATE selection) | | High (Tek, Syn, SNAP, GFAP) |
| AQTLQQPFKAQ | 3-mer-s PHP.B library (PHP.B7) | | (High (based on NGS/E. coli transformants from prior CREATE selection) | | High (Tek, Syn, SNAP, GFAP) |

FIG. 74

| Sequence | Source | Description | Expression | SEQ ID | Variant recovery in brain tissue |
|---|---|---|---|---|---|
| DGTTLKPFLAQ | Current study | "AQ" on PHP.V2 substituted with "DG" | Unknown | | variant unrecovered in brain tissue |
| DGTALKPFLAQ | Current study | "AQ" on PHP.V1 substituted with "DG" | Unknown | | High (Syn, GFAP) |
| DGTTLKPFSNP | Current study | "AQ" on PHP.V2 substituted with "DG" and "LAQ" substituted with "SNP" | Unknown | | Low (Syn) |
| AQTTLKPFSNP | Current study | "LAQ" on PHP.V2 substituted with "SNP" | Unknown | | High (Tek, Syn, SNAP, GFAP) |
| ESTLAVPFKAQ | 3-mer-s PHP.B library | | (High (based on NGS/E. coli transformants from prior CREATE selection) | 15150 | High (Tek, Syn, SNAP, GFAP) |
| GGTLAVPFKAQ | 3-mer-s PHP.B library | | (High (based on NGS/E. coli transformants from prior CREATE selection) | 15151 | High (Tek, Syn, SNAP, GFAP) |
| AQTLATPFKAQ | 3-mer-s PHP.B library | | (High (based on NGS/E. coli transformants from prior CREATE selection) | 15152 | High (Syn, SNAP, GFAP) |
| ATTLATPFKAQ | 3-mer-s PHP.B library | | (High (based on NGS/E. coli transformants from prior CREATE selection) | 15153 | High (Tek, Syn, SNAP, GFAP) |
| DGTLATPFKAQ | 3-mer-s PHP.B library | | (High (based on NGS/E. coli transformants from prior CREATE selection) | 15154 | High (Tek, Syn, SNAP, GFAP) |
| GGTLATPFKAQ | 3-mer-s PHP.B library | | (High (based on NGS/E. coli transformants from prior CREATE selection) | 15155 | High (Tek, Syn, SNAP, GFAP) |

FIG. 74 (Continued)

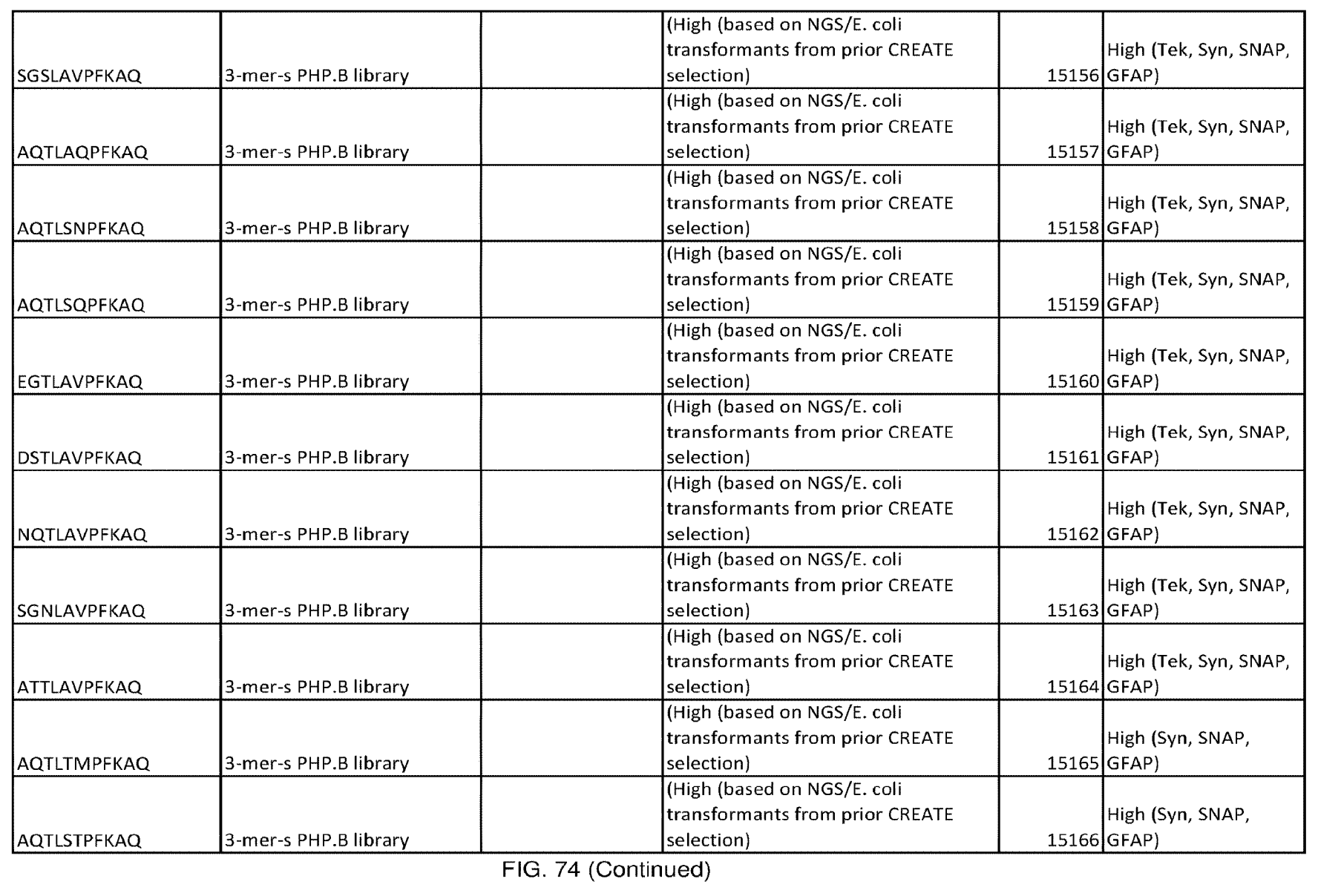

| | | | |
|---|---|---|---|
| SGSLAVPFKAQ | 3-mer-s PHP.B library | (High (based on NGS/E. coli transformants from prior CREATE selection) | High (Tek, Syn, SNAP, GFAP) 15156 |
| AQTLAQPFKAQ | 3-mer-s PHP.B library | (High (based on NGS/E. coli transformants from prior CREATE selection) | High (Tek, Syn, SNAP, GFAP) 15157 |
| AQTLSNPFKAQ | 3-mer-s PHP.B library | (High (based on NGS/E. coli transformants from prior CREATE selection) | High (Tek, Syn, SNAP, GFAP) 15158 |
| AQTLSQPFKAQ | 3-mer-s PHP.B library | (High (based on NGS/E. coli transformants from prior CREATE selection) | High (Tek, Syn, SNAP, GFAP) 15159 |
| EGTLAVPFKAQ | 3-mer-s PHP.B library | (High (based on NGS/E. coli transformants from prior CREATE selection) | High (Tek, Syn, SNAP, GFAP) 15160 |
| DSTLAVPFKAQ | 3-mer-s PHP.B library | (High (based on NGS/E. coli transformants from prior CREATE selection) | High (Tek, Syn, SNAP, GFAP) 15161 |
| NQTLAVPFKAQ | 3-mer-s PHP.B library | (High (based on NGS/E. coli transformants from prior CREATE selection) | High (Tek, Syn, SNAP, GFAP) 15162 |
| SGNLAVPFKAQ | 3-mer-s PHP.B library | (High (based on NGS/E. coli transformants from prior CREATE selection) | High (Tek, Syn, SNAP, GFAP) 15163 |
| ATTLAVPFKAQ | 3-mer-s PHP.B library | (High (based on NGS/E. coli transformants from prior CREATE selection) | High (Tek, Syn, SNAP, GFAP) 15164 |
| AQTLTMPFKAQ | 3-mer-s PHP.B library | (High (based on NGS/E. coli transformants from prior CREATE selection) | High (Syn, SNAP, GFAP) 15165 |
| AQTLSTPFKAQ | 3-mer-s PHP.B library | (High (based on NGS/E. coli transformants from prior CREATE selection) | High (Syn, SNAP, GFAP) 15166 |

FIG. 74 (Continued)

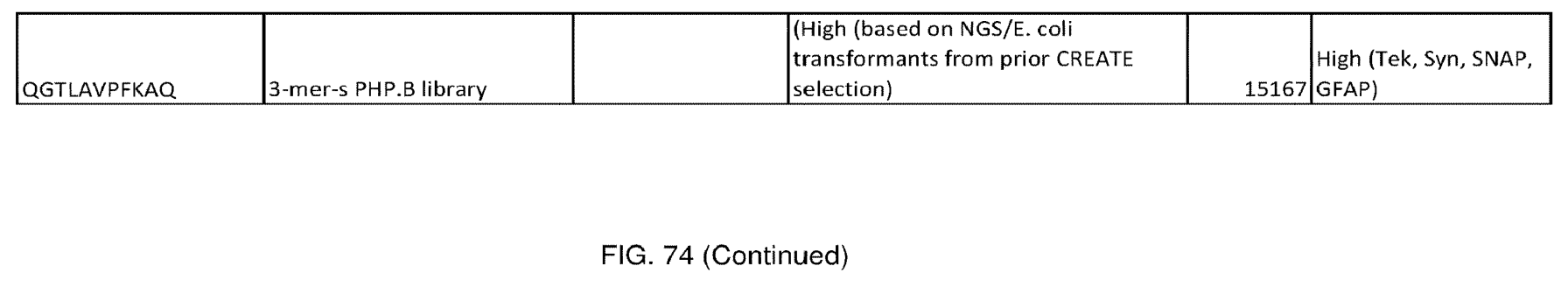

| QGTLAVPFKAQ | 3-mer-s PHP.B library | (High (based on NGS/E. coli transformants from prior CREATE selection) | 15167 | High (Tek, Syn, SNAP, GFAP) |

FIG. 74 (Continued)

| SEQ ID | 7-11 mer Peptide | Source (Selection study that first identified this peptide) | Mutation of variants identified from R1 selection in 7-mer-i library from this study. | Predicted enrichment in brain (prior 7-mer-i synthetic pool selection) | Enrichment in brain as validated by M-CREATE (against prediction) | Enrichment in brain as validated by M-CREATE (matched prediction) |
|---|---|---|---|---|---|---|
| | AQTLAVPFKAQ | 7-mer-i AAV9 library (PHP.B) (Deverman et al, 2016) | | High (validated in vivo) (Deverman et al, 2016) | | High (Tek, Syn, SNAP, GFAP) |
| | AQYTLSQGWAQ | 7-mer-i AAV9 library (PHP.A) (Deverman et al, 2016) | | High but poor virus production (validated in vivo) (Deverman et al, 2016) | | variant unrecovered in brain tissue |
| | AQSVSKPFLAQ | 7-mer-i AAV9 library (PHP.B2) (Deverman et al, 2016) | | High (validated in vivo) (Deverman et al, 2016) | | High (Tek, Syn, SNAP, GFAP) |
| | AQFTLTTPKAQ | 7-mer-i AAV9 library (PHP.B3) (Deverman et al, 2016) | | High (validated in vivo) (Deverman et al, 2016) | | High (Tek, Syn, SNAP, GFAP) |
| | DGTLAVPFKAQ | 3-mer-s PHP.B library (PHP.eB) (Chan et al, 2017) | | High (validated in vivo) (Chan et al, 2017) | | High (Tek, Syn, SNAP, GFAP) |
| | AQQAVRTSLAQ | 7-mer-i AAV9 library (PHP.S) (Chan et al, 2017) | | Low (validated in vivo) (Chan et al, 2017) | | Low (Tek, Syn) |
| | AQTLAVPFSNP | 3-mer-s PHP.B library (PHP.N) | | High (validated in vivo in this study) | | High (Tek, Syn, SNAP, GFAP) |

FIG. 75

| Peptide | Source | Notes | Production | Tropism |
|---|---|---|---|---|
| AQTLQLPFKAQ | 3-mer-s PHP.B library (PHP.B6) | | High (based on NGS/E.coli transformants from prior CREATE selection) | High (Tek, Syn, SNAP, GFAP) |
| AQTLQQPFKAQ | 3-mer-s PHP.B library (PHP.B7) | | High (based on NGS/E.coli transformants from prior CREATE selection) | High (Tek, Syn, SNAP, GFAP) |
| DGTTLKPFLAQ | Current study (New design inspired from previously identified peptides) | "AQ" on PHP.V2 substituted with "DG" | Unknown | variant unrecovered in brain tissue |
| DGTALKPFLAQ | Current study (New design inspired from previously identified peptides) | "AQ" on PHP.V1 substituted with "DG" | Unknown | High (Syn, GFAP) |
| DGTTLKPFSNP | Current study (New design inspired from previously identified peptides) | "AQ" on PHP.V2 substituted with "DG" and "LAQ" substituted with "SNP" | Unknown | |
| AQTTLKPFSNP | design inspired from | PHP.V2 | Unknown | Low (Syn) |
| ESTLAVPFKAQ | 3-mer-s PHP.B library | | High (based on NGS/E.coli transformants from prior CREATE selection) | SNAP, GFAP |
| GGTLAVPFKAQ | 3-mer-s PHP.B library | | High (based on NGS/E.coli transformants from prior CREATE selection) | High (Tek, Syn, SNAP, GFAP) |

FIG. 75 (Continued)

| | | | |
|---|---|---|---|
| AQTLATPFKAQ | 3-mer-s PHP.B library | High (based on NGS/E.coli transformants from prior CREATE selection) | High (Syn, SNAP, GFAP) |
| ATTLATPFKAQ | 3-mer-s PHP.B library | High (based on NGS/E.coli transformants from prior CREATE selection) | High (Tek, Syn, SNAP, GFAP) |
| DGTLATPFKAQ | 3-mer-s PHP.B library | High (based on NGS/E.coli transformants from prior CREATE selection) | High (Tek, Syn, SNAP, GFAP) |
| GGTLATPFKAQ | 3-mer-s PHP.B library | High (based on NGS/E.coli transformants from prior CREATE selection) | High (Tek, Syn, SNAP, GFAP) |
| SGSLAVPFKAQ | 3-mer-s PHP.B library | High (based on NGS/E.coli transformants from prior CREATE selection) | High (Tek, Syn, SNAP, GFAP) |
| AQTLAQPFKAQ | 3-mer-s PHP.B library | High (based on NGS/E.coli transformants from prior CREATE selection) | High (Tek, Syn, SNAP, GFAP) |
| AQTLSNPFKAQ | 3-mer-s PHP.B library | High (based on NGS/E.coli transformants from prior CREATE selection) | High (Tek, Syn, SNAP, GFAP) |
| AQTLSQPFKAQ | 3-mer-s PHP.B library | High (based on NGS/E.coli transformants from prior CREATE selection) | High (Tek, Syn, SNAP, GFAP) |
| EGTLAVPFKAQ | 3-mer-s PHP.B library | High (based on NGS/E.coli transformants from prior CREATE selection) | High (Tek, Syn, SNAP, GFAP) |
| DSTLAVPFKAQ | 3-mer-s PHP.B library | High (based on NGS/E.coli transformants from prior CREATE selection) | High (Tek, Syn, SNAP, GFAP) |

FIG. 75 (Continued)

| | | | | | |
|---|---|---|---|---|---|
| | NQTLAVPFKAQ | 3-mer-s PHP.B library | High (based on NGS/E.coli transformants from prior CREATE selection) | | High (Tek, Syn, SNAP, GFAP) |
| | SGNLAVPFKAQ | 3-mer-s PHP.B library | High (based on NGS/E.coli transformants from prior CREATE selection) | | High (Tek, Syn, SNAP, GFAP) |
| | ATTLAVPFKAQ | 3-mer-s PHP.B library | High (based on NGS/E.coli transformants from prior CREATE selection) | | High (Tek, Syn, SNAP, GFAP) |
| | AQTLTMPFKAQ | 3-mer-s PHP.B library | High (based on NGS/E.coli transformants from prior CREATE selection) | | High (Syn, SNAP, GFAP) |
| | AQTLSTPFKAQ | 3-mer-s PHP.B library | High (based on NGS/E.coli transformants from prior CREATE selection) | | High (Syn, SNAP, GFAP) |
| | QGTLAVPFKAQ | 3-mer-s PHP.B library | High (based on NGS/E.coli transformants from prior CREATE selection) | | High (Tek, Syn, SNAP, GFAP) |
| 15168 | DGTLAVPFSNP | 3-mer-s PHP.B library | High (based on NGS/E.coli transformants from prior CREATE selection) | | High (Tek, Syn, SNAP, GFAP) |
| 15169 | DGTLAVPFRAQ | 3-mer-s PHP.B library | High (based on NGS/E.coli transformants from prior CREATE selection) | variant unrecovered in brain tissue | |
| 15170 | AQNSREVNIAQ | 7-mer-i AAV9 library (prior selection study in GFAP-cre) | High in GFAP (based on NGS/E.coli transformants from prior CREATE selection) | Low (GFAP) | Low (Syn, SNAP) |
| 15171 | AQTREVNVIAQ | 7-mer-i AAV9 library (prior selection study in GFAP-cre) | High in GFAP (based on NGS/E.coli transformants from prior CREATE selection) | | Low (Syn) |

FIG. 75 (Continued)

| | | | | |
|---|---|---|---|---|
| 15172 | AQIGMGHTLAQ | 7-mer-i AAV9 library (prior selection study in GFAP-cre) | High in GFAP (based on NGS/E.coli transformants from prior CREATE selection) | | Low (Syn) |
| 15173 | AQTAETKFLAQ | 7-mer-i AAV9 library (prior selection study in GFAP-cre) | High in GFAP (based on NGS/E.coli transformants from prior CREATE selection) | | Low (Syn) |
| 15174 | AQKATPPTEAQ | 7-mer-i AAV9 library (prior selection study in GFAP-cre) | High in GFAP (based on NGS/E.coli transformants from prior CREATE selection) | Low (GFAP) | |
| 15175 | AQAETSRSVAQ | 7-mer-i AAV9 library (prior selection study in GFAP-cre) | High in GFAP (based on NGS/E.coli transformants from prior CREATE selection) | | Low (Syn) |
| 15176 | AQTNRTIQTAQ | 7-mer-i AAV9 library (prior selection study in GFAP-cre) | High in GFAP (based on NGS/E.coli transformants from prior CREATE selection) | | High (Tek), Low (Syn, SNAP, GFAP) |
| 15177 | AQYALTNDRAQ | 7-mer-i AAV9 library (prior selection study in GFAP-cre) | High in GFAP (based on NGS/E.coli transformants from prior CREATE selection) | variant unrecovered in brain tissue | |
| 15178 | AQSVTNKMLAQ | 7-mer-i AAV9 library (prior selection study in GFAP-cre) | High in GFAP (based on NGS/E.coli transformants from prior CREATE selection) | | Low (Syn, Tek) |
| 15179 | AQSVQIVRGAQ | 7-mer-i AAV9 library (prior selection study in GFAP-cre) | High in GFAP (based on NGS/E.coli transformants from prior CREATE selection) | Low (GFAP) | |

FIG. 75 (Continued)

| 15180 | | | | |
|---|---|---|---|---|
| | AQYPNTSQVAQ | 7-mer-i AAV9 library (prior selection study in GFAP-cre) | High in GFAP (based on NGS/E.coli transformants from prior CREATE selection) | Low (GFAP) | Low (Syn, Tek) |
| 15181 | AQYTLSQGTAQ | 7-mer-i AAV9 library (prior selection study in GFAP-cre) | High in GFAP (based on NGS/E.coli transformants from prior CREATE selection) | | Low (Syn) |
| 15182 | AQWGLNRGTAQ | 7-mer-i AAV9 library (prior selection study in GFAP-cre) | High in GFAP (based on NGS/E.coli transformants from prior CREATE selection) | variant unrecovered in brain tissue | |
| 15183 | AQTPKNVPDAQ | 7-mer-i AAV9 library (prior selection study in GFAP-cre) | High in GFAP (based on NGS/E.coli transformants from prior CREATE selection) | variant unrecovered in brain tissue | |
| 15184 | AQYDPRGTDAQ | 7-mer-i AAV9 library (prior selection study in GFAP-cre) | High in GFAP (based on NGS/E.coli transformants from prior CREATE selection) | variant unrecovered in brain tissue | |
| 15185 | AQVDTRPIQAQ | 7-mer-i AAV9 library (prior selection study in GFAP-cre) | High in GFAP (based on NGS/E.coli transformants from prior CREATE selection) | Low (GFAP) | |
| 15186 | AQTKSSYGVAQ | 7-mer-i AAV9 library (prior selection study in GFAP-cre) | High in GFAP (based on NGS/E.coli transformants from prior CREATE selection) | | Low (Syn, Tek) |
| 15187 | AQMNSTKNVAQ | 7-mer-i AAV9 library (prior selection study in GFAP-cre) | High in GFAP (based on NGS/E.coli transformants from prior CREATE selection) | | High (Tek), Low (Syn, SNAP, GFAP) |

FIG. 75 (Continued)

| | | | | |
|---|---|---|---|---|
| 15188 | AQSLHHGSSAQ | 7-mer-i AAV9 library (prior selection study in GFAP-cre) | High in GFAP (based on NGS/E.coli transformants from prior CREATE selection) | | Low (Syn) |
| 15189 | AQSSPGAMHAQ | 7-mer-i AAV9 library (prior selection study in GFAP-cre) | High in GFAP (based on NGS/E.coli transformants from prior CREATE selection) | variant unrecovered in brain tissue | |
| 15190 | AQSSYNDHPAQ | 7-mer-i AAV9 library (prior selection study in GFAP-cre) | High in GFAP (based on NGS/E.coli transformants from prior CREATE selection) | Low (GFAP) | Low (Syn) |
| 15191 | AQGAPRSSIAQ | 7-mer-i AAV9 library (prior selection study in GFAP-cre) | High in GFAP (based on NGS/E.coli transformants from prior CREATE selection) | | Low (Tek, Syn) |
| 15192 | AQQGSLYTSAQ | 7-mer-i AAV9 library (prior selection study in GFAP-cre) | High in GFAP (based on NGS/E.coli transformants from prior CREATE selection) | | Low (Syn) |
| 15193 | AQHNAPGSLAQ | 7-mer-i AAV9 library (prior selection study in GFAP-cre) | High in GFAP (based on NGS/E.coli transformants from prior CREATE selection) | Low (GFAP) | Low (Syn) |
| 15194 | AQSLSPTINAQ | 7-mer-i AAV9 library (prior selection study in GFAP-cre) | High in GFAP (based on NGS/E.coli transformants from prior CREATE selection) | | Low (Syn) |
| 15195 | AQNNVTLLSAQ | 7-mer-i AAV9 library (prior selection study in GFAP-cre) | High in GFAP (based on NGS/E.coli transformants from prior CREATE selection) | Low (GFAP) | Low(Syn) |

FIG. 75 (Continued)

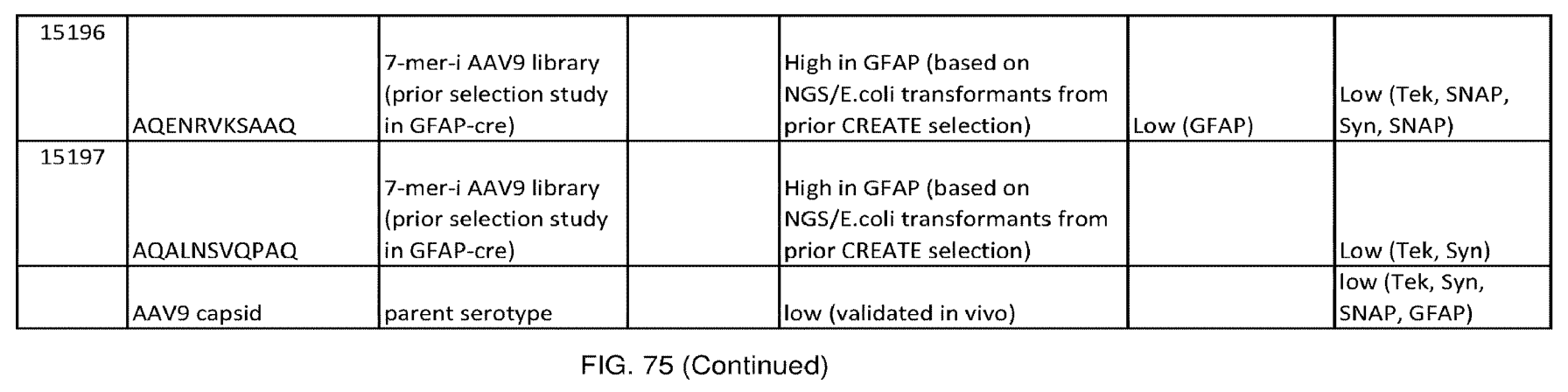

| 15196 | AQENRVKSAAQ | 7-mer-i AAV9 library (prior selection study in GFAP-cre) | High in GFAP (based on NGS/E.coli transformants from prior CREATE selection) | Low (GFAP) | Low (Tek, SNAP, Syn, SNAP) |
| 15197 | AQAINSVQPAQ | 7-mer-i AAV9 library (prior selection study in GFAP-cre) | High in GFAP (based on NGS/E.coli transformants from prior CREATE selection) | | Low (Tek, Syn) |
| | AAV9 capsid | parent serotype | low (validated in vivo) | | low (Tek, Syn, SNAP, GFAP) |

FIG. 75 (Continued)

| 7-11 mer Peptide | SNAP-Cre brain mean enrichment score (log10 scale) |
|---|---|
| AQTLQLPFKAQ | 2.635622315 |
| QGTLAVPFKAQ | 2.560366902 |
| AQTLSNPFKAQ | 2.502118769 |
| EGTLAVPFKAQ | 2.482752751 |
| DGTLAVPFKAQ | 2.463683642 |
| AQTLQQPFKAQ | 2.419778506 |
| AQTLATPFKAQ | 2.413504952 |
| SGSLAVPFKAQ | 2.332201386 |
| AQTLSTPFKAQ | 2.299687253 |
| DGTLATPFKAQ | 2.291973997 |
| GGTLAVPFKAQ | 2.29043988 |
| AQSVSKPFLAQ | 2.284711601 |
| AQTLAVPFKAQ | 2.278601473 |
| AQTLTMPFKAQ | 2.221290966 |
| ESTLAVPFKAQ | 2.117205819 |
| SGNLAVPFKAQ | 2.105494998 |
| AQTLSQPFKAQ | 2.0935429 |
| NQTLAVPFKAQ | 2.016639766 |
| AQTLAQPFKAQ | 1.995025038 |
| ATTLATPFKAQ | 1.92915754 |
| DSTLAVPFKAQ | 1.905246666 |
| AQTLAVPFSNP | 1.738130019 |
| GGTLATPFKAQ | 1.695996385 |
| ATTLAVPFKAQ | 1.647772357 |
| AQFTLTTPKAQ | 1.10964487 |
| DGTLAVPFSNP | 0.989170037 |
| AQTTLKPFSNP | 0.848064508 |
| AQMNSTKNVAQ | 0.133837545 |
| AQTNRTIQTAQ | 0.070636377 |
| AQNSREVNIAQ | 0.010923571 |
| AQENRVKSAAQ | -0.270391873 |
| *AAV9 parent* | *-0.717369399* |

FIG. 76

| 7-11 mer Peptide | GFAP-Cre brain mean enrichment score (log10 scale) |
|---|---|
| AQSVSKPFLAQ | 2.432111357 |
| AQTLQLPFKAQ | 2.426669581 |
| AQTLAVPFKAQ | 2.424167734 |
| SGSLAVPFKAQ | 2.413393158 |
| GGTLAVPFKAQ | 2.397707224 |
| SGNLAVPFKAQ | 2.35782662 |
| AQTLTMPFKAQ | 2.35516667 |
| AQTLQQPFKAQ | 2.327525492 |
| QGTLAVPFKAQ | 2.306177613 |
| DGTLAVPFKAQ | 2.284953655 |
| EGTLAVPFKAQ | 2.254372157 |
| AQTLSNPFKAQ | 2.214426568 |
| AQTLATPFKAQ | 2.189159997 |
| DGTLATPFKAQ | 2.142993798 |
| AQTLSQPFKAQ | 2.114492139 |
| ATTLATPFKAQ | 2.109425827 |
| AQTLSTPFKAQ | 1.960573055 |
| AQTLAQPFKAQ | 1.922063594 |
| ESTLAVPFKAQ | 1.876988733 |
| NQTLAVPFKAQ | 1.793802999 |
| ATTLAVPFKAQ | 1.700418599 |
| AQTLAVPFSNP | 1.613667889 |
| GGTLATPFKAQ | 1.566031662 |
| DSTLAVPFKAQ | 1.378544566 |
| AQTTLKPFSNP | 1.101507461 |
| AQFTLTTPKAQ | 1.066406048 |
| DGTLAVPFSNP | 0.635613469 |
| DGTALKPFLAQ | 0.42534062 |
| AQTNRTIQTAQ | 0.394388797 |
| AQMNSTKNVAQ | 0.358805861 |
| AQSSYNDHPAQ | 0.295857683 |
| AQSVQIVRGAQ | 0.183522142 |
| AQYPNTSQVAQ | 0.180040989 |
| AQVDTRPIQAQ | 0.178271526 |
| AQHNAPGSLAQ | 0.141306671 |
| AQKATPPTEAQ | 0.13263146 |
| AQENRVKSAAQ | -0.025808641 |
| AQQAVRTSLAQ | -0.219734424 |
| AQNSREVNIAQ | -0.272580586 |
| *AAV9 parent* | *-0.463061913* |
| AQNNVTLLSAQ | -0.666668537 |

| 7-11 mer Peptide | SNAP-Cre brain mean enrichment score (log10 scale) | 7-11 mer Peptide | GFAP-Cre brain mean enrichment score (log10 scale) |
|---|---|---|---|
| AQTLQLPFKAQ | 2.635622315 | AQSVSKPFLAQ | 2.432111357 |
| QGTLAVPFKAQ | 2.560366902 | AQTLQLPFKAQ | 2.426669581 |
| AQTLSNPFKAQ | 2.502118769 | AQTLAVPFKAQ | 2.424167734 |
| EGTLAVPFKAQ | 2.482752751 | SGSLAVPFKAQ | 2.413393158 |
| DGTLAVPFKAQ | 2.463683642 | GGTLAVPFKAQ | 2.397707224 |
| AQTLQQPFKAQ | 2.419778506 | SGNLAVPFKAQ | 2.35782662 |
| AQTLATPFKAQ | 2.413504952 | AQTLTMPFKAQ | 2.35516667 |
| SGSLAVPFKAQ | 2.332201386 | AQTLQQPFKAQ | 2.327525492 |
| AQTLSTPFKAQ | 2.299687253 | QGTLAVPFKAQ | 2.306177613 |
| DGTLATPFKAQ | 2.291973997 | DGTLAVPFKAQ | 2.284953655 |
| GGTLAVPFKAQ | 2.29043988 | EGTLAVPFKAQ | 2.254372157 |
| AQSVSKPFLAQ | 2.284711601 | AQTLSNPFKAQ | 2.214426568 |
| AQTLAVPFKAQ | 2.278601473 | AQTLATPFKAQ | 2.189159997 |
| AQTLTMPFKAQ | 2.221290966 | DGTLATPFKAQ | 2.142993798 |
| ESTLAVPFKAQ | 2.117205819 | AQTLSQPFKAQ | 2.114492139 |
| SGNLAVPFKAQ | 2.105494998 | ATTLATPFKAQ | 2.109425827 |
| AQTLSQPFKAQ | 2.0935429 | AQTLSTPFKAQ | 1.960573055 |
| NQTLAVPFKAQ | 2.016639766 | AQTLAQPFKAQ | 1.922063594 |
| AQTLAQPFKAQ | 1.995025038 | ESTLAVPFKAQ | 1.876988733 |
| ATTLATPFKAQ | 1.92915754 | NQTLAVPFKAQ | 1.793802999 |
| DSTLAVPFKAQ | 1.905246666 | ATTLAVPFKAQ | 1.700418599 |
| AQTLAVPFSNP | 1.738130019 | AQTLAVPFSNP | 1.613667889 |
| GGTLATPFKAQ | 1.695996385 | GGTLATPFKAQ | 1.566031662 |
| ATTLAVPFKAQ | 1.647772357 | DSTLAVPFKAQ | 1.378544566 |
| AQFTLTTPKAQ | 1.10964487 | AQTTLKPFSNP | 1.101507461 |
| DGTLAVPFSNP | 0.989170037 | AQFTLTTPKAQ | 1.066406048 |
| AQTTLKPFSNP | 0.848064508 | DGTLAVPFSNP | 0.635613469 |
| AQMNSTKNVAQ | 0.133837545 | DGTALKPFLAQ | 0.42534062 |
| AQTNRTIQTAQ | 0.070636377 | AQTNRTIQTAQ | 0.394388797 |
| AQNSREVNIAQ | 0.010923571 | AQMNSTKNVAQ | 0.358805861 |
| AQENRVKSAAQ | -0.270391873 | AQSSYNDHPAQ | 0.295857683 |
| *AAV9 parent* | *-0.717369399* | AQSVQIVRGAQ | 0.183522142 |
| | | AQYPNTSQVAQ | 0.180040989 |
| | | AQVDTRPIQAQ | 0.178271526 |
| | | AQHNAPGSLAQ | 0.141306671 |
| | | AQKATPPTEAQ | 0.13263146 |
| | | AQENRVKSAAQ | -0.025808641 |
| | | AQQAVRTSLAQ | -0.219734424 |
| | | AQNSREVNIAQ | -0.272580586 |
| | | *AAV9 parent* | *-0.463061913* |
| | | AQNNVTLLSAQ | -0.666668537 |

FIG. 76 (Continued)

VIRUS COMPOSITIONS WITH ENHANCED SPECIFICITY IN THE BRAIN

RELATED APPLICATIONS

This Application claims the benefit of and priority to U.S. Provisional Patent Application Ser. No. 62/832,836, filed Apr. 11, 2019, the content of which is incorporated herein in its entirety.

STATEMENT AS TO FEDERALLY SPONSORED RESEARCH

This invention was made with government support under NS087949, MH117069, and OD025535 awarded by National Institutes of Health. The government has certain rights in the invention.

SUMMARY

Recombinant adeno-associated viruses (rAAVs) are widely used as vectors for gene delivery in basic scientific research and therapeutic applications because of their ability to transduce both dividing and non-dividing cells, their long-term persistence as episomal DNA in infected cells, and their low immunogenicity. These characteristics make them appealing for applications in both basic science and in clinics, such as gene therapy. However, there is a need to significantly improve the performance of existing serotypes to specifically target distinct brain cell-types, upon systemic delivery to a subject. This need is especially acute when the AAV must across the blood brain barrier (BBB) to reach the central nervous system (CNS).

Systemic delivery of existing AAV serotypes show limited transduction of certain cell types and organs, and non-specific, overlapping tropisms in others. This leads to several complications in gene therapy applications, including but not limited to off-target effects due to transduction of unimpacted organs and cell types (in particular, the liver), and the necessity for a larger viral dosage to achieve sufficient therapeutic levels in the tissue or organ of interest.

Disclosed herein are rAAVs with engineered specificity into the capsid structure through iterative rounds of positive and negative selection, yielding variants with tropisms having an increased specificity and transduction efficiency when measured in the CNS, and in some cases, a decreased specificity and transduction efficiency in an off-target environment, like the liver. The rAAVs described herein achieve widespread transduction to target environment (e.g., target cell types or tissues) in a subject upon systemic delivery (e.g., intravenous injection).

Also provided are methods of engineering the rAAVs of the present disclose using a multiplexed Cre recombination-based AAV targeted evolution (M-CREATE) method. The M-CREATE method generates enhanced transduction efficiency and/or specificity by (1) introducing variations in the capsid protein sequence, (2) in vivo unbiased selection and recovery of only those variants that travel to defined cell populations, (3) cross the cell membrane, (4) travel to the nucleus, and (5) unpackage and express their genetic dosage amount. Variant capsids exhibiting the most desirable tropism (e.g., enhanced efficiency and specificity for a particular in vivo environment) are recovered and identified by deep sequencing. Strategies for unbiased selection and analysis include determining variants' enrichment score (by normalizing the target tissue library to starting virus library) and unbiased propagation between rounds of selections through a synthetic library construction (where each variant is represented equally). Also disclosed are detailed characterizations of the resultant libraries from sequencing data which provide useful insights on the selection of variants towards a target.

Disclosed herein are AAV capsid libraries generated using M-CREATE. The first library, a 7-mer peptide insertion in AAV9 (7-mer-i library) was built for parallel in vivo selections across different brain cell types—endothelial cells, neurons, and astrocytes—and yielded a large pool of AAV9 variants with enhanced ability to target as well as cross the blood-brain barrier (BBB) and broadly transduce the central nervous system (CNS). The second library, a 3-mer peptide substitution in AAV-PHP.B (3-mer-s library), was reinvestigated by incorporating deep sequencing to recover capsids. A pool of AAV-PHP.B variants were discovered including a variant that transduce CNS neurons with greater specificity. The rAAVs of the present disclosure can efficiently target the endothelial cells of the blood-brain barrier, variants that can broadly transduce different cell types in the central nervous system, and a variant exhibiting greater specificity towards transducing neuron.

Aspects disclosed herein provide AAV capsids comprising: (a) an AAV capsid protein comprising: (i) a first amino acid sequence that is at least 98% identical to amino acid 217 to amino acid 736 of SEQ ID NO: 1; and (ii) a second amino acid sequence at least 57.1% identical to an amino acid sequence provided in Tables 2-3 or FIG. 33 inserted at an amino acid position 588_589 within SEQ ID NO: 1, wherein the AAV capsid protein is characterized by at least one of an increased specificity and an increased transduction efficiency when measured in a central nervous system (CNS) in a subject when delivered to the subject systemically, relative to a native AAV capsid protein provided in SEQ ID NO: 1. In some embodiments, the second amino acid sequence is at least 71.4% identical to the amino acid sequence provided in Tables 2-3 or FIG. 33. In some embodiments, the second amino acid sequence is at least 86.7% identical to the amino acid sequence provided in Tables 2-3 or FIG. 33. In some embodiments, the second amino acid sequence is selected from the group consisting of TALKPFL, TTLKPFL, TLQIPFK, TMQKPFI, SIERPFK, RYQGDSV, and TTLKPFS. In some embodiments, the AAV capsid protein is present in VP1, VP2, and VP3 of the AAV capsid. In some embodiments, the AAV capsid is chimeric. In some embodiments, 60 copies of the AAV capsid protein are assembled into the AAV capsid. In some embodiments, the CNS comprises a cell-type selected from the group consisting of a neuron, an oligodendrocyte, an astrocyte, and a brain vascular cell. In some embodiments, the CNS comprises a tissue that is selected from the group consisting of a brain, a thalamus, a cortex, a striatum, a ventral midbrain, and a spinal cord. In some embodiments, the AAV capsid protein further comprises an amino acid substitution A587D. In some embodiments, the AAV capsid protein further comprises an amino acid substitution Q588G. In some embodiments, the AAV capsid protein further comprises an amino acid substitution comprising A589N. In some embodiments, the AAV capsid protein further comprises an amino acid substitution comprising Q590P. In some embodiments, the second amino acid sequence at the amino acid position 588_589 within SEQ ID NO: 1 is not TLAVPFK, KFPVALT, SVSKPFL, FTLTTPK, MNATKNV, NGGTSSS, TRTNPEA, or YTLSQGW. In some embodiments, the AAV capsid is isolated and purified. In some embodiments, the AAV capsid is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects disclosed herein provide AAV capsids comprising an AAV capsid protein comprising a seven amino acid insertion (X1-X2-X3-X4-X5-X6-X7) between amino acid 588 and amino acid 589 in an amino acid sequence of the AAV capsid protein provided in SEQ ID NO: 1, wherein X1 is an amino acid selected from the group consisting of E, D, G, R, S and T. In some embodiments, X2 is an amino acid selected from the group consisting of A, G, I, L, M, N, Q, T, and Y. In some embodiments, X3 is an amino acid selected from the group consisting of E, K, L, T, and Q. In some embodiments, X4 is an amino acid selected from the group consisting of G, I, K, L, R, T, and V. In some embodiments, X5 is an amino acid selected from the group consisting of A, D, G, P, L, Q, and V. In some embodiments, X6 is an amino acid selected from the group consisting of F, K, N, P, Q, S, and V. In some embodiments, X7 is an amino acid selected from the group consisting of I, K, L, P, and V. In some embodiments, the seven amino acid insertion is selected from the group consisting of TALKPFL, TTLKPFL, TLQIPFK, TMQKPFI, SIERPFK, RYQGDSV, and TTLKPFS. In some embodiments, the AAV capsid protein is present in VP1, VP2, and VP3 of the AAV capsid. In some embodiments, the AAV capsid is chimeric. In some embodiments, 60 copies of the AAV capsid protein are assembled into the AAV capsid. In some embodiments, the AAV capsid protein is characterized by at least one of an increased specificity and an increased transduction efficiency when measured in a central nervous system (CNS) in a subject when delivered to the subject systemically, relative to a native AAV capsid protein provided in SEQ ID NO: 1. In some embodiments, the CNS comprises a cell-type selected from the group consisting of a neuron, a glial cell, a oligodendrocyte, an ependymal cell, an astrocyte, a Schwann cell, a satellite cell, and an enteric glial cell. In some embodiments, the CNS comprises a tissue that is selected from the group consisting of a brain, a thalamus, a cortex, a striatum, a ventral midbrain, and a spinal cord. In some embodiments, the AAV capsid protein further comprises an amino acid substitution comprising A587D. In some embodiments, the AAV capsid protein further comprises an amino acid substitution comprising Q588G. In some embodiments, the AAV capsid protein further comprises an amino acid substitution comprising A589N. In some embodiments, the AAV capsid protein further comprises an amino acid substitution comprising Q590P. In some embodiments, the seven amino acid insertion is not TLAVPFK, KFPVALT, SVSKPFL, FTLTTPK, MNATKNV, NGGTSSS, TRTNPEA, or YTLSQGW. In some embodiments, the AAV capsid is isolated and purified. In some embodiments, the AAV capsid is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects provided herein provide AAV capsids comprising: (a) an AAV capsid protein comprising: (i) a first amino acid sequence that is at least 98% identical to amino acid 217 to amino acid 736 of SEQ ID NO: 1; and (ii) a second amino acid sequence provided in Table 4 or FIG. 35 at an amino acid position 588_589 within SEQ ID NO: 1, wherein the AAV capsid protein is characterized by at least one of an increased specificity and an increased transduction efficiency when measured in a liver in a subject when delivered to the subject systemically, relative to a native AAV capsid protein provided in SEQ ID NO: 1. In some embodiments, the second amino acid sequence is at least 71.4% identical to the amino acid sequence provided in Table 4 or FIG. 35. In some embodiments, the second amino acid sequence is at least 86.7% identical to the amino acid sequence provided in Table 4 or FIG. 35. In some embodiments, the second amino acid sequence is selected from the group consisting of KAYSVQV, PSGSARS, and RTANALG. In some embodiments, the AAV capsid protein is present in VP1, VP2, and VP3 of the AAV capsid. In some embodiments, the AAV capsid is chimeric. In some embodiments, 60 copies of the AAV capsid protein are assembled into the AAV capsid. In some embodiments, the AAV capsid is isolated and purified. In some embodiments, the AAV capsid is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects disclosed herein provide AAV capsid proteins comprising: (i) a first amino acid sequence that is at least 98% identical to amino acid 217 to amino acid 736 of SEQ ID NO: 1; and (ii) a second amino acid sequence at least 57.1% identical to an amino acid sequence provided in Tables 2-3 or FIG. 33 inserted at an amino acid position 588_589 within SEQ ID NO: 1, wherein the AAV capsid protein is characterized by at least one of an increased specificity and an increased transduction efficiency when measured in a central nervous system (CNS) in a subject when delivered to the subject systemically, relative to a native AAV capsid protein provided in SEQ ID NO: 1. In some embodiments, the second amino acid sequence is at least 71.4% identical to the amino acid sequence provided in Tables 2-3 or FIG. 33. In some embodiments, the second amino acid sequence is at least 86.7% identical to the amino acid sequence provided in Tables 2-3 or FIG. 33. In some embodiments, the second amino acid sequence is selected from the group consisting of TALKPFL, TTLKPFL, TLQIPFK, TMQKPFI, SIERPFK, RYQGDSV, and TTLKPFS. In some embodiments, the AAV capsid protein is present in VP1, VP2, and VP3 of an AAV capsid. In some embodiments, the AAV capsid is chimeric. In some embodiments, 60 copies of the AAV capsid protein are assembled into the AAV capsid. In some embodiments, the CNS comprises a cell-type selected from the group consisting of a neuron, an oligodendrocyte, an astrocyte, and a brain vascular cell. In some embodiments, the CNS comprises a tissue that is selected from the group consisting of a brain, a thalamus, a cortex, a striatum, a ventral midbrain, and a spinal cord. In some embodiments, the AAV capsid protein further comprises an amino acid substitution A587D. In some embodiments, the AAV capsid protein further comprises an amino acid substitution Q588G. In some embodiments, the AAV capsid protein further comprises an amino acid substitution comprising A589N. In some embodiments, the AAV capsid protein further comprises an amino acid substitution comprising Q590P. In some embodiments, the second amino acid sequence at the amino acid position 588_589 within SEQ ID NO: 1 is not TLAVPFK, KFPVALT, SVSKPFL, FTLTTPK, MNATKNV, NGGTSSS, TRTNPEA, or YTLSQGW. In some embodiments, the AAV capsid protein is isolated and purified. In some embodiments, the AAV capsid protein is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects disclosed herein provide AAV capsids proteins comprising a seven amino acid insertion (X1-X2-X3-X4-X5-X6-X7) between amino acid 588 and amino acid 589 in an amino acid sequence of the AAV capsid protein provided in SEQ ID NO: 1, wherein X1 is an amino acid selected from the group consisting of E, D, G, R, S and T. In some embodiments, X2 is an amino acid selected from the group consisting of A, G, I, L, M, N, Q, T, and Y. In some embodiments, X3 is an amino acid selected from the group consisting of E, K, L, T, and Q. In some embodiments, X4 is an amino acid selected from the group consisting of G, I, K, L, R, T, and V. In some embodiments, X5 is an amino acid selected from the group consisting of A, D, G, P, L, Q, and V. In some embodiments, X6 is an amino acid selected from the group consisting of F, K, N, P, Q, S, and V. In some embodiments, X7 is an amino acid selected from the group consisting of I, K, L, P, and V. In some embodiments, the seven amino acid insertion is selected from the group consisting of TALKPFL, TTLKPFL, TLQIPFK, TMQKPFI, SIERPFK, RYQGDSV, and TTLKPFS. In some embodiments, the AAV capsid protein is present in VP1, VP2, and VP3 of a AAV capsid. In some embodiments, the AAV capsid is chimeric. In some embodiments, 60 copies of the AAV capsid protein are assembled into the AAV capsid. In some embodiments, the AAV capsid protein is characterized by at least one of an increased specificity and an increased transduction efficiency when measured in a central nervous system (CNS) in a subject when delivered to the subject systemically, relative to a native AAV capsid protein provided in SEQ ID NO: 1. In some embodiments, the CNS comprises a cell-type selected from the group consisting of a neuron, a glial cell, a oligodendrocyte, an ependymal cell, an astrocyte, a Schwann cell, a satellite cell, and an enteric glial cell. In some embodiments, the CNS comprises a tissue that is selected from the group consisting of a brain, a thalamus, a cortex, a striatum, a ventral midbrain, and a spinal cord. In some embodiments, the AAV capsid protein further comprises an amino acid substitution comprising A587D. In some embodiments, the AAV capsid protein further comprises an amino acid substitution comprising Q588G. In some embodiments, the AAV capsid protein further comprises an amino acid substitution comprising A589N. In some embodiments, the AAV capsid protein further comprises an amino acid substitution comprising Q590P. In some embodiments, the seven amino acid insertion is not TLAVPFK, KFPVALT, SVSKPFL, FTLTTPK, MNATKNV, NGGTSSS, TRTNPEA, or YTLSQGW. In some embodiments, the AAV capsid protein is isolated and purified. In some embodiments, the AAV capsid protein is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects provided herein provide AAV capsids proteins comprising: (i) a first amino acid sequence that is at least 98% identical to amino acid 217 to amino acid 736 of SEQ ID NO: 1; and (ii) a second amino acid sequence at least 57.1% identical to an amino acid sequence provided in Table 4 or FIG. 35 at an amino acid position 588_589 within SEQ ID NO: 1, wherein the AAV capsid protein is characterized by at least one of an increased specificity and an increased transduction efficiency when measured in a liver in a subject when delivered to the subject systemically, relative to a native AAV capsid protein provided in SEQ ID NO: 1. In some embodiments, the second amino acid sequence is at least 71.4% identical to the amino acid sequence provided in Table 4 or FIG. 35. In some embodiments, the second amino acid sequence is at least 86.7% identical to the amino acid sequence provided in Table 4 or FIG. 35. In some embodiments, the second amino acid sequence is selected from the group consisting of KAYSVQV, PSGSARS, and RTANALG. In some embodiments, the AAV capsid protein is present in VP1, VP2, and VP3 of an AAV capsid. In some embodiments, the AAV capsid is chimeric. In some embodiments, 60 copies of the AAV capsid protein are assembled into the AAV capsid. In some embodiments, the AAV capsid protein is isolated and purified. In some embodiments, the AAV capsid protein is formulated as a pharmaceutical formulation for intravenous administration to treat a disease or a condition of the liver, the pharmaceutical formulation further comprising a pharmaceutically acceptable carrier. In some embodiments, the pharmaceutical formulation further comprises a therapeutic agent.

Aspects disclosed herein comprise plasmid vectors comprising a nucleic acid sequence encoding the AAV capsids and AAV capsid proteins described herein. In some instances, the plasmid vector is bacterial. In some instances, the plasmid vector is derived from *Escherichia coli*. In some instances, the nucleic acid sequence comprises, in a 5' to 3' direction: (1) a 5' inverted terminal repeat (ITR) sequence, (2) a Replication (Rep) gene, (3) a Capsid (Cap) gene, and (4) a 3' ITR, wherein the Cap gene encodes the AAV capsid protein described herein. In some instances, the plasmid vector encodes a pseudotyped AAV capsid protein. In some instances, the Cap gene is derived from the deoxyribose nucleic acid (DNA) provided in any one of SEQ ID NOs: 6-10. In some instances, the nucleic acid sequence comprising the Cap gene is at least 90%, 91%, 92%, 93%, 94%, 95%, 96%, 97%, 98%, 99%, or 100% identical to any one of the DNA sequences provided in U.S. application. Ser. No. 16/582,635, incorporated herein by reference. In some instances, the 5' ITR and the 3' ITR are derived from an AAV2 serotype. In some instances, the 5' ITR and the 3' ITR are derived from an AAV5 serotype. In some instances, the 5' ITR and the 3' ITR are derived from an AAV9 serotype.

Aspects disclosed herein provide methods of treating a disease or condition in a subject comprising administering a therapeutically effective amount of a pharmaceutical formulation comprising the AAV capsid protein or the AAV capsid of the present disclosure. In some embodiments, the disease or the condition is a disease or a condition of a central nervous system (CNS) or a liver of the subject. In some embodiments, the disease or condition of the liver is selected from the group consisting of Alagille Syndrome, Alcohol-Related Liver Disease, Alpha-1 Antitrypsin Deficiency, Autoimmune Hepatitis, Benign Liver Tumors, Biliary Atresia, Cirrhosis, Crigler-Najjar Syndrome, Galactosemia, Gilbert Syndrome, Hemochromatosis, Hepatic Encephalopathy, Hepatitis A, Hepatitis B, Hepatitis C, Hepatorenal Syndrome, Intrahepatic Cholestasis of Pregnancy (ICP), Lysosomal Acid Lipase Deficiency (LAL-D), Liver Cysts, Liver Cancer, Newborn Jaundice, Non-Alcoholic Fatty Liver Disease, Primary Biliary Cholangitis (PBC), Primary Sclerosing Cholangitis (PSC), Reye Syndrome, Type I Glycogen Storage Disease, and Wilson Disease. In some embodiments, the disease or condition of the CNS is selected from group consisting of Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Subcortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavemous Malformation, Cerebral Gigantism, Cerebral Hypoxia, Cerebral Palsy, Cerebro-Oculo-Facio-Skeletal Syndrome (COFS), Charcot-Marie-Tooth Disease, Charcot-Marie-Tooth syndrome, classical rhizomelic chondrodysplasia punctata (RCDP), Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, Deafness, De Morsier's Syndrome, Dejerine-Klumpke Palsy, Dementia, Dementia-Multi-Infarct, Dementia—Semantic, Dementia—Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Duchenne muscular dystrophy, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, glioblastoma, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Kliiver-Bucy Syndrome, Korsakoff s Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado—Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy-Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy-Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, and X-Linked Spinal and Bulbar Muscular Atrophy. In some embodiments, the pharmaceutical formulation comprises a therapeutic nucleic acid encoding a therapeutic gene expression product. In some instances, the therapeutic gene expression product is effective to modulate an activity or an expression of a target gene or gene expression product selected from the group consisting of Sarcoglycan Alpha (SGCA), glutamic acid decarboxylase 65 (GAD65), glutamic acid decarboxylase 67 (GAD67), CLN2, Nerve Growth Factor (NGF), Survival Of Motor Neuron 1, Telomeric (SMN1), Factor X (FIX), Retinoid Isomerohydrolase (RPE65), sarco/endoplasmic reticulum Ca2+-ATPase (SERCA2a), β-Glucocerebrosidase (GCase), Frataxin (FXN), Huntingtin (HTN), methyl-CpG binding protein 2 (MECP2), a peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and a NLRP3 inflammasome. In some instances, the therapeutic gene expression product comprises gene editing components. In some instances, the gene editing components are selected from the group consisting of small interfering RNA (siRNA), short hairpin RNA (shRNA), a microRNA (miRNA), artificial site-specific RNA endonuclease (ASRE), zinc finger endonuclease (ZFN), CRISPR/Cas, and transcription factor like effector nuclease (TALEN).

Aspects disclosed herein provide methods of manufacturing a recombinant AAV particle from the AAV capsid of the present disclosure, the method comprising: (a) introducing into a cell a nucleic acid comprising: (i) a first nucleic acid sequence encoding a therapeutic gene expression product; (ii) a second nucleic acid sequence encoding a recombinant viral genome comprising a capsid (Cap) gene modified to express the AAV capsid of the present disclosure; and (iii) a third nucleic acid sequence encoding an AAV helper virus genome; and (b) assembling the recombinant AAV particle, the recombinant AAV particle comprising the AAV capsid encapsidating the first nucleic acid.

Aspects disclosed herein provide methods of manufacturing comprising: (a) introducing into a cell a nucleic acid comprising: (i) a first nucleic acid sequence encoding a therapeutic gene expression product enclosed by a 5' and a 3' inverted terminal repeat (ITR) sequence; (ii) a second nucleic acid sequence encoding a viral genome comprising a 5' ITR sequence, a Replication (Rep) gene, Capsid (Cap) gene, and a 3' ITR, wherein the Cap gene encodes the AAV capsid protein described herein; and (iii) a third nucleic acid sequence encoding a first helper virus protein selected from the group consisting of E4orf6, E2a, and VA RNA, and optionally, a second helper virus protein comprising Ela or E1b55k; (b) expressing in the cell the AAV capsid protein described herein; (c) assembling an AAV particle comprising the AAV capsid proteins disclosed herein; and (d) packaging the first nucleic acid sequence in the AAV particle. In some instances, the cell is mammalian. In some instances, the cell is immortalized. In some instances, the immortalized cell is an embryonic stem cell. In some instances, the embryonic stem cell is a human embryonic stem cell. In some instances, the human embryonic stem cell is a human embryonic kidney 293 (HEK-293) cell. In some instances, the Cap gene is derived from the deoxyribose nucleic acid (DNA) provided in any one of SEQ ID NOs: 6-10. In some instances, the nucleic acid sequence comprising the Cap gene is at least 90%, 91%, 92%, 93%, 94%, 95%, 96%, 97%, 98%, 99%, or 100% identical to any one of the DNA sequences provided in U.S. application. Ser. No. 16/582,635, incorporated herein by reference. In some instances, the 5' ITR and the 3' ITR are derived from an AAV2 serotype. In some instances, the 5' ITR and the 3' ITR are derived from an AAV5 serotype. In some instances, the 5' ITR and the 3' ITR are derived from an AAV9 serotype. In some instances, the first nucleic acid sequence and the second nucleic acid sequence are in trans. In some instances, the first nucleic acid sequence and the second nucleic acid sequence are in cis. In some instances, the first nucleic acid sequence, the second nucleic acid sequence and the third nucleic acid sequence, are in trans.

Aspects disclosed herein provide methods of manufacturing a recombinant AAV particle, the method comprising: (a) providing a recombinant AAV genome comprising: (i) an AAV capsid gene, and (ii) a recognition sequence for a Cre recombinase, wherein the recognition sequence facilitates a recombinase-dependent change that is detectable, and wherein the recombinase recognition sequence comprises two Cre-recognition sites; (iii) transfecting a population of cells expressing the Cre recombinase with the recombinant AAV genome, whereby the Cre recombinase induces a recombination event to generate the recombinase-dependent change in the recombinant AAV genome, and wherein the recombinase-dependent change comprises an inversion of the sequence that is flanked by the Cre-recognition sites; (iv) detecting an increased rate of the recombinase-dependent change a target cell in the population of cells; (v) detecting a decreased rate of the recombinase-dependent change in an off-target cell in the population of cells; and (vi) identifying a recombinant AAV genome generated by the recombinase-dependent change, wherein said identified rAAV genome comprises the inversion, and wherein said identified recombinant AAV genome encodes an AAV capsid particle characterized having an increased specificity for the target cell and a decreased specificity for the off-target cell. In some embodiments, the off-target cell is a hepatocyte. In some embodiments, the target cell is a cell selected from the group consisting of a neuron, a glial cell, a oligodendrocyte, an ependymal cell, an astrocyte, a Schwann cell, a satellite cell, and an enteric glial cell.

Aspects disclosed herein provide kits comprising: (a) a first vector comprising the recombinant vector of the present disclosure; (b) a second vector encoding a helper virus protein; and (c) a third vector comprising a therapeutic nucleic acid encoding a therapeutic gene expression product.

Aspects disclosed herein provide kits comprising: (a) a first vector comprising a first nucleic acid sequence encoding a viral genome comprising in a 5' to 3' direction: (i) a 5' inverted terminal repeat (ITR) sequence; (ii) a Replication (Rep) gene; (iii) a Capsid (Cap) gene encoding the AAV capsid proteins described herein, and (iv) a 3' ITR; and (b) optionally, a second vector comprising a second nucleic acid sequence encoding a helper virus protein comprising at least one of E4orf6, E2a, VA RNA, Ela and E1b55k. In some instances, the kit further comprises a cell. In some instances, the cell is mammalian. In some instances, the cell is immortalized. In some instances, the immortalized cell is an embryonic stem cell. In some instances, the embryonic stem cell is a human embryonic stem cell. In some instances, the human embryonic stem cell is a human embryonic kidney 293 (HEK-293) cell. In some instances, the kit further comprises an AAV vector comprising a heterologous nucleic acid encoding a therapeutic gene expression product. In some instances, the AAV vector is an episome.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 4 shows distributions of variants recovered from three R1 libraries from Tek-Cre, SNAP25-Cre, and GFAP-Cre brain tissue (n=2 per Cre line), with capsid libraries sorted by decreasing order of the enrichment score. The enrichment scores of the AAV-PHP.V2 variant are mapped as well.

FIG. 5 is a schematic of R2 synthetic pool (left) and PCR pool (right) library design.

FIG. 13 shows the 7-mer insertion peptide sequences of AAV-PHP variants between AA positions 588-589 of AAV9 capsid.

In FIGS. 31 and 32, the white box on the sagittal brain images represents the location of thalamus and not the precise area that is zoomed-in on the figure to the left. The microscope settings of acquired images were matched across all sagittal sections and across all thalamus regions. The insets in AAV-PHP.V1 are zoom-ins with enhanced brightness. The indicated capsids were used to package ssAAV:CAG-mNeongreen (n=2-3 per group, $1 \times 10^{11}$ vg IV dose per 6-8 weeks old adult mouse, 3 weeks of expression. The data reported in FIGS. 31 and 32 are from one independent trial where all viruses were freshly prepared and titered in the same assay for dosage consistency. AAV-PHP.C2 and AAV-PHP.C3 were further validated in an independent trial for BALB/cJ, n=2 per group).

FIG. 33 provides 7-mer and 11-mer variants that were positively enriched in the brain tissue in all cell lines.

FIG. 34 provides 7-mer and 11-mer variants enriched in one specific library, but negatively enriched in all other brain and liver libraries.

FIG. 35 provides 11-mer variants that were positively enriched in all cre lines in liver tissue.

FIG. 36 is a diagram of the genetic switch used in M-CREATE. The Acceptor Vector shows the position of the forward and reverse primers between the Lox sites that are used for selective recovery of capsids from the Cre+ cells. The Rep-AAPΔCap vector shows a deletion of 480 bp in Cap gene in addition to the stop codons that are designed to prevent synthesis of VP1, VP2, and VP3 proteins. AAP protein translation is unaffected by these modifications.

FIG. 37 is a schematic of the protocol to selectively recover rAAV genomes from the target population using the Cre-Lox flipping strategy and preparation of the sample for deep sequencing.

FIG. 40 shows the distributions of AAV capsid read counts for libraries recovered by NGS from brain tissue across different Cre transgenic mice post R1 selection. The dotted line is illustrative only and roughly separates the signal from noise (see Methods for estimation of signal v.s. noise) where signal in this context represents the input for the R2 selection.

FIG. 41 shows rAAV genome recovery from tissues using different treatments are shown with total rAAV genome recovery from 0.1 g of liver.

FIG. 42 shows the percentage of rAAV genomes recovered per ng of total extracted DNA.

In FIGS. 41-44, n=4 mice; 2 from GFAP-Cre line and 2 from Tek-Cre line, each data point is drawn from the mean of three technical replicates, error bar is mean±S.E.M., Mann-Whitney test, two-tailed (exact P-value of 0.0286 (*P≤0.05), in FIGS. 41, 42, and 44, and 0.1143 (n.s.,P>0.05, CI 95%) in FIG. 43). The data reported FIGS. 41, 42, and 44 are from one independent trial, and FIG. 43, from three independent trials.

FIG. 49 illustrates correlations of enrichment scores of variants from the brain libraries (n=2 per Cre line, mean is plotted) produced by synthetic pool and PCR pool methods is determined by the same method described with respect to FIG. 47.

FIG. 58 shows expression of packaging Ple261 promoter carrying iCre transgene in Ai14-tdTomato reporter adult mouse (n=2-3 per group, $3\times10^{11}$ vg dose per adult mouse, 3 weeks of expression) on the left. In the right column, FIG. 58 shows expression of self-complementary (sc) AAV-PHP.V1 carrying CB6 ubiquitous promoter driving EGFP (above) and CAG promoter driving EGFP (below). Lectin DyLight 594 staining is also shown (n=2-3, $3\times10^{11}$ vg dose per adult C57BL/6J mouse, 2 weeks of expression). Experiments in FIGS. 56, 57, and the left column of FIG. 58 are reported from one independent trial from a fresh batch of viruses, and titered in the same assay for dosage consistency. Experiments in FIG. 58 were validated in two independent trials (n=2 per group).

FIG. 60 shows Transduction of brain vasculature by AAV-PHP.V2 carrying CAG-DIO-EYFP in Tek-Cre adult mice (left, $1\times10^{12}$ vg IV dose per mouse, 4 weeks of expression), and its efficiency (right) is determined by the overlap of αGLUT1 staining with EYFP expression across different brain areas (n=2, mean of 3 images per brain region per mouse).

FIG. 61 shows transduction of astrocytes by AAV-PHP.V2 in GFAP-Cre adult mouse ($1\times10^{12}$ vg IV dose per mouse, 4 weeks of expression). Percentage of cortical S100$^+$ cells that overlapped with EYFP expression is quantified (n=2, mean of 3 images per mouse).

FIG. 62 shows transduction levels of liver hepatocytes quantified as the percentage of DAPI$^+$ cells that are EGFP$^+$ (n=3, vectors packaged with CAG-2xNLS-EGFP, $1\times10^{11}$ vg IV dose/adult C57BL/6J mouse, 3 weeks of expression, mean±S.E.M, 4 images per mouse per group). One-way ANOVA, non-parametric Kruskal-Wallis test gave an approximate P-value of 0.0088).

FIG. 63 shows transduction of brain tissue by AAV-PHP.B4, B7, AAV-PHP.X1 (ARQMDLS), and AAV-PHP.X2 (TNKVGNI) packaging CAG-mNeonGreen genome (n=3, $1\times10^{11}$ vg IV dose/adult C57BL/6J mouse, 3 weeks of expression), were acquired using the same microscope settings to that of AAV9 and AAV-PHP.V1 sagittal brain images in FIG. 14.

FIG. 64 shows transduction of the brain by AAV-PHP.B8 using the CAG-mRuby2 genome (n=3, $3\times10^{11}$ vg IV dose/adult C57BL/6J mouse, 3 weeks of expression).

FIG. 65 shows Transduction of AAV9 (left), AAV-PHP.X3 (QNVTKGV) (middle) and AAV-PHP.X4 (LNAIKNI) (right) vectors packaging CAG-2xNLS-EGFP (n=2, $1\times10^{11}$ vg IV dose/adult C57BL/6J mouse, 3 weeks of expression). Data in FIGS. 62-65 is reported from one independent trial.

FIG. 74 provides details of a spike-in library of AAV9 and ~50 additional variants (and their alternative codon duplicates), identified in prior publications (includes well characterized variants like AAV-PHP.B or AAVPHP.eB as well as many variants identified using the previous methodology but uncharacterized in vivo) act as internal selection controls and standards for the relative performance of the new variants. Deverman, B. E. et al. Cre-dependent selection yields AAV variants for widespread gene transfer to the adult brain. Nat. Biotechnol. 34, 204-209 (2016) and Chan, K. Y. et al. Engineered AAVs for efficient noninvasive gene delivery to the central and peripheral nervous systems. Nat. Neurosci. 20, 1172-1179 (2017); the content of each of which is incorporated herein by reference. The spike-in library was generated as part of the synthetic pool library.

FIG. 75 shows enrichment scores for the spike-in library.

DETAILED DESCRIPTION

Figure 1:
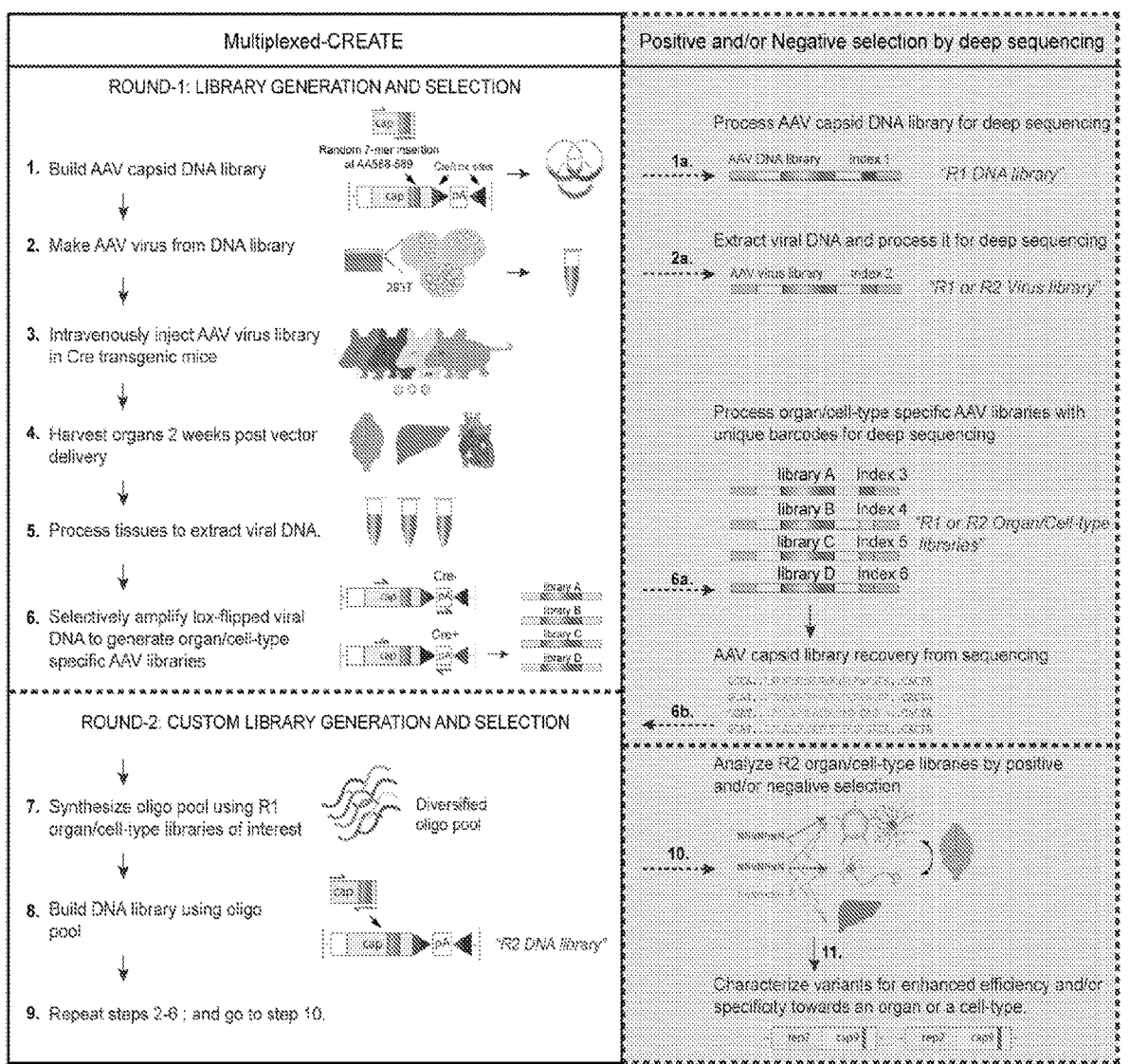
FIG. 1 shows a multiplexed selection approach to identify capsids with specific and broad tropisms. Steps 1-6 describe the workflow in Round-1 (R1) selection, steps 7-9 describe Round-2 (R2) selection using synthetic pool method, steps 1a, 2a, and 6a-b show the incorporation of deep sequencing to recover capsids after R1 and R2 selection, and steps 10-11 describe positive and/or negative selection criteria followed by variant characterization.

While preferred instances of the present disclosure have been shown and described herein, it will be obvious to those skilled in the art that such instances are provided by way of example only. Numerous variations, changes, and substitutions will now occur to those skilled in the art without departing from the disclosure. It should be understood that various alternatives to the instances of the disclosure described herein may be employed in practicing the disclosure. It is intended that the following claims define the scope of the disclosure and that methods and structures within the scope of these claims and their equivalents be covered thereby.

Provided herein are modified adeno-associated (AAV) virus capsid compositions useful for integrating a transgene into a target cell or environment (e.g., a cell-type or tissue) in a subject when they are administered systemically (e.g., intravenous, intranasal) to the subject. The modified AAV capsid proteins of the present disclosure comprise at least one insertion or substitution of an amino acid in a corresponding parental AAV capsid protein that confers a desired tropism such as an increased or decreased specificity as compared to a reference AAV capsid protein, or increased or decreased transgene transduction efficiency as compared to a reference AAV capsid protein.

Disclosed herein are AAV capsids engineered with desired tropisms, such as an increased specificity of viral transduction in a target in vivo environment, such as a tissue or cell. In some embodiments, the AAV capsids of the present disclosure are engineered to specifically target the central nervous system (CNS) of a subject. In some embodiments, the AAV capsids of the present disclosure are engineered to specifically target the liver of a subject. The AAV capsids can encapsidate a viral vector with a heterologous nucleic acid encoding, for example, a therapeutic gene expression product. Highly specific transduction of the heterologous nucleic acid in a target in vivo environment (e.g., brain, liver) can be achieved upon systemic delivery to a subject of the AAV capsid of the present disclosure encapsidating a heterologous nucleic acid. The AAV capsids disclosed herein are advantageous for many applications, such as diagnosing and/or treating monogenetic disorders of the brain (e.g., GLUT1-deficiency syndrome, mucoploysaccharidosis type IIIC), producing adoptive cellular therapies, and biomedical research applications.

The AAV capsids comprise AAV capsid proteins (e.g., VP1, VP2, and VP3), each with an insertion or a substitution of at least one amino acid at an amino acid in the 588 loop of a parental AAV capsid protein structure (AAV9 VP1 numbering). The 588 loop contains the site of heparan sulfate binding of AAV2 and amenable to peptide display. The only known receptors for AAV9 is N-linked terminal galactose and AAV receptor (AAVR), but many indications point toward there being others. Modifications to AAV9 588 loop are shown herein to confer an increased specificity and transgene transduction in target in vivo environments as compared to a reference AAV in rodent models. In some cases, the parental AAV capsid protein has an AAV serotype 9 (alias AAV9).

The most common method of AAV-mediated transgene delivery is by direct injection to the target in vivo environment, which is disadvantageous for many reasons, including risk of injury or death, pain, and higher cost, as compared to less invasive methods. For example, intracranial injection can cause hemorrhaging of the brain. Previous AAV-mediated delivery by intravenous administration avoids a need for a direct injection, but suffers from reduced specificity for the target in vivo environment (e.g., tissue or cell) resulting in off-target transduction events and necessitating a larger viral load to achieve sufficient therapeutic levels in the target in vivo environment. This is especially evident when the AAV must cross the blood brain barrier (BBB).

Methods are disclosed comprising systemically administering an AAV capsid of the present disclosure encapsidating a viral vector comprising a transgene (e.g., therapeutic nucleic acid) with an increased specificity, as compared to a reference AAV capsid protein. The AAV capsids of the present disclosure are capable of crossing the BBB, and transducing a transgene in a particular target cell-type (e.g., neuron, endothelial cell) in a subject. Accordingly, the AAV capsid proteins of the present disclosure are suitable for transgene therapy to treat human disease, particularly disease that effects the target in vivo environment.

The transgenes contained in a recombinant AAV (rAAV) vector and encapsidated by the AAV capsid proteins of the present disclosure are also provided herein. The transgenes disclosed herein are delivered to a subject for a variety of purposes, such as to treat a disease or condition in the subject. The transgene can be gene editing components that modulate the activity or expression of a target gene or gene expression product. Alternatively, the transgene is a gene encoding a therapeutic gene expression product that is effective to modulate the activity or expression of itself, or another target gene or gene expression product.

Provided herein, are methods of identifying the 7-mer or 3-mer peptide insertions comprising multiplexed Cre recombination-based AAV targeted evolution (M-CREATE). The M-CREATE method of the present disclosure supports (1) the calculation of a true enrichment score for each variant by using deep sequencing to correct for biases in viral production prior to selection, (2) reduced propagation of bias in successive rounds of selection through the creation of a post-round 1 synthetic pool library with equal variant representation, (3) the reduction of false positives by including two codon replicates of each selected variant in the pool, and (4) both positive and negative selection criteria by comparing deep sequencing of recovered capsid libraries among multiple targets (cells types or organs). These features allow informed, confident choices on variants worthy of validation and characterization in vivo.

Disclosed herein are methods of producing the AAV capsids comprising the AAV capsid proteins and viral vector encoding a therapeutic nucleic acid. The AAV capsid proteins are produced by introducing into a cell (e.g., immortalized stem cell) a first vector encoding the transgene (e.g., containing the therapeutic nucleic acid), a second vector encoding the AAV genome with a AAV capsid protein, and a third vector encoding helper virus proteins, required for assembly of the AAV capsid structure and packaging of the transgene in the AAV capsid. The assembled AAV capsid can be isolated and purified from the cell using suitable methods known in the art.

The recombinant AAV vectors comprising a nucleic acid sequence encoding the AAV capsid proteins of the present disclosure as also provided herein. For example, the viral vectors of the present disclosure comprise a nucleic acid sequence comprising the AAV viral Cap (Capsid) encoding VP1, VP2, and VP3, at least one of which is modified to produce the AAV capsid proteins of the present disclosure. The recombinant AAV vector provided can be derived from an AAV serotype (e.g., AAV9).

I. Compositions

Recombinant adeno-associated virus (rAAV) mediated gene delivery leverages the AAV mechanism of viral transduction for nuclear expression of an episomal heterologous nucleic acid (e.g., a transgene, therapeutic nucleic acid). Upon delivery to a host in vivo environment, a rAAV will (1) bind or attach to cellular surface receptors on the target cell, (2) endocytose, (3) traffic to the nucleus, (4) uncoat the virus to release the encapsidated heterologous nucleic acid, (5) convert of the heterologous nucleic acid from single-stranded to double-stranded DNA as a template for transcription in the nucleus, and (6) transcribe of the episomal heterologous nucleic acid in the nucleus of the host cell ("transduction"). rAAVs engineered to have an increased specificity (binding to cellular surface receptors on the target cell) and transduction efficiency (transcription of the episomal heterologous nucleic acid in the host cell) are desirable for gene therapy applications.

Figure 2:
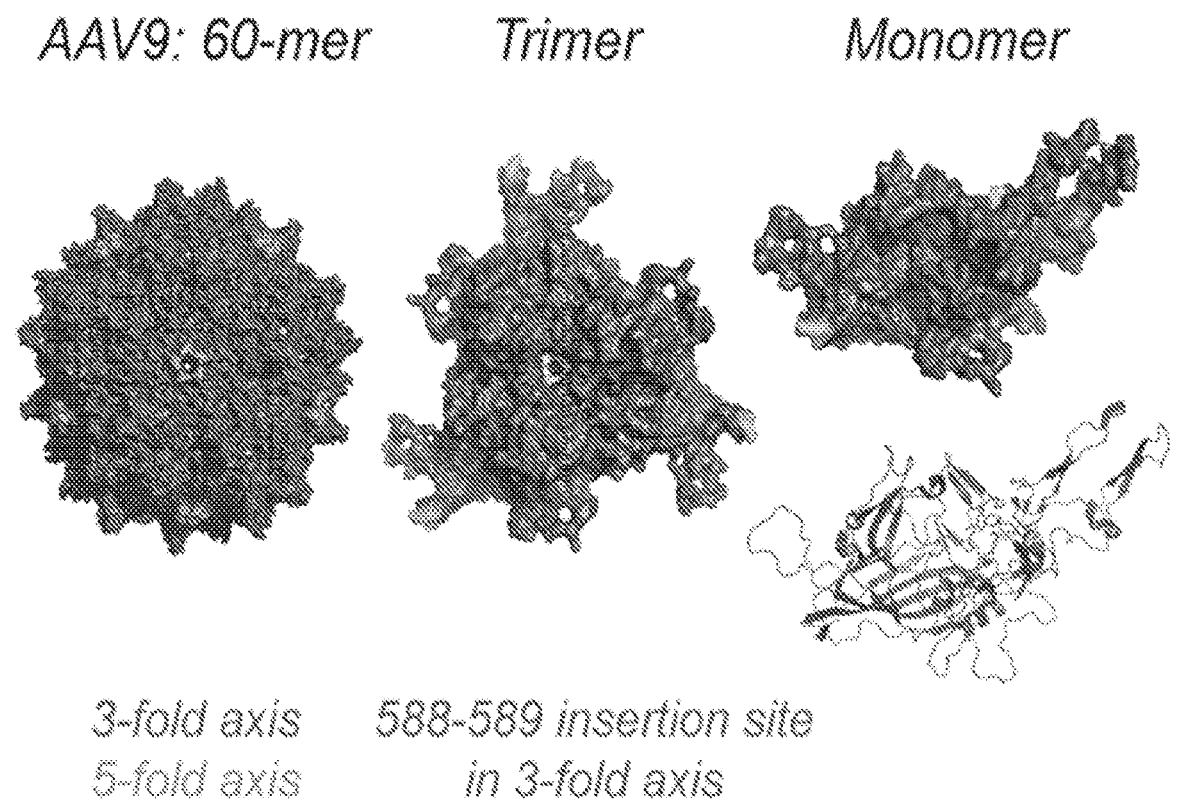
FIG. 2 shows a structural model of the AAV9 capsid (PDB 3UX1) with the insertion site for the 7-mer-i library highlighted in red in the 60-meric (left), trimeric (middle), and monomeric (right) forms.

A rAAV comprises an AAV capsid that can be engineered to encapsidate a heterologous nucleic acid (e.g., therapeutic nucleic acid, gene editing machinery). The AAV capsid is made up of three AAV capsid protein monomers, VP1, VP2, and VP3. Sixty copies of these three VP proteins interact in a 1:1:10 ratio to form the viral capsid (FIG. 2). VP1 covers the whole of VP2 protein in addition to a ~137 amino acid N-terminal region (VP1u), VP2 covers the whole of VP3 in addition to ~65 amino acid N-terminal region (VP1/2 common region). The three capsid proteins share a conserved amino acid sequence of VP3, which in some cases is the region beginning at amino acid position 138 (e.g., AA139-736).

The AAV VP3 structure contains highly conserved regions that are common to all serotypes, a core eight-stranded β-barrel motif (βB-βI) and a small α-helix (αA). The loop regions inserted between the β-strands consist of the distinctive HI loop between β-strands H and I, the DE loop between β-strands D and E, and nine variable regions (VRs), which form the top of the loops. These VRs, such as the AA588 loop, are found on the capsid surface and can be associated with specific functional roles in the AAV life cycle including receptor binding, transduction and antigenic specificity.

Disclosed herein are AAV capsids comprising AAV capsid proteins with a substitution at the 588 loop that confer a desired tropism characterized by a higher specificity for transduction in specific cell-types, including for e.g., brain cell types (e.g., brain endothelial cells, neurons, astrocytes) and liver cell types. In particular, the AAV capsid proteins disclosed herein enable rAAV-mediated transduction of a heterologous nucleic acid (e.g., transgene) in the brain or the liver of a subject. The AAV capsids of the present disclosure, or the AAV capsid proteins, may be formulated as a pharmaceutical composition. In addition, the AAV capsids or the AAV capsid proteins can be isolated and purified to be used for a variety of applications.

A. Adeno-Associated Virus (AAV) Capsid Proteins

Disclosed herein are recombinant AAV (rAAV) capsids comprise AAV capsid proteins that are engineered with a modified capsid protein (e.g., VP1, VP2, VP3). In some embodiments, the rAAV capsid proteins of the present disclosure are generated using the methods disclosed herein (e.g., M-CREATE). In some embodiments, the AAV capsid proteins are used in the methods of delivering a therapeutic nucleic acid (e.g., a transgene) to a subject. In some instances, the rAAV capsid proteins have desired AAV tropisms rendering them particularly suitable for certain therapeutic applications, e.g., the treatment of a disease or disorder in a subject such as those disclosed herein.

The rAAV capsid proteins are engineered for optimized entry into and through the blood brain barrier (BBB) of a subject upon systemic administration of the rAAV to the subject, such as those provided in Tables 2-3, and FIG. 33. Prior methods of AAV-mediated delivery of a therapeutic transgene to the brain required intracranial injection. Intracranial injection is an invasive procedure that causes a subject discomfort, and in some cases, pain. For example, intracranial injection can cause hemorrhaging of the brain. Additionally, intracranial delivery has limited spread and is highly heterogeneous. The rAAV capsid proteins provided in Tables 2-4, and FIG. 33 are engineered to have tropisms that eliminate the need for intracranial injection, while also achieving widespread and efficient transduction of an encapsidated transgene. In particular, the tropisms comprise at least one of an increased specificity and efficiency (e.g., of viral transduction) in the central nervous system (CNS) of a subject, as compared to a reference AAV.

The engineered AAV capsid proteins described herein have, in some cases, an insertion of an amino acid that is heterologous to the parental AAV capsid protein at the amino acid position in the 588 loop. In some embodiments, the amino acid is not endogenous to the parental AAV capsid protein at the amino acid position of the insertion. The amino acid may be a naturally occurring amino acid in the same or equivalent amino acid position as the insertion of the substitution in a different AAV capsid protein.

Aspects provided herein provide amino acid insertions comprising seven amino acid polymer (7-mer) inserted at AA588_589, and may additionally include a substitution of one or two amino acids at amino acid positions flanking the 7-mer sequence (e.g., AA587-588 and/or AA589-590) to produce an eleven amino acid polymer (11-mer) at the 588 loop of a parental AAV capsid protein. The 7-mers described herein were advantageously generated using polymerase chain reaction (PCR) with degenerate primers, where each of the seven amino acids is encoded by a deoxyribose nucleic acid (DNA) sequence N-N-K. "N" is any of the four DNA nucleotides and K is guanine (G) or thymine (T). This method of generating random 7-mer amino acid sequences enables 1.28 billion possible combinations at the protein level. Since the 7-mers developed are random, some amino acids in the 7-mer may be naturally occurring in the AAC capsid protein at that amino acid position, while other amino acids may differ.

Recombinant AAVs (rAAVs) were generated, each with a unique 7-mer or 11-mer at the 588 loop and each encapsidating a reporter gene that, when administered systemically in multiple transgenic animals, enabled the selective amplification and recovery of sequences that effectively transduced the reporter gene in a target in vivo environment of the transgenic animal. 7-mers and 11-mers that were found to be positively enriched in the target in vivo environment (e.g, central nervous system, liver) are provided herein. "Enrichment" is the prevalence of a given 7-mer or an 11-mer in the tissue of the in vivo environment compared to its prevalence in the viral library that was administered to the transgenic animal. An enrichment score above 0 indicates a positive enrichment. An enrichment score below 0 indicates a negative enrichment. A subset of the rAAVs with desired enrichment profiles were tested individually in vivo to determine exact systemic expression (e.g., specificity and transduction efficiency). rAAVs from this subset exhibiting a desired tropism comprising increased specificity of viral transduction, and in some cases, transduction efficiency are considered to be uniquely suited for targeted rAAV-mediated transgene delivery useful for a wide variety of purposes (e.g., therapeutic, diagnostic, scientific discovery).

The rAAV particles with the 7-mers or 11-mers described herein have an increased transduction efficiency in a target in vivo environment (e.g., tissue or cell type). In some instances, the increased transduction efficiency comprises a 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold increase, or more, relative to a reference AAV. In some instances, the increased transduction efficiency is at least 30-fold. In some instances, the increased transduction efficiency is at least 40-fold. In some instances, the increased transduction efficiency is at least 50-fold. In some instances, the increased transduction efficiency is at least 60-fold. In some instances, the increased transduction efficiency is at least 80-fold. In some instances, the increased transduction efficiency is at least 90-fold. In some instances, the increased transduction efficiency is at least 100-fold.

The rAAV particles with the 7-mers or 11-mers described herein have an increased specificity in a target in vivo environment (e.g., tissue or cell type), as compared to a reference AAV. Detecting whether a rAAV possesses more or less specificity for a target in vivo environment than a reference AAV, includes measuring a level of gene expression product (e.g., RNA or protein) expressed from the heterologous nucleic acid encapsidated by the rAAV in a tissue sample obtained from the target in vivo environment in a subject; and comparing the measured level to a control level (such as, for e.g., the gene expression product expressed from a heterologous nucleic acid encapsidated by a reference AAV (e.g., AAV9)). Suitable methods for measuring expression of a gene expression product luciferase reporter assay and quantitative polymerase chain reaction (qPCR).

The increased specificity is correlated with an increased enrichment in the target in vivo environment, which in some cases is represented with an enrichment score provided herein in FIGS. 33-35. As a non-limiting example, AAV-PHP.V2 (TTLKPFL), which is shown herein to be positively enriched in the brain (enrichment score of ~2.51) also exhibited an increase in reporter gene expression (e.g., measured by fluorescence reporter assay) in the brain (~60% of cortical brain vasculature cells and ~60% cortical astrocytes transduced with the reporter gene) as compared to a reference AAV9 (~0%). Without being bound by a particular theory, the inventors of the present disclosure would expect to see this correlation for all rAAVs disclosed herein, and further, would expect that a more significant the enrichment score (whether negative or positive) would correlate with a more significant specificity to the in vivo environment(s) as indicated by a measured level of the gene expression product in the in vivo environment(s).

Transduction efficiency, as disclosed herein, may be measured by at least one of (1) a number of cells in a target in vivo or off-target in vivo environment expressing the heterologous nucleic acid encapsidated by the modified AAV capsid proteins disclosed herein, and (2) a quantity of expression of the heterologous nucleic acid in a single cell. Specificity for a target in vivo environment may be inferred when a presence, or an increase in a level, of rAAV-mediated transduction in a target in vivo environment is observed, as compared to a reference AAV. A lack of, or reduced, specificity to an off-target in vivo environment may be inferred when an absence, or a decrease in a level, of rAAV-mediated transduction in the off-target in vivo environment is observed, as compared to a reference AAV.

The reference AAV may have a serotype selected from the group consisting of AAV1, AAV2, AAV3, AAV4, AAVS, AAV6, AAV7, AAV8, AAV9, AAV10, AAV11, AAV12, or variant thereof. For example, the reference AAV can have a serotype selected from the group consisting of AAV-PHP.B, AAV-PHP.eB, and AAV-PHP.S.

The rAAV capsid proteins of the present disclosure comprise an insertion of an amino acid in an amino acid sequence of an AAV capsid protein. The AAV capsid, from which an engineered AAV capsid protein of the present disclosure is produced, is referred to as a "parental" AAV capsid. In some cases, the parental AAV has a serotype selected from the group consisting of AAV1, AAV2, AAV3, AAV4, AAV5, AAV6, AAV7, AAV8, AAV9, AAV10, AAV11, and AAV12. The complete genome of AAV-1 is provided in GenBank Accession No. NC_002077; the complete genome of AAV-2 is provided in GenBank Accession No. NC_001401 and Srivastava et al., J. Virol., 45: 555-564 (1983); the complete genome of AAV-3 is provided in GenBank Accession No. NC_1829; the complete genome of AAV-4 is provided in GenBank Accession No. NC_001829; the AAV-5 genome is provided in GenBank Accession No. AF085716; the complete genome of AAV-6 is provided in GenBank Accession No. NC_00 1862; at least portions of AAV-7 and AAV-8 genomes are provided in GenBank Accession Nos. AX753246 and AX753249, respectively; the AAV-9 genome is provided in Gao et al., J. Virol., 78: 6381-6388 (2004); the AAV-10 genome is provided in Mol. Ther., 13(1): 67-76 (2006); the AAV-11 genome is provided in Virology, 330(2): 375-383 (2004); portions of the AAV-12 genome are provided in Genbank Accession No. DQ813647; portions of the AAV-13 genome are provided in Genbank Accession No. EU285562.

In some cases, the parental AAV is derived from an AAV with a serotype selected from the group consisting of AAV1, AAV2, AAV3, AAV4, AAV5, AAV6, AAV7, AAV8, AAV9, AAV10, AAV11, and AAV12. The AAV capsid protein that is "derived" from another may be a variant AAV capsid protein. A variant may include, for example, a heterologous amino acid in an amino acid sequence of the AAV capsid protein. The heterologous amino acid may be non-naturally occurring in the AAV capsid protein. The heterologous amino acid may be naturally occurring in a different AAV capsid protein. In some instances, the parental AAV capsid is described in U.S. Pat. App. Ser. Nos. 62/736,904; 16/582, 635; 62/832,812; and 62/832,826; the content of each of which is incorporated herein. For example, the parental AAV capsid may be modified at the 455 loop of the AAV capsid protein (e.g., substitutions of 7-mer at AA452-458, AAV9 VP1 numbering).

In some instances, the parental AAV is AAV9. In some instances, the amino acid sequence of the AAV9 capsid protein comprises SEQ ID NO: 1. The amino acid sequence of AAV9 VP1 capsid protein (>trlQ6JC40|Q6JC40_9VIRU Capsid protein VP1 OS=Adeno-associated virus 9 OX= 235455 GN=cap PE=1 SV=1) is provided in SEQ ID NO: 1 (MAADGYLPDWLEDNLSEGIREWWALKPGAPQPKA NQQHQDNARGLVLPGYKYLGPG NGLDKGEPVNAA DAAALEHDKAYDQQLKAGDNPYLKYNHADAEF QERLKEDTSFGG NLGRAVFQAKKRLLEPLGLVEEA AKTAPGKKRPVEQSPQEPDSSAGIGKSGAQPAKKRL NFGQTGDTESVPDPQPIGEPPAAPSGVGSLTMASGG-GAPVADNNEGADGVGSSSGNWH CDSQWLGDRVI TTSTRTWALPTYNNHLYKQISNSTSGGSSNDNAYFG YSTPWGYFDFN RFHCHFSPRDWQRLINNNWGFRP KRLNFKLFNIQVKEVTDNNGVKTIANNLTSTVQVFT DSDYQLPYVLGSAHEGCLPPFPADVFMIPQYGYLTL NDGSQAVGRSSFYCLEYFPSQML RTGNNFQFSYEFE NVPFHSSYAHSQSLDRLMNPLIDQYLYYLSKTINGSG QNQQTLKFSV AGPSNMAVQGRNYIPGPSYRQ QR V STTVTQNNNSEFAWPGASSWALNGRNSLMNPGP AMASHKEGEDRFFPLSGSLIFGKQGTGRDNVDAD-KVMITNEEEIKTTNPVATESYGQVA TNHQSAQAQA QTGWVQNQGILPGMVWQDRDVYLQGPIWAKIPH-TDGNFHPSPLMGGF GMKHPPPQILIKNTPVPADPP TAFNKDKLNSFITQYSTGQVSVEIEWELQKEN SKR WNPE IQYTSNYYKSNNVEFAVNTEGVYSEPRPI GTRYLTRNL). In some instances, the parental AAV capsid protein sequence is 70%, 75%, 80%, 85%, 90%, 91%, 92%, 93%, 94%, 95%, 96%, 97%, 98%, 99%, or 100% homologous to SEQ ID NO: 1.

Disclosed herein are insertions of an amino acid (or amino acid sequence) in an amino acid sequence of an AAV capsid protein at an amino acid position between amino acid 588 and amino acid 589. As used herein, "AA588_589" indicates that the insertion of the amino acid (or amino acid sequence) is immediately after an amino acid (AA) at position 588 and immediately before an AA at position 589 within an amino acid sequence of a parental AAV VP capsid protein (VP1 numbering). Amino acids 587-591 include a motif comprising "AQAQA" as set forth in SEQ ID NO: 1. Exemplary AAV capsid protein sequences are provided in Table 1. For example, QAVRTSL is inserted at AA588_589 in an AAV9 capsid amino acid sequence, and is provided SEQ ID NO: 3. In another example, TLAVPFK is inserted at AA588_589 in an AAV9 capsid amino acid sequence, and is provided in SEQ ID NO: 2. It is envisioned that the 7-mer insertions disclosed herein (FIGS. 33-35, Tables 2-4) may be inserted at AA588_589 in an amino acid sequence of a parental AAV9 capsid protein, a variant thereof, or equivalent amino acid position a parental AAV of a different serotype (e.g., AAV1, AAV2, AAV3, and the like).

The 11-mers described herein may, in some cases, comprise a 7-mer insertion at AA588_589, and substitutions of one or more amino acids at amino acid positions AA587-590. In some cases, the amino acids 587-590 are substituted with an amino acid that is not endogenous to the parental AAV capsid protein at that position. In some cases, AA587 is substituted with D (e.g., A587D). In some cases, AA587 is substituted with an A (e.g., Q587A). In some cases, AA587 is substituted with an S (e.g., Q587S). In some cases, AA587 is substituted with a G (e.g., Q587G). In some cases, AA588 is substituted with a G (e.g., Q588G). In some cases, AA589 is substituted with an N (e.g., A589N). In some cases, AA590 is substituted with a P (e.g., A590). In a non-limiting example SEQ ID NO: 4 (PHP-AAV.eB) comprises an insertion at AA588_AA589 of TLAVPFK, and substitutions A587D and Q588G. In another non-limiting example, SEQ ID NO: 5 (PHP-AAV.N) comprises an insertion at AA588_AA589 of TTLKPFS, and substitutions A587D, Q588G, A589N, and Q590P. It is envisioned that any 7-mer insertion disclosed herein in addition to a substitution with any amino acid at amino acid positions 587-590 may comprise an 11-mer.

TABLE 1

| SEQ ID NO: | Identifier | Sequence |
|---|---|---|
| | | Exemplary AAV Capsid Protein Sequences |
| 2 | AAV-PHP.B | MAADGYLPDWLEDNLSEGIREWWALKPGAPQPKANQQHQDN ARGLVLPGYKYLGPGNGLDKGEPVNAADAAALEHDKAYDQQ LKAGDNPYLKYNHADAEFQERLKEDTSFGGNLGRAVFQAKK RLLEPLGLVEEAAKTAPGKKRPVEQSPQEPDSSAGIGKSGAQP AKKRLNFGQTGDTESVPDPQPIGEPPAAPSGVGSLTMASGGGA PVADNNEGADGVGSSSGNWHCDSQWLGDRVITTSTRTWALPT YNNHLYKQISNSTSGGSSNDNAYFGYSTPWGYFDFNRFHCHFS PRDWQRLINNNWGFRPKRLNFKLFNIQVKEVTDNNGVKTIAN NLTSTVQVFTDSDYQLPYVLGSAHEGCLPPFPADVFMIPQYGY LTLNDGSQAVGRSSFYCLEYFPSQMLRTGNNFQFSYEFENVPF HSSYAHSQSLDRLMNPLIDQYLYYLSRTINGSGQNQQTLKFSV AGPSNMAVQGRNYIPGPSYRQQRVSTTVTQNNNSEFAWPGAS SWALNGRNSLMNPGPAMASHKEGEDRFFPLSGSLIFGKQGTG RDNVDADKVMITNEEEIKTTNPVATESYGQVATNHQSAQTLA VPFKAQAQTGWVQNQGILPGMVWQDRDVYLQGPIWAKIPHT DGNFHPSPLMGGFGMKHPPPQILIKNTPVPADPPTAFNKDKLN SFITQYSTGQVSVEIEWELQKENSKRWNPEIQYTSNYYKSNNV EFAVNTEGVYSEPRPIGTRYLTRNL |
| 3 | AAV-PHP.S | MAADGYLPDWLEDNLSEGIREWWALKPGAPQPKANQQHQDN ARGLVLPGYKYLGPGNGLDKGEPVNAADAAALEHDKAYDQQ LKAGDNPYLKYNHADAEFQERLKEDTSFGGNLGRAVFQAKK RLLEPLGLVEEAAKTAPGKKRPVEQSPQEPDSSAGIGKSGAQP AKKRLNFGQTGDTESVPDPQPIGEPPAAPSGVGSLTMASGGGA PVADNNEGADGVGSSSGNWHCDSQWLGDRVITTSTRTWALPT |

TABLE 1-continued

Exemplary AAV Capsid Protein Sequences

| SEQ ID NO: | Identifier | Sequence |
|---|---|---|
| | | YNNHLYKQISNSTSGGSSNDNAYFGYSTPWGYFDFNRFHCHFS PRDWQRLINNNWGFRPKRLNFKLFNIQVKEVTDNNGVKTIAN NLTSTVQVFTDSDYQLPYVLGSAHEGCLPPFPADVFMIPQYGY LTLNDGSQAVGRSSFYCLEYFPSQMLRTGNNFQFSYEFENVPF HSSYAHSQSLDRLMNPLIDQYLYYLSRTINGSGQNQQTLKFSV AGPSNMAVQGRNYIPGPSYRQQRVSTTVTQNNNSEFAWPGAS SWALNGRNSLMNPGPAMASHKEGEDRFFPLSGSLIFGKQGTG RDNVDADKVMITNEEEIKTTNPVATESYGQVATNHQSAQQAV RTSLAQAQTGWVQNQGILPGMVWQDRDVYLQGPIWAKIPHT DGNFHPSPLMGGFGMKHPPPQILIKNTPVPADPPTAFNKDKLN SFITQYSTGQVSVEIEWELQKENSKRWNPEIQYTSNYYKSNNV EFAVNTEGVYSEPRPIGTRYLTRNL |
| 4 | AAV-PHP.eB | MAADGYLPDWLEDNLSEGIREWWALKPGAPQPKANQQHQDN ARGLVLPGYKYLGPGNGLDKGEPVNAADAAALEHDKAYDQQ LKAGDNPYLKYNHADAEFQERLKEDTSFGGNLGRAVFQAKK RLLEPLGLVEEAAKTAPGKKRPVEQSPQEPDSSAGIGKSGAQP AKKRLNFGQTGDTESVPDPQPIGEPPAAPSGVGSLTMASGGGA PVADNNEGADGVGSSSGNWHCDSQWLGDRVITTSTRTWALPT YNNHLYKQISNSTSGGSSNDNAYFGYSTPWGYFDFNRFHCHFS PRDWQRLINNNWGFRPKRLNFKLFNIQVKEVTDNNGVKTIAN NLTSTVQVFTDSDYQLPYVLGSAHEGCLPPFPADVFMIPQYGY LTLNDGSQAVGRSSFYCLEYFPSQMLRTGNNFQFSYEFENVPF HSSYAHSQSLDRLMNPLIDQYLYYLSRTINGSGQNQQTLKFSV AGPSNMAVQGRNYIPGPSYRQQRVSTTVTQNNNSEFAWPGAS SWALNGRNSLMNPGPAMASHKEGEDRFFPLSGSLIFGKQGTG RDNVDADKVMITNEEEIKTTNPVATESYGQVATNHQSDGTLA VPFKAQAQTGWVQNQGILPGMVWQDRDVYLQGPIWAKIPHT DGNFHPSPLMGGFGMKHPPPQILIKNTPVPADPPTAFNKDKLN SFITQYSTGQVSVEIEWELQKENSKRWNPEIQYTSNYYKSNNV EFAVNTEGVYSEPRPIGTRYLTRNL |
| 5 | AAV-PHP.N | MAADGYLPDWLEDNLSEGIREWWALKPGAPQPKANQQHQDN ARGLVLPGYKYLGPGNGLDKGEPVNAADAAALEHDKAYDQQ LKAGDNPYLKYNHADAEFQERLKEDTSFGGNLGRAVFQAKK RLLEPLGLVEEAAKTAPGKKRPVEQSPQEPDSSAGIGKSGAQP AKKRLNFGQTGDTESVPDPQPIGEPPAAPSGVGSLTMASGGGA PVADNNEGADGVGSSSGNWHCDSQWLGDRVITTSTRTWALPT YNNHLYKQISNSTSGGSSNDNAYFGYSTPWGYFDFNRFHCHFS PRDWQRLINNNWGFRPKRLNFKLFNIQVKEVTDNNGVKTIAN NLTSTVQVFTDSDYQLPYVLGSAHEGCLPPFPADVFMIPQYGY LTLNDGSQAVGRSSFYCLEYFPSQMLRTGNNFQFSYEFENVPF HSSYAHSQSLDRLMNPLIDQYLYYLSRTINGSGQNQQTLKFSV AGPSNMAVQGRNYIPGPSYRQQRVSTTVTQNNNSEFAWPGAS SWALNGRNSLMNPGPAMASHKEGEDRFFPLSGSLIFGKQGTG RDNVDADKVMITNEEEIKTTNPVATESYGQVATNHQSAQTLA VPFSNPAQTGWVQNQGILPGMVWQDRDVYLQGPIWAKIPHT DGNFHPSPLMGGFGMKHPPPQILIKNTPVPADPPTAFNKDKLN SFITQYSTGQVSVEIEWELQKENSKRWNPEIQYTSNYYKSNNV EFAVNTEGVYSEPRPIGTRYLTRNL |

The rAAV capsid proteins described herein may be isolated and purified. The AAV may be isolated and purified by methods standard in the art such as by column chromatography or cesium chloride gradients. Methods for purifying AAV from helper virus are known in the art and may include methods disclosed in, for example, Clark et al., Hum. Gene Ther., 10(6): 1031-1039 (1999); Schenpp and Clark, Methods Mol. Med., 69: 427-443 (2002); U.S. Pat. No. 6,566,118 and WO 98/09657.

The rAAV capsid protein can be conjugated to a nanoparticle, a second molecule, or a viral capsid protein. In some cases, the nanoparticle or viral capsid protein would encapsidate the therapeutic nucleic acid described herein. In some instances, the second molecule is a therapeutic agent, e.g., a small molecule, antibody, antigen-binding fragment, peptide, or protein, such as those described herein. In some instances, the second molecule is a detectable moiety. For example, the modified AAV capsid protein conjugated to a detectable moiety may be used for in vitro, ex vivo, or in vivo biomedical research applications, the detectable moiety used to visualize the modified capsid protein. The modified AAV capsid protein conjugated to a detectable moiety may also be used for diagnostic purposes.

AAV Capsid Proteins Targeting the Central Nervous System

Disclosed herein are AAV capsid proteins with a substitution or an insertion of at least one amino acid at an amino acid position described above in a parental AAV capsid protein that confers an increased specificity for a central nervous system (CNS) or peripheral nervous system (PNS) in a subject, even when delivered systemically. One of the many advantages of the AAV capsid proteins described herein is their ability to target the CNS and penetrate the blood brain barrier (BBB).

The in vivo environment can be a cell. The cell can be a cell-type selected from the group consisting of a central nervous system (CNS) cell and a peripheral nervous system (PNS) cell. Non-limiting examples of CNS cells include a neuron and a glial cell. Glial cells can be selected from the group consisting of an oligodendrocyte, an ependymal cell, and an astrocyte. Non-limiting examples of a PNS cell includes a neuron or a glial cell. The glial cell can be selected from the group consisting of a Schwann cell, a satellite cell, and an enteric glial cell.

The in vivo environment can be a tissue. The tissue can be the brain, or the spinal cord. The tissue can be a region of an organ, example, the cerebrum, the cerebellum, the brainstem, the cortex, the striatum, the thalamus, the lateral ventricles, the putamen, the hypothalamus, the medulla, the pons, the hippocampus, the amygdala, the motor cortex, or a combination thereof.

Disclosed herein are AAV capsid proteins with at least one amino acid insertion or substitution in a parental AAV capsid protein. The insertion or substitution can be of at least one, two, three, four, five, six, seven, eight, nine, ten, or eleven amino acids, or more. In some instances, the amino acids are contiguous. In some instances, the amino acids are not contiguous.

Figure 6:
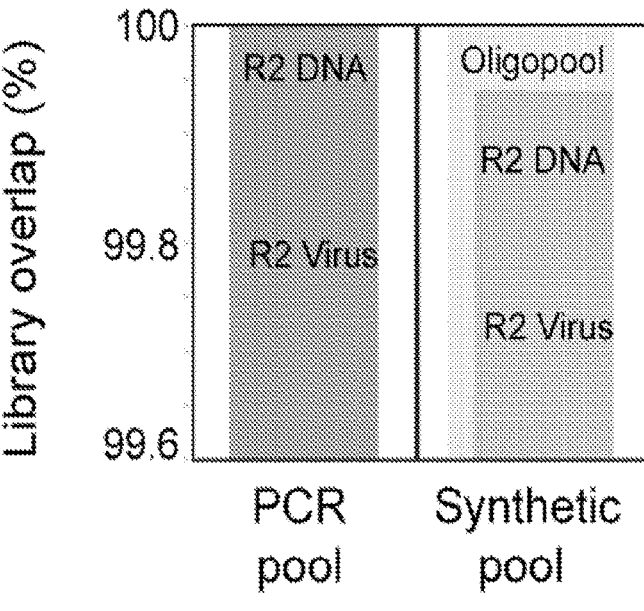
FIG. 6 shows an overlapping bar chart showing the percentage of library overlap between the mentioned libraries and their theoretical composition.

In some instances, the insertion is of at least one amino acid is provided in any one of the sequences provided in any one of Tables 2-3, or FIG. 6. In some instances, the insertion is of at least two amino acids provided in any one of the sequences provided in any one of Tables 2-3, or FIG. 6. In some instances, the insertion is of at least three amino acids provided in any one of the sequences provided in any one of Tables 2-3, or FIG. 6. In some instances, the insertion is of at least four amino acids provided in any one of the sequences provided in any one of Tables 2-3, or FIG. 6. In some instances, the insertion is of at least five amino acids provided in any one of Tables 2-3, or FIG. 6. In some instances, the insertion is of at least six amino acids provided in any one of Tables 2-3, or FIG. 6. In some instances, the insertion is of at least seven amino acids provided in any one of Tables 2-3, or FIG. 6.

Disclosed herein are AAV capsid proteins with an insertion of at least one amino acid X1, wherein X1 is selected from the group consisting of A, E, D, G, R, S and T. In some instances, the insertion further comprises two amino acids, wherein X2 is selected from the group consisting of A, G, I, L, M, N, Q, R, T, and Y. In some instances, the insertion further comprises three amino acids, wherein X3 is selected from the group consisting of E, K, L, T, and Q. In some instances, the insertion further comprises at least four amino acids, wherein X1 is selected from the group consisting of A, E, D, G, R, S and T, X2 is selected from the group consisting of A, G, I, L, M, N, Q, R, T, and Y, X3 is selected from the group consisting of E, K, L, T, and Q, and X4 is selected from the group consisting of G, I, K, L, M, R, T, and V. In some instances, the insertion further comprises five amino acids wherein X5 is selected from the group consisting of A, D, G, P, L, Q, and V. In some instances, the insertion further comprises at least six amino acids, wherein X6 is selected from the group consisting of F, K, L, N, P, Q, S, and V. In some instances, the insertion further comprises at least seven amino acids, wherein X7 is selected from the group consisting of I, K, L, P, S, and V.

In some embodiments, X1, X2, X3, X4, X5, X6, and X7 are contiguous (X1-X2-X3-X4-X5-X6-X7). In some embodiments, any two of X1, X2, X3, X4, X5, X6, and X7 are contiguous. In some embodiments, any three of X1, X2, X3, X4, X5, X6, and X7 are contiguous. In some embodiments, any four of X1, X2, X3, X4, X5, X6, and X7 are contiguous. In some embodiments, any five of X1, X2, X3, X4, X5, X6, and X7 are contiguous. In some embodiments, any six of X1, X2, X3, X4, X5, X6, and X7 are contiguous. In some embodiments, any seven of X1, X2, X3, X4, X5, X6, and X7 are contiguous. In some embodiments, X1, X2, X3, X4, X5, X6, and X7 are not contiguous. In some embodiments, the insertion is not TLAVPFK.

The 7-mers disclosed herein, in some cases share a common motif. A 7-mer (X1-X2-X3-X4-X5-X6-X7) may in some cases advantageously have a T in position X1, an L in position X2, a P in positive X5, an F in position X6, and a K or L in position X7. In some embodiments, the 7-mer comprises T-L-X3-X4-P-F-K, wherein X3 and X4 are any amino acid. In some embodiments, the 7-mer comprises T-L-X3-X4-P-F-L, wherein X3 and X4 are any amino acid. In some cases, X3 is not an A. In some cases, X3 is A, S, Q, or E or L. In some cases, X4 is not a V. In some cases, X4 is R, K, V, or a Q.

In some cases, the 7-mer may be X1-L-A-V-P-F-K, wherein X1 is any amino acid other than T, S, or N; X1-X2-A-V-P-F-K, wherein X1 is any amino acid other than T, S, or N, and X2 is any amino acid other than L or V; or X1-X2-X3-V-P-F-K, wherein X1 is any amino acid other than T, S, or N, X2 is any amino acid other than L or V, and X3 is any amino acid other than A, S, Q, P, or T; or X1-X2-X3-X4-P-F-K, wherein X1 is any amino acid other than T, S, or N, X2 is any amino acid other than L or V, X3 is any amino acid other than A, S, Q, P, or T, and X4 is any amino acid other than V, T, Q, N, L, or M. In some instances, the 7-mer is T-L-A-X4-P-F-K, wherein X is any amino acid other than V. In some instances, the 7-mer is T-L-A-X4-P-F-K, wherein X is any amino acid other than, T, Q, N, L, or M.

In some cases, the 7-mer (X1-X2-X3-X4-X5-X6-X7) comprises TALKPFL. In some instances, the 7-mer comprises TTLKPFL. In some instances, the 7-mer comprises TLQIPFK. In some instances, the 7-mer comprises TMQKPFI. In some instances, the 7-mer comprises SIER-PFK. In some instances, the 7-mer comprises RYQGDSV.

In some instances, the AAV capsid protein comprises an insertion of at least or about three, four, five, six, or seven amino acids of an amino acid sequence T-X2 L K P F L at an amino acid position 588_589 in a parental AAV9 capsid protein (SEQ ID NO: 1), wherein X2 is A or T. In some cases, the AAV capsid protein has an increased specificity for viral transduction in brain vascular cells (GLUT1+), as compared to a reference AAV (e.g., AAV9). In some cases, the AAV capsid protein has increased specificity for viral tranduction in astrocytes, as compared to a reference AAV (e.g., AAV9).

In some instances, the AAV capsid protein comprises an insertion of at least or about three, four, five, six, or seven amino acids of an amino acid sequence T-X2-Q-X4-P-F-X7 at an amino acid position 588_589 in a parental AAV9 capsid protein (SEQ ID NO: 1), wherein X2 is L or M; X4 is I, K, or L; X7 is K or I. In some cases, the AAV capsid protein has increased specificity for viral transduction in neurons and astrocytes, as compared to a reference AAV (e.g., AAV9). In some instances, the amino acid sequence is TLQIPFK. In some instances, the amino acid sequence is TMQKPFI. In some instances, the amino acid sequence is TLQLPFK.

In some instances, the AAV capsid protein comprises an insertion of at least or about three, four, five, six, or seven amino acids of an amino acid sequence S-I E R P F K at an amino acid position 588_589 in a parental AAV9 capsid protein (SEQ ID NO: 1). In some cases, the AAV capsid protein has increased specificity for viral transduction in neurons and astrocytes, as compared to a reference AAV (e.g., AAV9).

In some instances, the AAV capsid protein comprises an insertion of at least or about three, four, five, six, or seven amino acids of an amino acid sequence R-Y-Q-G-D-S-V at an amino acid position 588_589 in a parental AAV9 capsid protein (SEQ ID NO: 1). In some cases, the AAV capsid protein has increased specificity for viral transduction in astrocytes, as compared to a reference AAV (e.g., AAV9).

TABLE 2

List of 7-mer targeting peptides that can target the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 10 | ACGTTGCAGATTCCTTTTAAG | 435 | TLQIPFK | 2.730563 |
| 11 | ACCGCCCTCAAACCCTTCCTC | 436 | TALKPFL | 2.536397 |
| 12 | ACCACCCTCAAACCCTTCCTC | 437 | TTLKPFL | 2.513839 |
| 13 | AGCATCGAAAGACCCTTCAAA | 438 | SIERPFK | 2.357132 |
| 14 | ACCCAAACAGACCCTTCCTC | 439 | TQNRPFL | 2.22812 |
| 15 | ACCATGCAAAAACCCTTCATC | 440 | TMQKPFI | 2.165359 |
| 16 | ACTAGTACGCGGCCGTTTTTG | 441 | TSTRPFL | 2.14357 |
| 17 | GGCACCTTCGTCCCCCCCACC | 442 | GTFVPPT | 2.110151 |
| 18 | TGGTCGACTAATGCGGGTTAT | 443 | WSTNAGY | 1.979177 |
| 19 | ACCCTCGAAAGACCCTTCACC | 444 | TLERPFT | 1.892846 |
| 20 | ACTGCTGCTAAGCCGTTTCTG | 445 | TAAKPFL | 1.863541 |
| 21 | ATTAGGATTGGTTATTCGCAG | 446 | IRIGYSQ | 1.835644 |
| 22 | GAGCGTGTGGGTTTTGCTCAG | 447 | ERVGFAQ | 1.73803 |
| 23 | GCCGACCTCCTCAACTACAGA | 448 | ADLLNYR | 1.599571 |
| 24 | CTCGTCGCCGGCTTCAGCCAA | 449 | LVAGFSQ | 1.591793 |
| 25 | TCGTCTCTGAAGCCTTTTCTG | 450 | SSLKPFL | 1.574365 |
| 26 | ACGCATTCTAGGCCGTTTATT | 451 | THSRPFI | 1.566468 |
| 27 | CCTTTTCCTGGTTATTCTGCG | 452 | PFPGYSA | 1.555967 |
| 28 | ATTATTGTTGGGTATAGTCAG | 453 | IIVGYSQ | 1.515858 |
| 29 | AGGTATCAGGGTGATTCTGTT | 454 | RYQGDSV | 1.486197 |
| 30 | AGGTATGCTGGGGATTCTATT | 455 | RYAGDSI | 1.456352 |
| 31 | AAGACGATTGGGGAGCATTGG | 456 | KTIGEHW | 1.44094 |
| 32 | TGGATGACGCATGGTTCTGCG | 457 | WMTHGSA | 1.432726 |
| 33 | GCTGCTTCGAGGCCGTTTCTT | 458 | AASRPFL | 1.3791 |
| 34 | ACTACTTCTAGGCCGTTTCTT | 459 | TTSRPFL | 1.353519 |
| 35 | GCTCGTGTGGGTTTGGCTCAG | 460 | ARVGLAQ | 1.345499 |
| 36 | GGGACTAGTCCGAATCTTGCG | 461 | GTSPNLA | 1.306429 |
| 37 | GTGCGTACGGGGTATAGTTCT | 462 | VRTGYSS | 1.302979 |
| 38 | ATTCGGGTGGGGTATAGTTCT | 463 | IRVGYSS | 1.286795 |

TABLE 2-continued

List of 7-mer targeting peptides that can target the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 39 | ACTACTTTGCGTCCGTTTATT | 464 | TTLRPFI | 1.284391 |
| 40 | GGTATTACGTCTCTGTTTAAG | 465 | GITSLFK | 1.251837 |
| 41 | ACCACCCAAACCCCCTTCAGA | 466 | TTQTPFR | 1.192121 |
| 42 | ACTGTGTCGAGGCCGTTTTTG | 467 | TVSRPFL | 1.171604 |
| 43 | TATGGGACGAATCCGTTTCGT | 468 | YGTNPFR | 1.13664 |
| 44 | CCCACCATGGTCGACAGCAGC | 469 | PTMVDSS | 1.099202 |
| 45 | AATAAGGCTAGTTCTCAGAAT | 470 | NKASSQN | 1.084711 |
| 46 | ACTTTTCGTAGTTCGAATGAT | 471 | TFRSSND | 1.032118 |
| 47 | CTGCCGGATCGTTATCCTAAT | 472 | LPDRYPN | 1.019382 |
| 48 | CAGAATGTTACGAAGGGTGTT | 473 | QNVTKGV | 1.000865 |
| 49 | GCTCAGTCTCCGATTCTTCGG | 474 | AQSPILR | 0.979922 |
| 50 | GTGGCTACTGGTTATTCTTCG | 475 | VATGYSS | 0.978116 |
| 51 | TTGAATTCGAATCGGCCTAAT | 476 | LNSNRPN | 0.9672 |
| 52 | ACGATTCGTAATAATACGATT | 477 | TIRNNTI | 0.959641 |
| 53 | GATCTTAGTCGTATTTTTAAG | 478 | DLSRIFK | 0.950386 |
| 54 | CTCAGCAACAGCGCCAGCCAA | 479 | LSNSASQ | 0.941212 |
| 55 | CTCGAAAACATGGTCATGAGC | 480 | LENMVMS | 0.937552 |
| 56 | TTGACTCAGCAGACGGATGTT | 481 | LTQQTDV | 0.936974 |
| 57 | GCCGGCCTCGCCCACGCCACC | 482 | AGLAHAT | 0.936046 |
| 58 | AATGCTCATACTGCGCTGGAT | 483 | NAHTALD | 0.933184 |
| 59 | TGGCCGATTCTTCGGGCTGAT | 484 | WPILRAD | 0.931545 |
| 60 | GCGCTGGCTGGTCTGTCTCTG | 485 | ALAGLSL | 0.930454 |
| 61 | CGTATTGATATGCCTTTTAAG | 486 | RIDMPFK | 0.920205 |
| 62 | ACGATGTCGTTGAGTAGTAGT | 487 | TMSLSSS | 0.919718 |
| 63 | CAAAACGTCGCCAAAAACCTC | 488 | QNVAKNL | 0.916602 |
| 64 | TTCGACAACCCCAACAACGTC | 489 | FDNPNNV | 0.915503 |
| 65 | GTCCTCATGAGAGAAAGCCTC | 490 | VLMRESL | 0.914386 |
| 66 | CACCACGACACCGGCAGCGCC | 491 | HHDTGSA | 0.912951 |
| 67 | GATGCGCCGAATAGTGTGGAT | 492 | DAPNSVD | 0.901999 |
| 68 | ACTGCGAGTAGGGATGCTAAG | 493 | TASRDAK | 0.889552 |
| 69 | ACTAATTATACGAAGCAGATT | 494 | TNYTKQI | 0.889024 |
| 70 | CCTCATAATGCTTCTGTGTTG | 495 | PHNASVL | 0.864707 |
| 71 | ACCAACAACACCAGAAACATC | 496 | TNNTRNI | 0.862873 |
| 72 | ATGGTTCCTAATCATTCTGGT | 497 | MVPNHSG | 0.859604 |
| 73 | CCGGTGCCGCAGTCTGAGCAT | 498 | PVPQSEH | 0.852761 |
| 74 | CTCTACCACGGCGGCAGCACC | 499 | LYHGGST | 0.851158 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 75 | ATGATTCATACTAGGGAGACG | 500 | MIHTRET | 0.850116 |
| 76 | ACTAATAATACGAAGCCTCTT | 501 | TNNTKPL | 0.849557 |
| 77 | CTCAACACCACCAGAAACACC | 502 | LNTTRNT | 0.839304 |
| 78 | GCTTTGCATAATTCTCAGAAT | 503 | ALHNSQN | 0.827469 |
| 79 | GTGAATAGTACGAGGAATGTT | 504 | VNSTRNV | 0.826565 |
| 80 | GGTGTTGGGGTTGTTACGAAG | 505 | GVGVVTK | 0.820556 |
| 81 | GTTTTGTCGAAGCAGTTGGCT | 506 | VLSKQLA | 0.816495 |
| 82 | TCTAAGTCTCTGCAGCCGTTG | 507 | SKSLQPL | 0.815502 |
| 83 | TCGAATTCTACGCGGTTGGTT | 508 | SNSTRLV | 0.815119 |
| 84 | CTCAACCAAACCAAACAAATC | 509 | LNQTKQI | 0.811665 |
| 85 | AACAACAGCGTCAGACAACTC | 510 | NNSVRQL | 0.806765 |
| 86 | ATGTCGGGGTATTCGCATACT | 511 | MSGYSHT | 0.804194 |
| 87 | GTCAAAGTCCCCATCATCACC | 512 | VKVPIIT | 0.799412 |
| 88 | GGGAATAATACTCGGGCGGTG | 513 | GNNTRAV | 0.797634 |
| 89 | CAGAATCAGATTAAGAATATT | 514 | QNQIKNI | 0.797303 |
| 90 | ACCAACATGACCAAACCCCTC | 515 | TNMTKPL | 0.791064 |
| 91 | AACAACAGCACCAGACTCAGC | 516 | NNSTRLS | 0.790429 |
| 92 | AGCATGCTCACCAGCATCGTC | 517 | SMLTSIV | 0.790252 |
| 93 | CTCAACGCCACCGCCAGCAGA | 518 | LNATASR | 0.785269 |
| 94 | AATACTGGGGTGCAGGTTAGG | 519 | NTGVQVR | 0.785026 |
| 95 | ACCAACACCGTCAGACCCATC | 520 | TNTVRPI | 0.780569 |
| 96 | CAGTCTACGCCGGGGGCTACT | 521 | QSTPGAT | 0.779842 |
| 97 | GGTCATTCTGAGAATTCTCGT | 522 | GHSENSR | 0.778724 |
| 98 | CTCCCCACCCAAACCCTCAGA | 523 | LPTQTLR | 0.773756 |
| 99 | AAGAATGCTCCGATGCCTGAT | 524 | KNAPMPD | 0.772397 |
| 100 | AGCAACAGCACCAAACCCACC | 525 | SNSTKPT | 0.768053 |
| 101 | CCTATTATTACTATGCCTGCT | 526 | PIITMPA | 0.767318 |
| 102 | CCCCTCAAAGGCATCGGCAGC | 527 | PLKGIGS | 0.767253 |
| 103 | GTCCTCAGCGTCAACCACCTC | 528 | VLSVNHL | 0.765014 |
| 104 | AGTGTGGCTGCTGTGCATATG | 529 | SVAAVHM | 0.764013 |
| 105 | AGCAACAGCATCAGACTCGTC | 530 | SNSIRLV | 0.763114 |
| 106 | CATAATGATACTCGTCCTCTT | 531 | HNDTRPL | 0.759962 |
| 107 | CCTCCGGTGAGGTCTACGGCT | 532 | PPVRSTA | 0.755777 |
| 108 | ATGAACACCGTCAGAAACCTC | 533 | MNTVRNL | 0.754463 |
| 109 | TTGACGGATGGTCATCGGATT | 534 | LTDGHRI | 0.754429 |
| 110 | ACGAATGCGGTGAAGCTGACT | 535 | TNAVKLT | 0.752766 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 111 | CGTGTGGATGCGGTTTTGAGT | 536 | RVDAVLS | 0.750458 |
| 112 | ACCAACGCCGTCAAAAGCACC | 537 | TNAVKST | 0.749271 |
| 113 | ATGCTCAACACCACCGCCAGA | 538 | MLNTTAR | 0.747921 |
| 114 | GGCAACAACACCAGACCCACC | 539 | GNNTRPT | 0.747523 |
| 115 | CAGTCTGGGGGTAGTGCGTTG | 540 | QSGGSAL | 0.744332 |
| 116 | GTGATTGCTTTGTCTACTATG | 541 | VIALSTM | 0.743901 |
| 117 | CTGAATACGATTCGGAATGTG | 542 | LNTIRNV | 0.743811 |
| 118 | AGCAACGCCACCAGAAGCGTC | 543 | SNATRSV | 0.740235 |
| 119 | GGCAACGGCACCAAATTCATC | 544 | GNGTKFI | 0.736944 |
| 120 | AGCAACACCATCAGACCCGTC | 545 | SNTIRPV | 0.736197 |
| 121 | AGCAACAGCACCAGAGCCATC | 546 | SNSTRAI | 0.734716 |
| 122 | TTTCATTTGACTGATAGGGGT | 547 | FHLTDRG | 0.733831 |
| 123 | CCGATTAGGTCGGATACTGTG | 548 | PIRSDTV | 0.731286 |
| 124 | GCCAACCAAATCCACAACACC | 549 | ANQIHNT | 0.730071 |
| 125 | TCGAATACGGTTCGGAATACT | 550 | SNTVRNT | 0.727807 |
| 126 | ACCAGCCTCGGCTACAGCAGC | 551 | TSLGYSS | 0.727167 |
| 127 | ATCAGCGGCGTCCAAACCAGA | 552 | ISGVQTR | 0.724309 |
| 128 | TCGAATGCTGTTAGGCAGACT | 553 | SNAVRQT | 0.72361 |
| 129 | TCTCTTTCTGAGCTTAGGATT | 554 | SLSELRI | 0.723061 |
| 130 | AGTACTGAGAAGAGGGATGAG | 555 | STEKRDE | 0.721349 |
| 131 | AACCTCGTCGGCACCCTCATC | 556 | NLVGTLI | 0.72103 |
| 132 | GGCAACAACATCAGACTCACC | 557 | GNNIRLT | 0.719643 |
| 133 | GCCGTCCCCACCGGCCTCAGA | 558 | AVPTGLR | 0.717951 |
| 134 | GGTGATAATAGTCTGACTAGG | 559 | GDNSLTR | 0.717624 |
| 135 | CACGCCGACAACAGACTCAAA | 560 | HADNRLK | 0.714815 |
| 136 | AGCAACGCCACCAGAAACTTC | 561 | SNATRNF | 0.714052 |
| 137 | GGGAATACGACTAGGGGGCTG | 562 | GNTTRGL | 0.713945 |
| 138 | CTCAACCTCACCGCCACCAAC | 563 | LNLTATN | 0.71358 |
| 139 | AGCGGCGTCAGCACCACCGAC | 564 | SGVSTTD | 0.711249 |
| 140 | TATGCTAAGACGTTGGCTATG | 565 | YAKTLAM | 0.710703 |
| 141 | ATGAACCACACCAAACCCACC | 566 | MNHTKPT | 0.710702 |
| 142 | GCTAATGCTACGAGGAATTCT | 567 | ANATRNS | 0.707423 |
| 143 | CAAAACCAAACCAAAATCACC | 568 | QNQTKIT | 0.707235 |
| 144 | TCTAATGCTATTAAGGCTACG | 569 | SNAIKAT | 0.70699 |
| 145 | TATCCTGATAATTATGGTAAG | 570 | YPDNYGK | 0.706343 |
| 146 | GGCAACACCACCATCAGAAGC | 571 | GNTTIRS | 0.705947 |

TABLE 2-continued

List of 7-mer targeting peptides that can target the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 147 | CTGGGTCTTACGGGTGCGGTT | 572 | LGLTGAV | 0.705628 |
| 148 | GCGAATAGTACGCGTATTCTG | 573 | ANSTRIL | 0.704068 |
| 149 | GATAATGCGATTCGTGCGCAG | 574 | DNAIRAQ | 0.703945 |
| 150 | ACGAATTATACTAAGCTTATG | 575 | TNYTKLM | 0.702916 |
| 151 | CATAATAGTCCTAGTAGTTAT | 576 | HNSPSSY | 0.70154 |
| 152 | GAGAATATGGTTCGGTCTGTG | 577 | ENMVRSV | 0.700139 |
| 153 | ACCAACAACATCAAAAGCTAC | 578 | TNNIKSY | 0.698201 |
| 154 | ACTAATTCGACGAGGCCTGTG | 579 | TNSTRPV | 0.696679 |
| 155 | CATACGGCTCCGCCTCATCCT | 580 | HTAPPHP | 0.695156 |
| 156 | GCCCTCAGCCAAAACACCAGC | 581 | ALSQNTS | 0.692869 |
| 157 | CCGAATGTGACTAAGAATGCT | 582 | PNVTKNA | 0.692038 |
| 158 | CTTGATACGCTGACGGGTTAT | 583 | LDTLTGY | 0.690142 |
| 159 | CCTAATAGTGTGCGTTCTGTT | 584 | PNSVRSV | 0.689082 |
| 160 | ACCAGCAGCCACCTCCCCCAC | 585 | TSSHLPH | 0.688469 |
| 161 | GTTCTTCATGGTGGTAATGAT | 586 | VLHGGND | 0.687991 |
| 162 | AGCAACTACGTCAAAAGCGCC | 587 | SNYVKSA | 0.687276 |
| 163 | GACAACAACAGCACCAGATGG | 588 | DNNSTRW | 0.687057 |
| 164 | ACTGTGATGAAGGGTTTTACT | 589 | TVMKGFT | 0.687036 |
| 165 | AGCCACACCCTCAGCACCCTC | 590 | SHTLSTL | 0.686592 |
| 166 | CCTGGTCCTCAGCAGGCGAAG | 591 | PGPQQAK | 0.685365 |
| 167 | ACTTTTGGGACGTCTAAGTTG | 592 | TFGTSKL | 0.684153 |
| 168 | AGCAACGCCGTCACCAACAGA | 593 | SNAVTNR | 0.683838 |
| 169 | TTGTCTATGTCGACGGTGCCT | 594 | LSMSTVP | 0.682136 |
| 170 | AGGCGTTATGATGGTAGGGAG | 595 | RRYDGRE | 0.681722 |
| 171 | ACCAACAGCACCAAAAACATC | 596 | TNSTKNI | 0.678439 |
| 172 | ATTAATGCTCAGTGGTCTGCG | 597 | INAQWSA | 0.672085 |
| 173 | GCCCAAACCAGCAACGACCCC | 598 | AQTSNDP | 0.669325 |
| 174 | ACGAATGAGACTAGGATGGTG | 599 | TNETRMV | 0.669307 |
| 175 | GCCAACGCCACCAGAGGCGTC | 600 | ANATRGV | 0.667153 |
| 176 | GCGGATGTGAATGCTTCGGGT | 601 | ADVNASG | 0.666574 |
| 177 | CTTAGTGAGCGGAATTATGTG | 602 | LSERNYV | 0.665675 |
| 178 | AGTGGTGAGCTTGCGCGGGCG | 603 | SGELARA | 0.663381 |
| 179 | GGGAATACTGCTAAGAATATT | 604 | GNTAKNI | 0.662988 |
| 180 | GACAACGCCGTCAGACCCCTC | 605 | DNAVRPL | 0.662435 |
| 181 | ATGATGCTCAGCGGCCTCAAC | 606 | MMLSGLN | 0.660837 |
| 182 | CCCAACACCATCAGAAACGTC | 607 | PNTIRNV | 0.660528 |

TABLE 2-continued

List of 7-mer targeting peptides that can target the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 183 | GAGAATTTGACGCGTGGGGTG | 608 | ENLTRGV | 0.659884 |
| 184 | TTTAGTGCTCGGAGTACGGGG | 609 | FSARSTG | 0.659095 |
| 185 | GAAAACGCCACCAGAACCTAC | 610 | ENATRTY | 0.657305 |
| 186 | GGCAACAGCACCAGAATGAAC | 611 | GNSTRMN | 0.656999 |
| 187 | GGGAATTCTACTAAGTCTCCT | 612 | GNSTKSP | 0.656908 |
| 188 | ATGCAAACCACCCTCCACCTC | 613 | MQTTLHL | 0.656525 |
| 189 | AACCCCACCCTCATCACCCTC | 614 | NPTLITL | 0.655924 |
| 190 | CTTATTTCTGGTCATGCGCAG | 615 | LISGHAQ | 0.655121 |
| 191 | TTCAACCAAGTCAGAAGCCTC | 616 | FNQVRSL | 0.65493 |
| 192 | ATGAACATCCTCAGAGAAGTC | 617 | MNILREV | 0.654097 |
| 193 | AGTGCTATGATGCGTGGTGTT | 618 | SAMMRGV | 0.653566 |
| 194 | CCCATGCTCAGCAGCCCCAGC | 619 | PMLSSPS | 0.652269 |
| 195 | CAGAATAATACGCTTAGGTCG | 620 | QNNTLRS | 0.651653 |
| 196 | AGGCATTCGGATCCGGTGGAG | 621 | RHSDPVE | 0.65144 |
| 197 | GTGAATACGACGTTTTCTACG | 622 | VNTTFST | 0.65142 |
| 198 | ATCAACAGCACCAGAGGCATC | 623 | INSTRGI | 0.650374 |
| 199 | ACCAACGCCGTCAGAGACCTC | 624 | TNAVRDL | 0.649865 |
| 200 | TCTAATAGTACTAGGCTGTCG | 625 | SNSTRLS | 0.649567 |
| 201 | ACGTCTATTGCTGGGTCGTTT | 626 | TSIAGSF | 0.647793 |
| 202 | CTCGGCAGCACCTACCCCAGA | 627 | LGSTYPR | 0.644533 |
| 203 | GCCAACGTCACCACCCAAAGA | 628 | ANVTTQR | 0.643299 |
| 204 | AGCAACAGCGTCAGACTCAGC | 629 | SNSVRLS | 0.641635 |
| 205 | GCTACGAATGAGCCTGATCGG | 630 | ATNEPDR | 0.641008 |
| 206 | AGAATGAACCCCGAACAAAGC | 631 | RMNPEQS | 0.640866 |
| 207 | TCGGTTAGTGGTTCGGCTAAT | 632 | SVSGSAN | 0.640362 |
| 208 | CCGAGTAATAGTACTACGCGT | 633 | PSNSTTR | 0.639664 |
| 209 | CTTTTTCATGGTACGCATGAG | 634 | LFHGTHE | 0.639176 |
| 210 | CCCCAACTCGGCAGCACCAAA | 635 | PQLGSTK | 0.638022 |
| 211 | CCCATCAGCGCCAACAGACTC | 636 | PISANRL | 0.637814 |
| 212 | AATTCGGGTAATCTTTCTATG | 637 | NSGNLSM | 0.637206 |
| 213 | AAGGTTGAGGCTATTGGGATG | 638 | KVEAIGM | 0.63585 |
| 214 | AAGACTTTGCTTAATAGTGTT | 639 | KTLLNSV | 0.635567 |
| 215 | AATGCTATGGATCTTAAGGTG | 640 | NAMDLKV | 0.633592 |
| 216 | ATGATGGGTAATGGGTCTTCG | 641 | MMGNGSS | 0.632846 |
| 217 | AGCAACAGCACCAAAGCCCTC | 642 | SNSTKAL | 0.630646 |
| 218 | TCTAATAGTACGCGGGGTACG | 643 | SNSTRGT | 0.630359 |

37

38

TABLE 2-continued

TABLE 2-continued

List of 7-mer targeting peptides that can target
the CNS with greater efficiency and specificity List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 219 | AGCCTCAGCAGCCTCCACGTC | 644 | SLSSLHV | 0.629137 |
| 220 | ACCCTCAGCGGCGCCCTCACC | 645 | TLSGALT | 0.628275 |
| 221 | CCGAATACGGTGAGGAATAAT | 646 | PNTVRNN | 0.627943 |
| 222 | AATAATAATGTGAAGATGACT | 647 | NNNVKMT | 0.627302 |
| 223 | TCTGTTGCTAAGCCTTTTATG | 648 | SVAKPFM | 0.627075 |
| 224 | ACGCAGACGACTCGGCTTTCG | 649 | TQTTRLS | 0.625657 |
| 225 | AATAATGCGACTCGGGGTGGG | 650 | NNATRGG | 0.622765 |
| 226 | ACCAACACCACCGCCAGAATC | 651 | TNTTARI | 0.621665 |
| 227 | GAGAATAGTATTCGGACTATT | 652 | ENSIRTI | 0.619021 |
| 228 | ATTAGGGAGACTTCTGGGAAG | 653 | IRETSGK | 0.618732 |
| 229 | AGCATCTACTACCACACCGAA | 654 | SIYYHTE | 0.618441 |
| 230 | GTCCTCGACAACAGCGGCCAA | 655 | VLDNSGQ | 0.618183 |
| 231 | AGCCACAACATGACCATCAGA | 656 | SHNMTIR | 0.614114 |
| 232 | ACCATCCCCAGCGCCGGCAAA | 657 | TIPSAGK | 0.612816 |
| 233 | CCTAGGCATACTTTGAGTCAG | 658 | PRHTLSQ | 0.60799 |
| 234 | TCGCTTAATGTGCAGGATGTG | 659 | SLNVQDV | 0.607203 |
| 235 | TATCAGTCTCTGGCTAATCCG | 660 | YQSLANP | 0.607005 |
| 236 | ATTCTGAATATGTCTACGGAT | 661 | ILNMSTD | 0.606834 |
| 237 | GTCCTCCACCTCGGCCACAGC | 662 | VLHLGHS | 0.605932 |
| 238 | GGTGTTACTCAGACTCCGCGT | 663 | GVTQPR | 0.6059 |
| 239 | ACCAACGACACCAGAAGAATC | 664 | TNDTRRI | 0.604587 |
| 240 | CAAACCGACCACACCAGCAGA | 665 | QTDHTSR | 0.604031 |
| 241 | AAGAATGAGATTAAGAATGTG | 666 | KNEIKNV | 0.603838 |
| 242 | TGGACTGGTAATGAGAGGCTT | 667 | WTGNERL | 0.603412 |
| 243 | GGTAAGAGTGATGCTATGCGG | 668 | GKSDAMR | 0.603322 |
| 244 | GGGAATGCGACTCGTACTTAT | 669 | GNATRTY | 0.602016 |
| 245 | GCCAGCAACCTCGGCCTCCCC | 670 | ASNLGLP | 0.600647 |
| 246 | AGCAGCCTCAGCGGCAGCCCC | 671 | SSLSGSP | 0.599424 |
| 247 | GCCGCCGTCAACCAAGGCGTC | 672 | AAVNQGV | 0.599283 |
| 248 | GACCAAAACCAACCCAGAGAA | 673 | DQNQPRE | 0.59872 |
| 249 | CTCACCCAAGACAAACAAGCC | 674 | LTQDKQA | 0.59843 |
| 250 | TTCGGCAGCAACGAACACAAC | 675 | FGSNEHN | 0.59773 |
| 251 | CTGAATCAGCCGAATGTGCGG | 676 | LNQPNVR | 0.59703 |
| 252 | ATGAATACTACGCGTAATCTG | 677 | MNTTRNL | 0.596819 |
| 253 | ACTAATTCTACTAGGACGAGT | 678 | TNSTRTS | 0.596817 |
| 254 | TTTGAGCTTTCGCATGTGCCT | 679 | FELSHVP | 0.595373 |

| SEQ ID NO | Sequence (7 mer Amino acid) | SEQ ID NO | 7 mer Amino acid | Brain-mean-enrich (log10) |
|---|---|---|---|---|
| 255 | GAAGGCCTCGGCAACGCCGCC | 680 | EGLGNAA | 0.59339 |
| 256 | CTCACCGTCACCCTCAACCAC | 681 | LTVTLNH | 0.593104 |
| 257 | TTTGGGAATGCGATTCAGTCT | 682 | FGNAIQS | 0.593063 |
| 258 | CCGGGTGGGGGTTTGACTCCG | 683 | PGGGLTP | 0.591748 |
| 259 | CCCAACATGACCAGAAGCCTC | 684 | PNMTRSL | 0.591633 |
| 260 | AGTCAGCTGCATAGGTTGCAG | 685 | SQLHRLQ | 0.588997 |
| 261 | AATGATCCTGTGCTGACTGTG | 686 | NDPVLTV | 0.587622 |
| 262 | GAAAACAGCGTCAGAACCACC | 687 | ENSVRTT | 0.586872 |
| 263 | GATCGTGTGACTAATCCGAAG | 688 | DRVTNPK | 0.585898 |
| 264 | CTCAACACCGGCCAAATGAGA | 689 | LNTGQMR | 0.584482 |
| 265 | ATTAGTCCTTCTCAGGTGAAG | 690 | ISPSQVK | 0.583565 |
| 266 | TACAGCGCCGACAAAACCACC | 691 | YSADKTT | 0.583168 |
| 267 | ATTGATAGTGCGGGGATGGCG | 692 | IDSAGMA | 0.582726 |
| 268 | AGCAACAACATCAAACTCAAC | 693 | SNNIKLN | 0.582501 |
| 269 | CTTGAGACGCAGCCTAGGACT | 694 | LETQPRT | 0.582054 |
| 270 | AATTTGCATAGTAATGTGCTG | 695 | NLHSNVL | 0.581653 |
| 271 | ATGGTCAAAGACACCCAACTC | 696 | MVKDTQL | 0.581409 |
| 272 | CTCATGCACCTCACCAACCCC | 697 | LMHLTNP | 0.579725 |
| 273 | GTCGCCAGCCCCGACAAAAGA | 698 | VASPDKR | 0.579259 |
| 274 | GTCGTCGCCGTCCTCACCAGC | 699 | VVAVLTS | 0.578391 |
| 275 | AACATCATGGTCAACGTCCCC | 700 | NIMVNVP | 0.578008 |
| 276 | CCGTATAGTGGGCAGCGGACT | 701 | PYSGQRT | 0.577882 |
| 277 | CCTCTGCTTAAGACGAATACT | 702 | PLLKTNT | 0.575523 |
| 278 | GGGAATACTACGGTGCGTGGG | 703 | GNTTVRG | 0.574402 |
| 279 | ACCAACAAAGTCAGAGACGAC | 704 | TNKVRDD | 0.573889 |
| 280 | CCCAGCACCGCCCTCCTCGTC | 705 | PSTALLV | 0.573034 |
| 281 | ATCCAAAGCATCACCCTCAAA | 706 | IQSITLK | 0.572783 |
| 282 | CCCCTCCACGCCAACATGAGC | 707 | PLHANMS | 0.570881 |
| 283 | ACCGCCCACGCCGAAGCCAGA | 708 | TAHAEAR | 0.570572 |
| 284 | ACGAATACGGATTCGTATCGT | 709 | TNTDSYR | 0.569365 |
| 285 | ACCCACGTCAGCCTCGACAGA | 710 | THVSLDR | 0.569228 |
| 286 | TTTAGTACGAAGGATCATGTT | 711 | FSTKDHV | 0.568654 |
| 287 | GACAACACCCAAACCGCCCCC | 712 | DNTQTAP | 0.568553 |
| 288 | AGCAACAGAATCATCAGCGGC | 713 | SNRIISG | 0.568551 |
| 289 | ACTAATTCTGTTAGGAATAAT | 714 | TNSVRNN | 0.568237 |
| 290 | AGCAACGAAGTCAGAAACATG | 715 | SNEVRNM | 0.567847 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 291 | GAACTCTACAAACCCAGCAGA | 716 | ELYKPSR | 0.567258 |
| 292 | TGGATTACGGGGGGTGCGAGT | 717 | WITGGAS | 0.567159 |
| 293 | AACAACAGCGTCAGACCCACC | 718 | NNSVRPT | 0.566945 |
| 294 | CACACCGCCGTCCTCAGAACC | 719 | HTAVLRT | 0.565911 |
| 295 | AATACTTTGTCTCTTGCTCCT | 720 | NTLSLAP | 0.564955 |
| 296 | CCCAACGCCAGCGTCAACAGC | 721 | PNASVNS | 0.564885 |
| 297 | GTTACTGGTGGGAATACTTAT | 722 | VTGGNTY | 0.564099 |
| 298 | GTCAACGAAAACCTCATCGAA | 723 | VNENLIE | 0.563902 |
| 299 | GTTTTGACGACTCATTCGAAT | 724 | VLTTHSN | 0.563552 |
| 300 | CACACCCAACTCCCCCTCACC | 725 | HTQLPLT | 0.562802 |
| 301 | CGGCAGTCTCTTGAGGCGTTG | 726 | RQSLEAL | 0.562715 |
| 302 | CCCGACGTCACCGAAGGCAGA | 727 | PDVTEGR | 0.560929 |
| 303 | CCGACTAATATTATGCTTGAT | 728 | PTNIMLD | 0.560313 |
| 304 | CCCAACATGAGCGCCATGATC | 729 | PNMSAMI | 0.559451 |
| 305 | ATTATGAATGGTCAGGCTCTG | 730 | IMNGQAL | 0.558677 |
| 306 | AATAATAATTCGACGCGTTTT | 731 | NNNSTRF | 0.558656 |
| 307 | GCCAACGTCACCAGAAGCACC | 732 | ANVTRST | 0.558653 |
| 308 | CAGAATCTTGGTCTTAATGTG | 733 | QNLGLNV | 0.558202 |
| 309 | CAAGCCCAAATGAGCAGCGCC | 734 | QAQMSSA | 0.557238 |
| 310 | CTCACCATGGCCACCAACGTC | 735 | LTMATNV | 0.556779 |
| 311 | GATCGTGATTCTGTGCAGAAT | 736 | DRDSVQN | 0.55654 |
| 312 | GTCAACCCCACCAACAACCTC | 737 | VNPTNNL | 0.555076 |
| 313 | CCGTCTTTTACGACTATGAGT | 738 | PSFTTMS | 0.554811 |
| 314 | AGGGAGACGCCTATTCCTAAG | 739 | RETPIPK | 0.553803 |
| 315 | AGCCTCAACTTCACCACCGCC | 740 | SLNFTTA | 0.553055 |
| 316 | GGTATGAGTGGGGTTGCTCAG | 741 | GMSGVAQ | 0.552736 |
| 317 | AAGGTTGATGCGGCTCAGAGT | 742 | KVDAAQS | 0.552569 |
| 318 | CATATTACGACTAATGTGTCT | 743 | HITTNVS | 0.552479 |
| 319 | GAGCGGGAGTCGGCTCGTCTT | 744 | ERESARL | 0.551876 |
| 320 | GATAATAGGACTCAGAGGACG | 745 | DNRTQRT | 0.551636 |
| 321 | TCTGCGCCTAATGTGACTATT | 746 | SAPNVTI | 0.551278 |
| 322 | GAAAACGGCACCAGAAACACC | 747 | ENGTRNT | 0.55012 |
| 323 | GGCACCGCCGTCTTCACCGCC | 748 | GTAVFTA | 0.549912 |
| 324 | GCCAACAACATGAGCCAAACC | 749 | ANNMSQT | 0.549519 |
| 325 | GGTAATCATACTTATAATCTG | 750 | GNHTYNL | 0.549264 |
| 326 | CTGAGTCCTTCGAATTCTAAT | 751 | LSPSNSN | 0.549019 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 327 | ATGGGCGCCGACCACAGAACC | 752 | MGADHRT | 0.548749 |
| 328 | AGTAATTCGACGCGTGGTTCT | 753 | SNSTRGS | 0.548705 |
| 329 | AATACTTCTGGTGTGCCTAAG | 754 | NTSGVPK | 0.548579 |
| 330 | ATCAACACCGCCGTCGTCAGC | 755 | INTAVVS | 0.54846 |
| 331 | ATGGGGGTTCAGGCTTATGTG | 756 | MGVQAYV | 0.54845 |
| 332 | GGGAATTTTGTTAAGCCGAAT | 757 | GNFVKPN | 0.547942 |
| 333 | GTGAATTCGGTGAGGATGATT | 758 | VNSVRMI | 0.547171 |
| 334 | CACGACAGCGCCAACAGCAGA | 759 | HDSANSR | 0.54671 |
| 335 | CTCGGCGTCAGAGACGACAGC | 760 | LGVRDDS | 0.545708 |
| 336 | AGCAACGCCGTCAGAGCCAAC | 761 | SNAVRAN | 0.545674 |
| 337 | CCCGTCCTCGCCGCCACCATG | 762 | PVLAATM | 0.545458 |
| 338 | AATAAGCCTGTGTCTGGTAAT | 763 | NKPVSGN | 0.544076 |
| 339 | GTCGGCCTCGCCAGCCACACC | 764 | VGLASHT | 0.541637 |
| 340 | GGCAGCAACACCAACATGAAA | 765 | GSNTNMK | 0.540634 |
| 341 | GTTGCTACTACTGTGCATAAT | 766 | VATTVHN | 0.540191 |
| 342 | AACACCCTCGACAGCAGAGTC | 767 | NTLDSRV | 0.539923 |
| 343 | AGGGAGGCTAATTTGCAGGCG | 768 | REANLQA | 0.539717 |
| 344 | GTCGACGCCCTCAGCCACATG | 769 | VDALSHM | 0.539694 |
| 345 | CTTCGTCTTGCTGGTCTTGCT | 770 | LRLAGLA | 0.539525 |
| 346 | ATTACGGTGACTAATTATTCG | 771 | ITVTNYS | 0.539447 |
| 347 | TGGGACAGCGGCAGCGGCGAA | 772 | WDSGSGE | 0.539198 |
| 348 | TTCGCCAGCGAAACCGTCGCC | 773 | FASETVA | 0.537906 |
| 349 | CAGAATGTTACGGGGACGAGG | 774 | QNVTGTR | 0.537867 |
| 350 | CTTAATGGGTTGAATGTGTCT | 775 | LNGLNVS | 0.537505 |
| 351 | AATATGCTTAAGCAGAGTGAG | 776 | NMLKQSE | 0.537354 |
| 352 | TTTAATGAGGTTCCGAAGGCG | 777 | FNEVPKA | 0.537144 |
| 353 | CTCGGCGACATCACCGGCTTC | 778 | LGDITGF | 0.537047 |
| 354 | ATTTCGGCTTCTCATTCTCGT | 779 | ISASHSR | 0.536983 |
| 355 | AGTCAGACGCAGATTGCTCTT | 780 | SQTQIAL | 0.53684 |
| 356 | AATATGGCTACTCAGATGAAG | 781 | NMATQMK | 0.536747 |
| 357 | GTCAACCACAACATCAGACTC | 782 | VNHNIRL | 0.53652 |
| 358 | AACGCCCTCCAAGTCCCCGTC | 783 | NALQVPV | 0.536474 |
| 359 | AATTCGACGGGTATTGATACG | 784 | NSTGIDT | 0.53526 |
| 360 | GTTGTTGCTGGGCATCTTAAT | 785 | VVAGHLN | 0.534827 |
| 361 | CGGAATGATGCGATTCTGAAT | 786 | RNDAILN | 0.53456 |
| 362 | AATCGGGTTGATTCGCGGGCT | 787 | NRVDSRA | 0.53408 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 363 | TCGACGCATTCTACTTATGTG | 788 | STHSTYV | 0.533753 |
| 364 | AGTGGGCATGGGACTCTGCGG | 789 | SGHGTLR | 0.532267 |
| 365 | CCCAACAGCACCACCCTCAGC | 790 | PNSTTLS | 0.531723 |
| 366 | GACACCAAACCCACCAACACC | 791 | DTKPTNT | 0.531589 |
| 367 | AACAGAGACACCATCAACAAC | 792 | NRDTINN | 0.531212 |
| 368 | CCCAGAACCCTCAGCGACGGC | 793 | PRTLSDG | 0.530962 |
| 369 | ACCAAAGACGTCACCACCAGC | 794 | TKDVTTS | 0.53023 |
| 370 | CTGGGTAATCCTACGCCTTCT | 795 | LGNPTPS | 0.529624 |
| 371 | TATCAGGCGATGTATAGGGAT | 796 | YQAMYRD | 0.528592 |
| 372 | AGCGGCGTCCAAGAATTCGAC | 797 | SGVQEFD | 0.528493 |
| 373 | TCTAATCATCTGTCGACGGTT | 798 | SNHLSTV | 0.528046 |
| 374 | CACGACGAAAGAGCCAACATG | 799 | HDERANM | 0.526932 |
| 375 | ACGAATAGTACTCGGTCGCCT | 800 | TNSTRSP | 0.526707 |
| 376 | CCGACGGATAAGTCTTATCCG | 801 | PTDKSYP | 0.525687 |
| 377 | ATGACCGAACAAAGAACCGCC | 802 | MTEQRTA | 0.524729 |
| 378 | ACCAACGCCACCCACAGCAAA | 803 | TNATHSK | 0.523113 |
| 379 | AATCGGGGTACTTTTAGTGCG | 804 | NRGTFSA | 0.522986 |
| 380 | AACACCACCAAATTCAACACC | 805 | NTTKFNT | 0.522899 |
| 381 | GGGATTCCGCCTTTGACTAAG | 806 | GIPPLTK | 0.522659 |
| 382 | ACCGCCAACAGCACCCAAAGA | 807 | TANSTQR | 0.522626 |
| 383 | ACTCAGGGTCCGGGTCCGAAG | 808 | TQGPGPK | 0.522239 |
| 384 | ATGAATACTACGCGGAATTAT | 809 | MNTTRNY | 0.522193 |
| 385 | CTCAGAGAAGGCACCTTCATG | 810 | LREGTFM | 0.521554 |
| 386 | AACATCAGCAGCACCGACAGA | 811 | NISSTDR | 0.521154 |
| 387 | TCGGTTAGTCGGCCGTTTCAG | 812 | SVSRPFQ | 0.520365 |
| 388 | CCTATGTCTGCTAATGGGAAG | 813 | PMSANGK | 0.518792 |
| 389 | GAAGTCAGAGGCAACACCTTC | 814 | EVRGNTF | 0.518514 |
| 390 | TCGCAGAAGGGTCTGTCTGTG | 815 | SQKGLSV | 0.518477 |
| 391 | ATTGCTGAGAATCTGAGTGCT | 816 | IAENLSA | 0.517935 |
| 392 | TTCAGCAACATGAACCTCAAA | 817 | FSNMNLK | 0.517734 |
| 393 | CCTCGTGAGCGGACTTATACT | 818 | PRERTYT | 0.516835 |
| 394 | TGGTCGCATAATCCGGATTCT | 819 | WSHNPDS | 0.516248 |
| 395 | GGTCTTCAGACTCTGATTACG | 820 | GLQTLIT | 0.516123 |
| 396 | AGCAACAGAACCAAAGACATC | 821 | SNRTKDI | 0.515515 |
| 397 | GTGACTGAGACGATTCTTAAG | 822 | VTETILK | 0.515459 |
| 398 | TATGTTACGCGTAGTGGTCTG | 823 | YVTRSGL | 0.515319 |

TABLE 2-continued

List of 7-mer targeting peptides that can target
the CNS with greater efficiency and specificity

| SEQ ID NO | Sequence (7 mer Amino acid) | SEQ ID NO | 7 mer Amino acid | Brain-mean-enrich (log10) |
|---|---|---|---|---|
| 399 | ATGAACGCCAACATCCTCGTC | 824 | MNANILV | 0.514679 |
| 400 | ACTACGAATCGGGTGGGTACG | 825 | TTNRVGT | 0.51427 |
| 401 | GTCCTCAAAAGCCACCTCCAA | 826 | VLKSHLQ | 0.51406 |
| 402 | AGCGACGGCCTCAGAACCCAA | 827 | SDGLRTQ | 0.514048 |
| 403 | CTCAACAGCGTCAAACCCAAC | 828 | LNSVKPN | 0.513525 |
| 404 | AGCCAAGCCATCGCCCCCAAA | 829 | SQAIAPK | 0.51343 |
| 405 | TCTAATAATGTTCGTGCTCCG | 830 | SNNVRAP | 0.513257 |
| 406 | ATCAGCCACCTCAGCGAAAGC | 831 | ISHLSES | 0.511503 |
| 407 | CTCCTCCCCGGCATGAGATTC | 832 | LLPGMRF | 0.5114 |
| 408 | CTTCTTGCGTCGGCTACGAAG | 833 | LLASATK | 0.510718 |
| 409 | AACCACAACGGCATGGTCAGC | 834 | NHNGMVS | 0.510709 |
| 410 | CACAGCGGCGAACTCAACAAC | 835 | HSGELNN | 0.510488 |
| 411 | CTTTCTGCGCCTAAGGATACT | 836 | LSAPKDT | 0.509967 |
| 412 | ATTGGGACTCATGTGGGGACG | 837 | IGTHVGT | 0.509748 |
| 413 | GCCGTCGCCCTCGCCAGCGCC | 838 | AVALASA | 0.509614 |
| 414 | ATTACTCTTCAGTCTAATGCT | 839 | ITLQSNA | 0.509556 |
| 415 | GTCGACCACAGCCTCACCAGC | 840 | VDHSLTS | 0.509193 |
| 416 | GGCAACGAAGCCACCAGCCTC | 841 | GNEATSL | 0.508729 |
| 417 | CCCGTCAGCAGCACCACCCTC | 842 | PVSSTTL | 0.507682 |
| 418 | CCCTACCAAACCAGCAGCGCC | 843 | PYQTSSA | 0.507351 |
| 419 | ACCAGCGTCGTCAGCGCCTTC | 844 | TSVVSAF | 0.507058 |
| 420 | AACGGCGTCCCCGACAACAAC | 845 | NGVPDNN | 0.50693 |
| 421 | AGCACCCAAACCATCGGCTTC | 846 | STQTIGF | 0.505905 |
| 422 | ATTCGGAGTTCTGATCTTGCG | 847 | IRSSDLA | 0.505273 |
| 423 | AACACCCAAAGCGCCAAATAC | 848 | NTQSAKY | 0.504002 |
| 424 | AGTCTTGAGTCGTCTAGGCAG | 849 | SLESSRQ | 0.503575 |
| 425 | CTCAACCTCGCCAGCGGCAGA | 850 | LNLASGR | 0.503463 |
| 426 | ATGCAGGAGCGTCGGGAGTAT | 851 | MQERREY | 0.503055 |
| 427 | TGGCTCCTCAAAGACGGCTAC | 852 | WLLKDGY | 0.502893 |
| 428 | GGCAGATACCAAACCACCAGC | 853 | GRYQTTS | 0.502776 |
| 429 | AATACGACGAAGTTTCCGTTT | 854 | NTTKFPF | 0.502408 |
| 430 | ATGAGCAACGGCATCAGCAGA | 855 | MSNGISR | 0.501897 |
| 431 | CCGATTCGGGATCCGGAGAAG | 856 | PIRDPEK | 0.501479 |
| 432 | AGTACGCTGAGTCCGCATGTT | 857 | STLSPHV | 0.501315 |
| 433 | TTCATGCCCATCAGCAGCGCC | 858 | FMPISSA | 0.50124 |
| 434 | AGAAGCGACACCCAAAGCAGC | 859 | RSDTQSS | 0.500462 |

TABLE 3

| | | | Mean |
|---|---|---|---|
| SEQ ID NO | 11-mer DNA Sequence | SEQ ID NO | 11-mer Amino Acid Sequence | enrichment score (log 10 scale) |

11-mer targeting peptides that can target the CNS

| SEQ ID NO | 11-mer DNA Sequence | SEQ ID NO | 11-mer Amino Acid Sequence | Mean enrichment score (log 10 scale) |
|---|---|---|---|---|
| 860 | GCCCAAACCACCCTCAAACCCTTCAGCAACCCC | 864 | AQTTLKPFSNP | 1.101507461 |
| 861 | GACGGCACCACCCTCAAACCCTTCAGCAACCCC | 865 | DGTTLKPFSNP | 0.172425316 |
| 862 | GACGGCACCGCCCTCAAACCCTTCCTCGCCCAA | 866 | DGTALKPFLAQ | 0.647416071 |
| 863 | GATGGGACGACTCTTAAGCCGTTTCTGGCACAG | 867 | DGTTLKPFLAQ | sequence predicted based on PHP.eB sequence |

AAV Capsid Proteins Targeting the Liver

Disclosed herein are AAV capsid proteins with a substitution or an insertion of at least one amino acid at an amino acid position described above in a parental AAV capsid protein that confers an increased specificity for the liver. In some instances, the insertion comprises at least one amino acid provided in any one of the sequences provided in Table 4 and/or FIG. 35. In some instances, the insertion comprises at least two amino acids provided in any one of the sequences provided in Table 4 and/or FIG. 35. In some instances, the insertion comprises at least three amino acids provided in any one of the sequences provided in Table 4 and/or FIG. 35. In some instances, the insertion comprises at least four amino acids provided in any one of the sequences provided in Table 4 and/or FIG. 35. In some instances, the insertion comprises at least five amino acids provided in Table 4 and/or FIG. 35. In some instances, the insertion comprises at least six amino acids provided in Table 4 and/or FIG. 35. In some instances, the insertion comprises at least seven amino acids provided in Table 4 and/or FIG. 35. In some instances, the amino acids are contiguous. In some instances, the amino acids are not contiguous. In some instances, the insertion is at an amino acid position 588_589 in a parental AAV capsid protein. In some instances, the parental capsid protein is AAV9 capsid protein, provided in SEQ ID NO: 1.

TABLE 4

List of 7-mer targeting peptides that target the liver

| SEQ ID NO | DNA sequence for 7 mer amino acid | SEQ ID NO | 7 mer amino acid | liver-mean-enrich (log10) |
|---|---|---|---|---|
| 868 | GCCGAATACAACACCGGCGTC | 950 | AEYNTGV | 0.585999 |
| 869 | GCTAATGCGATGGGTGATCAT | 951 | ANAMGDH | 0.611245 |
| 870 | GAAAGCATCCAACAACTCAGC | 952 | ESIQQLS | 0.525712 |
| 871 | TTTAAGGTTAGTATTCAGCAG | 953 | FKVSIQQ | 0.591275 |
| 872 | TTTCTTCTTACTTCGGATCCG | 954 | FLLTSDP | 0.515975 |
| 873 | TTTCAGCAGGATACTTATCTG | 955 | FQQDTYL | 0.548808 |
| 874 | TTTTCTGGTAGTGCTAGGGTT | 956 | FSGSARV | 0.509852 |
| 875 | TTCAGCGTCACCAGACAAGCC | 957 | FSVTRQA | 0.718621 |
| 876 | GGGGCTGCTGGTAAGAGTTTG | 958 | GAAGKSL | 0.571307 |
| 877 | GGTCATATTTCGGCGCTTGCG | 959 | GHISALA | 0.552655 |
| 878 | GGGCTGAAGGTGTCTGGGTCT | 960 | GLKVSGS | 0.777335 |
| 879 | GGTCTTCAGTCGCCGAGGTCT | 961 | GLQSPRS | 0.572095 |
| 880 | GGGAGGACGGTGCAGGATAGG | 962 | GRTVQDR | 0.528631 |
| 881 | GGCACCAAAACCCACAGCCTC | 963 | GTKTHSL | 0.518459 |
| 882 | GGCACCACCAGAAGCCCCACC | 964 | GTTRSPT | 0.560705 |
| 883 | CACCCCAGCCTCAGACAAAGC | 965 | HPSLRQS | 0.508478 |
| 884 | CATTCTGCGAAGACTATTGCG | 966 | HSAKTIA | 0.579949 |

TABLE 4-continued

List of 7-mer targeting peptides that target the liver

| SEQ ID NO | DNA sequence for 7 mer amino acid | SEQ ID NO | 7 mer amino acid | liver-mean-enrich (log10) |
|---|---|---|---|---|
| 885 | CACAGCGGCCCCACCAGCAGC | 967 | HSGPTSS | 0.505295 |
| 886 | ATCAACAAAGACAACAACCAA | 968 | INKDNNQ | 0.531458 |
| 887 | ATCAACACCGCCAGCTACAAA | 969 | INTASYK | 0.542125 |
| 888 | AAAGCCATCAGCACCGCCAAC | 970 | KAISTAN | 0.616958 |
| 889 | AAAGCCAACAGCCAAATCACC | 971 | KANSQIT | 0.519425 |
| 890 | AAAGCCTACAGCGTCCAAGTC | 972 | KAYSVQV | 1.15776 |
| 891 | AAACTCAGCACCCTCCACCAA | 973 | KLSTLHQ | 0.568791 |
| 892 | AAGCGGGCGCCTGCTGATTCT | 974 | KRAPADS | 0.611303 |
| 893 | AAAACCAACAACACCGTCCTC | 975 | KTNNTVL | 0.504377 |
| 894 | AAAACCCAACTCGGCCAAATG | 976 | KTQLGQM | 0.519843 |
| 895 | CTTGGTTCTGCGCTTACGAGG | 977 | LGSALTR | 0.563314 |
| 896 | CTCATCAGCACCACCCACAGA | 978 | LISTTHR | 0.502083 |
| 897 | CTTAAGGTTGCGTCTGGTTTG | 979 | LKVASGL | 0.540598 |
| 898 | CTTCTTGCGACTGGGCTTAAG | 980 | LLATGLK | 0.545453 |
| 899 | CTTCCGGGTGGTGCGAGGTTG | 981 | LPGGARL | 0.564086 |
| 900 | CTTAGGGGTTCTGCTCAGGTG | 982 | LRGSAQV | 0.648123 |
| 901 | TTGTCTGCTCAGCTTCCGCGG | 983 | LSAQLPR | 0.503052 |
| 902 | CTTTCTACTGCGTTGACTGTG | 984 | LSTALTV | 0.591029 |
| 903 | CTCACCAGAGTCGGCACCGTC | 985 | LTRVGTV | 0.520831 |
| 904 | ATGGCCAACACCAGAAGCGCC | 986 | MANTRSA | 0.525721 |
| 905 | ATGATCAGAGGCACCAGCAGC | 987 | MIRGTSS | 0.512891 |
| 906 | ATGCTCAGCGGCCAAGCCAGA | 988 | MLSGQAR | 0.668364 |
| 907 | ATGAGAGGCCAAGGCGTCCAC | 989 | MRGQGVH | 0.567657 |
| 908 | AACAACAACCAAAAAGTCTAC | 990 | NNNQKVY | 0.610002 |
| 909 | AACAACAGCGGCCACATCAGC | 991 | NNSGHIS | 0.518228 |
| 910 | AACACCCTCATCAACGTCAGC | 992 | NTLINVS | 0.607212 |
| 911 | AATACTTCTGGTGTGCCTAAG | 993 | NTSGVPK | 0.684638 |
| 912 | AATGTGCCGACTTCGCCGCGG | 994 | NVPTSPR | 0.520245 |
| 913 | CCCGCCAGAATCCCCGGCAGC | 995 | PARIPGS | 0.50309 |
| 914 | CCCCTCAGAAACATCAGCGCC | 996 | PLRNISA | 0.50497 |
| 915 | CCGTTGAGTGGGGGTGTTCGT | 997 | PLSGGVR | 0.598554 |
| 916 | CCCAACAGAGCCGCCAACAAC | 998 | PNRAANN | 0.508143 |
| 917 | CCGCGTCATGCGACTCAGTCG | 999 | PRHATQS | 0.711312 |
| 918 | CCGCGGCCGGTGTCGAATGGG | 1000 | PRPVSNG | 0.7305 |
| 919 | CCTTCTGGTTCTGCGCGGAGT | 1001 | PSGSARS | 0.82811 |
| 920 | CCCAGCCACGCCAGAGCCAGC | 1002 | PSHARAS | 0.520336 |
| 921 | CCCGTCGGCACCAGAACCAGC | 1003 | PVGTRTS | 0.560759 |

TABLE 4-continued

List of 7-mer targeting peptides that target the liver

| SEQ ID NO | DNA sequence for 7 mer amino acid | SEQ ID NO | 7 mer amino acid | liver-mean-enrich (log10) |
|---|---|---|---|---|
| 922 | AGAGACACCGTCAGCAGATAC | 1004 | RDTVSRY | 0.535765 |
| 923 | AGAATCAGCACCCTCGGCCTC | 1005 | RISTLGL | 0.595844 |
| 924 | AGGCTTGATAGGACTGGTTTG | 1006 | RLDRTGL | 0.588542 |
| 925 | AGACTCACCAACAGCAACCAA | 1007 | RLTNSNQ | 0.516161 |
| 926 | CGTCAGCATCAGCTTCCTATG | 1008 | RQHQLPM | 0.505918 |
| 927 | AGAACCGCCAACGCCCTCGGC | 1009 | RTANALG | 0.802247 |
| 928 | CGGACGGATGTGCGGACGAAT | 1010 | RTDVRTN | 0.682169 |
| 929 | CGGACTACGGCTAATTCGCTT | 1011 | RTTANSL | 0.509233 |
| 930 | AGCGGCGGCACCAGAGAAGGC | 1012 | SGGTREG | 0.501512 |
| 931 | AGCATCAGAGCCCCCGTCAGC | 1013 | SIRAPVS | 0.572426 |
| 932 | TCGATTTCTCCTCCTCGTACG | 1014 | SISPPRT | 0.550578 |
| 933 | TCGAAGGTTACGCCTCCTCTG | 1015 | SKVTPPL | 0.687491 |
| 934 | AGCAGCAGACTCAGCGTCGGC | 1016 | SSRLSVG | 0.637971 |
| 935 | AGCACCAGAAACGTCGTCGGC | 1017 | STRNVVG | 0.532567 |
| 936 | TCGGTTCCTCCGAATAGGAAT | 1018 | SVPPNRN | 0.508166 |
| 937 | ACGGCTGCGCATGTTAGTTAT | 1019 | TAAHVSY | 0.520336 |
| 938 | ACCAGAAGCGAAGTCATGAAA | 1020 | TRSEVMK | 0.683884 |
| 939 | GTGGCGGGTCTGACTGTTCAG | 1021 | VAGLTVQ | 0.581695 |
| 940 | GTTGGTTCTAGTAATACGTAT | 1022 | VGSSNTY | 0.502229 |
| 941 | GTTAAGACTGATCGGGTTCTG | 1023 | VKTDRVL | 0.51183 |
| 942 | GTCAACAGCCACGAAAGAGCC | 1024 | VNSHERA | 0.573043 |
| 943 | GTCCAAGTCGCCATGAGAGCC | 1025 | VQVAMRA | 0.520831 |
| 944 | GTCAGCATCAGCGTCATGGGC | 1026 | VSISVMG | 0.510987 |
| 945 | GTGACGGGGGTTCGGATTGGG | 1027 | VTGVRIG | 0.75699 |
| 946 | TGGTCTGATCCTAGTGATCTG | 1028 | WSDPSDL | 0.59828 |
| 947 | TACCTCACCAGCGGCGGCTAC | 1029 | YLTSGGY | 0.538789 |
| 948 | TACCCCCACATGACCCACGAC | 1030 | YPHMTHD | 0.655794 |
| 949 | TATGTTAATAGTGCTCCGAAG | 1031 | YVNSAPK | 0.551681 |

The AAV capsids and AAV capsid proteins disclosed herein, in some embodiments, are isolated. In some instances, the AAV capsids and AAV capsid proteins disclosed herein are isolated and purified. In addition, the AAV capsids and AAV capsid proteins disclosed herein, either isolated and purified, or not, may be formulated into a pharmaceutical formulation, which in some cases, further comprises a pharmaceutically acceptable carrier.

B. Heterologous Nucleic Acids

Disclosed herein are therapeutic nucleic acids useful for the treatment or prevention of a disease or condition, or symptom of the disease or condition, disclosed herein. In some embodiments, the therapeutic nucleic acids encode a therapeutic gene expression product. Non-limiting examples of gene expression products include proteins, polypeptides, peptides, enzymes, antibodies, antigen binding fragments, nucleic acid (RNA, DNA, antisense oligonucleotide, siRNA, and the like), and gene editing components, for use in the treatment, prophylaxis, and/or amelioration of the disease or disorder, or symptoms of the disease or disorder. In some instances, the therapeutic nucleic acids are placed in an organism, cell, tissue or organ of a subject by way of a rAAV, such as those disclosed herein.

Disclosed herein are rAAVs, each comprising a viral vector (e.g., a single stranded DNA molecule (ssDNA)). In some instances, the viral vector comprises two inverted terminal repeat (ITR) sequences that are about 145 bases each, flanking a transgene. In some embodiments, the transgene comprises a therapeutic nucleic acid, and in some cases, a promoter in cis with the therapeutic nucleic acid in an open reading frame (ORF). The promoter is capable of initiating transcription of therapeutic nucleic acid in the nucleus of the target cell. The ITR sequences can be from any AAV serotype. Non-limiting examples of AAV serotypes include AV1, AAV2, AAV3, AAV4, AAV5, AAV6, AAV7, AAV8, AAV9, AAV10, AAV11, and AAV12. In some cases, an ITR is from AAV2. In some cases, an ITR is from AAV9.

Disclosed herein are transgenes that can comprise any number of nucleotides. In some cases, a transgene can comprise less than about 100 nucleotides. In some cases, a transgene can comprise at least about 100 nucleotides. In some cases, a transgene can comprise at least about 200 nucleotides. In some cases, a transgene can comprise at least about 300 nucleotides. In some cases, a transgene can comprise at least about 400 nucleotides. In some cases, a transgene can comprise at least about 500 nucleotides. In some cases, a transgene can comprise at least about 1000 nucleotides. In some cases, a transgene can comprise at least about 5000 nucleotides. In some cases, a transgene can comprise at least about 10,000 nucleotides. In some cases, a transgene can comprise at least about 20,000 nucleotides. In some cases, a transgene can comprise at least about 30,000 nucleotides. In some cases, a transgene can comprise at least about 40,000 nucleotides. In some cases, a transgene can comprise at least about 50,000 nucleotides. In some cases, a transgene can comprise between about 500 and about 5000 nucleotides. In some cases, a transgene can comprise between about 5000 and about 10,000 nucleotides. In any of the cases disclosed herein, the transgene can comprise DNA, RNA, or a hybrid of DNA and RNA. In some cases, the transgene can be single stranded. In some cases, the transgene can be double stranded.

Disclosed herein are transgenes useful for modulating the expression or activity of a target gene or gene expression product thereof. In some instances, the transgene is encapsidated by an rAAV capsid protein of an rAAV particle described herein. In some instances, the rAAV particle is delivered to a subject to treat a disease or condition disclosed herein in the subject. In some instances, the delivery is systemic (e.g., intravenous, intranasal).

The transgenes disclosed herein are useful for expressing an endogenous gene at a level similar to that of a healthy or normal individual. This is particularly useful in the treatment of a disease or condition related to the underexpression, or lack of expression, of a gene expression product. In some embodiments, the transgenes disclosed herein are useful for overexpressing an endogenous gene, such that an expression level of the endogenous gene is above the expression level of a healthy or normal individual. Additionally, transgenes can be used to express exogenous genes (e.g., active agent such as an antibody, peptide, nucleic acid, or gene editing components). In some embodiments, the therapeutic gene expression product is capable of altering, enhancing, increasing, or inducing the activity of one or more endogenous biological processes in the cell. In some embodiments, the transgenes disclosed herein are useful for reducing expressing an endogenous gene, example, a dominant negative gene. In some embodiments, the therapeutic gene expression product is capable of altering, inhibiting, reducing, preventing, eliminating, or impairing the activity of one or more endogenous biological processes in the cell. In some aspects, the increase of gene expression refers to an increase by at least about 20%, 30%, 40%, 50%, 60%, 70%, 80%, 85%, 90%, 95% and 100%. In one aspect, the protein product of the targeted gene may be increased by at least about 20%, 30%, 40%, 50%, 60%, 70%, 80%, 85%, 90%, 95% and 100%. In some aspects, the decrease of gene expression refers to an increase by at least about 20%, 30%, 40%, 50%, 60%, 70%, 80%, 85%, 90%, 95% and 100%. In one aspect, the protein product of the targeted gene may be decreased by at least about 20%, 30%, 40%, 50%, 60%, 70%, 80%, 85%, 90%, 95% and 100%.

When endogenous sequences (endogenous or part of a transgene) are expressed with a transgene, the endogenous sequences can be full-length sequences (wild-type or mutant) or partial sequences. The endogenous sequences can be functional. Non-limiting examples of the function of these full length or partial sequences include increasing the serum half-life of the polypeptide expressed by a transgene (e.g., therapeutic gene) and/or acting as a carrier.

A transgene can be inserted into an endogenous gene such that all, some or none of the endogenous gene is expressed. For example, a transgene as described herein can be inserted into an endogenous locus such that some (N-terminal and/or C-terminal to a transgene) or none of the endogenous sequences are expressed, for example as a fusion with a transgene. In other cases, a transgene (e.g., with or without additional coding sequences of the endogenous gene) is integrated into any endogenous locus, for example a safe-harbor locus. For example, a Frataxin (FXN) transgene can be inserted into an endogenous FXN gene. A transgene can be inserted into any gene, e.g., the genes as described herein.

At least one advantage of the present disclosure is that virtually any therapeutic nucleic acid may be used to express any therapeutic gene expression product. In some instances, the therapeutic gene expression product is a therapeutic protein or a peptide (e.g., antibody, antigen-binding fragment, peptide, or protein). In one embodiment the protein encoded by the therapeutic nucleic acid is between 50-5000 amino acids in length. In some embodiments the protein encoded is between 50-2000 amino acids in length. In some embodiments the protein encoded is between 50-1000 amino acids in length. In some embodiments the protein encoded is between 50-1500 amino acids in length. In some embodiments the protein encoded is between 50-800 amino acids in length. In some embodiments the protein encoded is between 50-600 amino acids in length. In some embodiments the protein encoded is between 50-400 amino acids in length. In some embodiments the protein encoded is between 50-200 amino acids in length. In some embodiments the protein encoded is between 50-100 amino acids in length. In some embodiments the peptide encoded is between 4-50 amino acids in length. In some embodiments, the protein encoded is a tetrapeptide, a pentapeptide, a hexapeptide, a heptapeptide, an octapeptide, a nonapeptide, or a decapeptide. In some embodiments, the protein encoded comprises a peptide of 2-30 amino acids, such as for example 5-30, 10-30, 2-25, 5-25, 10-25, or 10-20 amino acids. In some embodiments, the protein encoded comprises a peptide of at least 11, 12, 13, 14, 15, 17, 20, 25 or 30 amino acids, or a peptide that is no longer than 50 amino acids, e.g. no longer than 35, 30, 25, 20, 17, 15, 14, 13, 12, 11 or 10 amino acids.

Non-limiting examples of therapeutic protein or peptides include an adrenergic agonist, an anti-apoptosis factor, an apoptosis inhibitor, a cytokine receptor, a cytokine, a cytotoxin, an erythropoietic agent, a glutamic acid decarboxylase, a glycoprotein, a growth factor, a growth factor receptor, a hormone, a hormone receptor, an interferon, an interleukin, an interleukin receptor, a kinase, a kinase inhibitor, a nerve growth factor, a netrin, a neuroactive peptide, a neuroactive peptide receptor, a neurogenic factor, a neurogenic factor receptor, a neuropilin, a neurotrophic factor, a neurotrophin, a neurotrophin receptor, an N-methyl-D-aspartate antagonist, a plexin, a protease, a protease inhibitor, a protein decarboxylase, a protein kinase, a protein kinsase inhibitor, a proteolytic protein, a proteolytic protein inhibitor, a semaphoring, a semaphorin receptor, a serotonin transport protein, a serotonin uptake inhibitor, a serotonin receptor, a serpin, a serpin receptor, and a tumor suppressor. In certain embodiments, the therapeutic protein or peptide is selected from the group consisting of brain-derived neurotrophic factor (BDNF), ciliary neurotrophic factor (CNTF), macrophage colony-stimulating factor (CSF), epidermal growth factor (EGF), fibroblast growth factor (FGF), gonadotropin, interferon-gamma (IFN), insulin-like growth factor 1 (IFG-1), nerve growth factor (NGF), platelet-derived growth factor (PDGF), pigment epithelium-derived factor (PEDF), transforming growth factor (TGF), transforming growth factor-beta (TGF-B), tumor necrosis factor (TNF), vascular endothelial growth factor (VEGF), prolactin, somatotropin, X-linked inhibitor of apoptosis protein 1 (XIAP1), interleukin 1 (IL-1), IL-2, IL-3, IL-4, IL-5, IL-6, IL-7, IL-8, IL-9, IL-10, IL-10, viral IL-10, IL-11, IL-12, IL-13, IL-14, IL-15, IL-16, IL-17, and IL-18.

A therapeutic gene expression product can comprise gene editing components. Non-limiting examples of gene editing components include those required for CRISPR/Cas, artificial site-specific RNA endonuclease (ASRE), zinc finger endonuclease (ZFN), and transcription factor like effector nuclease (TALEN). In a non-limiting example, a subject having Huntington's disease is identified. The subject is then systemically administered a first amount of a rAAV encapsidating a viral vector encoding ZFN engineered to represses the transcription of the Huntingtin (HTT) gene. In some instances, the route of administration is intravenous. The rAAV will include a modified AAV capsid protein that includes an amino acid sequence provided in any one of Tables 2-3, or FIG. 33, so as to allow proper targeting of the ZFN to the nervous system, while retargeting off-target organs, such as the liver. If needed, the subject is administered a second or third dose of the rAAV, until a therapeutically effective amount of the ZFN is expressed in the subject's nervous system. In another non-limiting example, a subject with cystic fibrosis is identified. The subject is then systemically administered a first amount of a rAAV encapsidating a viral vector encoding ZFN engineered to represses the transcription of the cystic fibrosis transmembrane conductance regulator (CFTR) gene. In some instances, the route of administration is intranasal (e.g., intranasal spray). The rAAV will include a modified AAV capsid protein that includes an amino acid sequence provided in FIG. 33 or Tables 2-3, so as to allow proper targeting of the ZFN to the lung. If needed, the subject is administered a second or third dose of the rAAV, until a therapeutically effective amount of the ZFN is expressed in the subject's lung.

A therapeutic nucleic acid can comprise a non-protein coding gene e.g., sequences encoding antisense RNAs, RNAi, shRNAs and micro RNAs (miRNAs), miRNA sponges or decoys, recombinase delivery for conditional gene deletion, conditional (recombinase-dependent) expression, includes those required for the gene editing components described herein. The non-protein coding gene may also encode a tRNA, rRNA, tmRNA, piRNA, double stranded RNA, snRNA, snoRNA, and/or long non-coding RNA (lncRNA). In some cases, the non-protein coding gene can modulate the expression or the activity of a target gene or gene expression product. For example, the RNAs described herein may be used to inhibit gene expression in a target cell, for example, a cell in the central nervous system (CNS) or peripheral organ (e.g., lung). In some cases, inhibition of gene expression refers to an inhibition by at least about 20%, 30%, 40%, 50%, 60%, 70%, 80%, 85%, 90%, 95% and 100%. In some cases, the protein product of the targeted gene may be inhibited by at least about 20%, 30%, 40%, 50%, 60%, 70%, 80%, 85%, 90%, 95% and 100%. The gene can be either a wild type gene or a gene with at least one mutation. The targeted protein may be either a wild type protein or a protein with at least one mutation.

A therapeutic nucleic acid can modulate the expression or activity of a gene or gene expression product expressed from the gene that is implicated in disease or disorder of the brain. For example, the therapeutic nucleic acid, in some cases is a gene or a modified version of the gene described herein. In another example, the therapeutic nucleic acid comprises an effector gene expression product such as a gene editing component specific to target a gene therein. Non-limited examples of genes include Sarcoglycan Alpha (SGCA), glutamic acid decarboxylase 65 (GAD65), glutamic acid decarboxylase 67 (GAD67), CLN2 gene, Nerve Growth Factor (NGF), glial cell derived neurotrophic factor (GDNF), Neurturin, Survival Of Motor Neuron 1, Telomeric (SMN1), β-Glucocerebrosidase (GCase), Frataxin (FXN), Huntingtin (HTN), methyl-CpG binding protein 2 (MECP2), peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and NPS3. In some embodiments, the peroxisomal biogenesis factor (PEX) is selected from the group consisting of PEX1, PEX2, PEX3, PEX4, PEX5, PEX6, PEX7, PEX10, PEX11(3, PEX12, PEX13, PEX14, PEX16, PEX19, and PEX26. In some instances, the gene or gene expression product is inhibited. In some instances, the gene or gene expression product is enhanced.

A therapeutic nucleic acid modulates expression or activity of a gene or gene expression product expressed from the gene that is implicated in disease or disorder of a particular organ (e.g., lung, heart, liver, muscle, eye). Non-limited examples of genes include Cystic Fibrosis Transmembrane Conductance Regulator (CFTR), Factor X (FIX), RPE65, Retinoid Isomerohydrolase (RPE65), Sarcoglycan Alpha (SGCA), and sarco/endoplasmic reticulum Ca2+-ATPase (SERCA2a). In some embodiments, the therapeutic gene expression product is of human, murine, avian, porcine, bovine, ovine, feline, canine, equine, epine, caprine, lupine or primate origin. In some instances, the gene or gene expression product is inhibited. In some instances, the gene or gene expression product is enhanced.

C. AAV Vectors

Disclosed herein are adeno-associated virus (AAV) vectors comprising genetic information. AAV vectors described herein are useful for the assembly of a rAAV and viral packaging of a heterologous nucleic acid. In addition, an AAV vector may encode a transgene comprising the heterologous nucleic acid. In some instances, the AAV vector is from an AAV serotypes selected from the group consisting of AV1, AAV2, AAV3, AAV4, AAV5, AAV6, AAV7, AAV8, AAV9, AAV10, AAV11, and AAV12. In some instances, the AAV vector is selected from a modified AAV serotype selected from the group consisting of AAV-PHP.B, AAV-PHP.eB, and AAV-PHP.S.

An AAV vector can comprise a transgene, which in some cases encodes a heterologous gene expression product (e.g., therapeutic gene expression product, recombinant capsid protein, and the like). The transgene is in cis with two inverted terminal repeats (ITRs) flanking the transgene. The transgene may comprise a therapeutic nucleic acid encoding a therapeutic gene expression product. Due to the limited packaging capacity of the rAAV (~2.5 kB), in some cases, a longer transgene may be split between two AAV vectors, the first with 3' splice donor and the second with a 5' splice acceptor. Upon co-infection of a cell, concatemers form, which are spliced together to express a full-length transgene.

A transgene is generally inserted so that its expression is driven by the endogenous promoter at the integration site, namely the promoter that drives expression of the endogenous gene into which a transgene is inserted. In some instances, a transgene comprises a promoter and/or enhancer, for example a constitutive promoter or an inducible or tissue/cell specific promoter. As a non-limiting example, the promoter may be CMV promoter, a CMV-β-Actin-intron-β-Globin hybrid promoter (CAG), CBA promoter, FRDA or FXN promoter, UBC promoter, GUSB promoter, NSE promoter, Synapsin promoter, MeCP2 promoter, GFAP promoter, H1 promoter, U6 promoter, NFL promoter, NFH promoter, SCN8A promoter, or PGK promoter. As a non-limiting example, promoters can be tissue-specific expression elements include, but are not limited to, human elongation factor 1α-subunit (EF1α), immediate-early cytomegalovirus (CMV), chicken β-actin (CBA) and its derivative CAG, the β glucuronidase (GUSB), and ubiquitin C (UBC). The transgene may include a tissue-specific expression elements for neurons such as, but not limited to, neuron-specific enolase (NSE), platelet-derived growth factor (PDGF), platelet-derived growth factor B-chain (PDGF-β), the synapsin (Syn), the methyl-CpG binding protein 2 (MeCP2), Ca2+/calmodulin-dependent protein kinase II (CaMKII), metabotropic glutamate receptor 2 (mGluR2), NFL, NFH, np32, PPE, Enk and EAAT2 promoters. The transgene may comprise a tissue-specific expression element for astrocytes such as, but not limited to, the glial fibrillary acidic protein (GFAP) and EAAT2 promoters. The transgene may comprise tissue-specific expression elements for oligo-dendrocytes such as, but not limited to, the myelin basic protein (MBP) promoter.

In some embodiments, the promoter is less than 1 kb. The promoter may have a length of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800. The promoter may have a length between 200-300, 200-400, 200-500, 200-600, 200-700, 200-800, 300-400, 300-500, 300-600, 300-700, 300-800, 400-500, 400-600, 400-700, 400-800, 500-600, 500-700, 500-800, 600-700, 600-800 or 700-800. The promoter may provide expression of the therapeutic gene expression product for a period of time in targeted tissues such as, but not limited to, the central nervous system and peripheral organs (e.g., lung). Expression of the therapeutic gene expression product may be for a period of 1 hour, 2, hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 1 week, 8 days, 9 days, 10 days, 11 days, 12 days, 13 days, 2 weeks, 15 days, 16 days, 17 days, 18 days, 19 days, 20 days, 3 weeks, 22 days, 23 days, 24 days, 25 days, 26 days, 27 days, 28 days, 29 days, 30 days, 31 days, 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 21 months, 22 months, 23 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 21 years, 22 years, 23 years, 24 years, 25 years, 26 years, 27 years, 28 years, 29 years, 30 years, 31 years, 32 years, 33 years, 34 years, 35 years, 36 years, 37 years, 38 years, 39 years, 40 years, 41 years, 42 years, 43 years, 44 years, 45 years, 46 years, 47 years, 48 years, 49 years, 50 years, 55 years, 60 years, 65 years, or more than 65 years. Expression of the payload may be for 1-5 hours, 1-12 hours, 1-2 days, 1-5 days, 1-2 weeks, 1-3 weeks, 1-4 weeks, 1-2 months, 1-4 months, 1-6 months, 2-6 months, 3-6 months, 3-9 months, 4-8 months, 6-12 months, 1-2 years, 1-5 years, 2-5 years, 3-6 years, 3-8 years, 4-8 years or 5-10 years or 10-15 years, or 15-20 years, or 20-25 years, or 25-30 years, or 30-35 years, or 35-40 years, or 40-45 years, or 45-50 years, or 50-55 years, or 55-60 years, or 60-65 years.

An AAV vector can comprise a genome of a helper virus. Helper virus proteins are required for the assembly of a recombinant AAV (rAAV), and packaging of a transgene containing a heterologous nucleic acid into the rAAV. The helper virus genes are adenovirus genes E4, E2a and VA, that when expressed in the cell, assist with AAV replication. In some embodiments, an AAV vector comprises E2. In some embodiments, an AAV vector comprises E4. In some embodiments, an AAV vector comprises VA. In some instances, the AAV vector comprises one of helper virus proteins, or any combination.

An AAV vector can comprise a viral genome comprising a nucleic acid encoding the recombinant AAV (rAAV) capsid protein described herein. The viral genome can comprise a Replication (Rep) gene encoding a Rep protein, and Capsid (Cap) gene encoding an AAP protein in the first open reading frame (ORF1) or a Cap protein in the second open reading frame (ORF2). The Rep protein is selected from the group consisting of Rep78, Rep68, Rep52, and Rep40. In some instances, the Cap gene is modified encoding a modified AAV capsid protein described herein. A wild-type Cap gene encodes three proteins, VP1, VP2, and VP3. In some cases, VP1 is modified. In some cases, VP2 is modified. In some cases, VP3 is modified. In some cases, all three VP1-VP3 are modified. The AAV vector can comprise nucleic acids encoding wild-type Rep78, Rep68, Rep52, Rep40 and AAP proteins.

Disclosed herein are AAV vectors comprising any one of SEQ ID NOS: 10-434, 860-863, 868-949, 1068-5661, 14841-14880, and 14961-15053 which are the DNA sequences encoding modified portions of AAV capsid proteins of the present disclosure. In some instances, the AAV vector comprises a nucleic acid sequences provided in any one of SEQ ID NOS: 10-434 and 868-949, encoding 7-mer modified AAV capsid protein portions. The AAV vector of the present disclosure can comprise the VP1 Cap gene comprises any one of SEQ ID NOS: 6-9 provided in Table 5. An AAV vector can comprise 70%, 75%, 80%, 85%, 90%, 91%, 92%, 93%, 94%, 95%, 96%, 97%, 98%, 99%, or 100% of any one of SEQ ID NOS: 6-9.

In some instances, the AAV9 VP1 gene provided in SEQ ID NO: 6, which is provided in Table 5, is modified to include any one of SEQ ID NOS: 10-434, 860-863, 868-949, 1068-5661, 14841-14880, and 14961-15053. In some instances, the AAV-PHP.eB VP1 (SEQ ID NO: 9), which is also provided in Table 5 is modified to include any one of SEQ ID NOS: 10-434, 860-863, 868-949, 1068-5661, 14841-14880, and 14961-15053. The AAV vector described herein may be used to produce a variant AAV capsid by the methods described herein.

TABLE 5

| VP1 Capsid Protein Nucleic Acid Sequences | | |
|---|---|---|
| SEQ ID NO: | Identifier | Sequence |
| 6 | AAV9 >AY530579.1 Adeno- associated virus 9 isolate hu.14 capsid protein VP1 (cap) gene, complete cds | ATGGCTGCCGATGGTTATCTTCCAGATTGGCTCGAGGACAA CCTTAGTGAAGGAATTCGCGAGTGGTGGGCTTTGAAACCTG GAGCCCCTCAACCCAAGGCAAATCAACAACATCAAGACAA CGCTCGAGGTCTTGTGCTTCCGGGTTACAAATACCTTGGACC CGGCAACGGACTCGACAAGGGGGAGCCGGTCAACGCAGCA GACGCGGCGGCCCTCGAGCACGACAAGGCCTACGACCAGC AGCTCAAGGCCGGAGACAACCCGTACCTCAAGTACAACCAC GCCGACGCCGAGTTCCAGGAGCGGCTCAAAGAAGATACGTC TTTTGGGGGCAACCTCGGGCGAGCAGTCTTCCAGGCCAAAA AGAGGCTTCTTGAACCTCTTGGTCTGGTTGAGGAAGCGGCT AAGACGGCTCCTGGAAAGAAGAGGCCTGTAGAGCAGTCTCC TCAGGAACCGGACTCCTCCGCGGGTATTGGCAAATCGGGTG CACAGCCCGCTAAAAAGAGACTCAATTTCGGTCAGACTGGC GACACAGAGTCAGTCCCAGACCCTCAACCAATCGGAGAACC TCCCGCAGCCCCTCAGGTGTGGGATCTCTTACAATGGCTTC AGGTGGTGGCGCACCAGTGGCAGACAATAACGAAGGTGCC GATGGAGTGGGTAGTTCCTCGGGAAATTGGCATTGCGATTC CCAATGGCTGGGGGACAGAGTCATCACCACCAGCACCCGAA CCTGGGCCCTGCCCACCTACAACAATCACCTCTACAAGCAA ATCTCCAACAGCACATCTGGAGGATCTTCAAATGACAACGC CTACTTCGGCTACAGCACCCCCTGGGGGTATTTTGACTTCAA CAGATTCCACTGCCACTTCTCACCACGTGACTGGCAGCGAC TCATCAACAACAACTGGGGATTCCGGCCTAAGCGACTCAAC TTCAAGCTCTTCAACATTCAGGTCAAAGAGGTTACGGACAA CAATGGAGTCAAGACCATCGCCAATAACCTTACCAGCACGG TCCAGGTCTTCACGGACTCAGACTATCAGCTCCCGTACGTGC TCGGGTCGGCTCACGAGGGCTGCCTCCCGCCGTTCCCAGCG GACGTTTTCATGATTCCTCAGTACGGGTATCTGACGCTTAAT GATGGAAGCCAGGCCGTGGGTCGTTCGTCCTTTTACTGCCT GGAATATTTCCCGTCGCAAATGCTAAGAACGGGTAACAACT TCCAGTTCAGCTACGAGTTTGAGAACGTACCTTTCCATAGCA GCTACGCTCACAGCCAAAGCCTGGACCGACTAATGAATCCA CTCATCGACCAATACTTGTACTATCTCTCAAAGACTATTAAC GGTTCTGGACAGAATCAACAAACGCTAAAATTCAGTGTGGC CGGACCCAGCAACATGGCTGTCCAGGGAAGAAACTACATAC CTGGACCCAGCTACCGACAACAACGTGTCTCAACCACTGTG ACTCAAAACAACAACAGCGAATTTGCTTGGCCTGGAGCTTC TTCTTGGGCTCTCAATGGACGTAATAGCTTGATGAATCCTGG ACCTGCTATGGCCAGCCACAAAGAAGGAGAGGACCGTTTCT TTCCTTTGTCTGGATCTTTAATTTTTGGCAAACAAGGAACTG GAAGAGACAACGTGGATGCGGACAAAGTCATGATAACCAA CGAAGAAGAAATTAAAACTACTAACCCGGTAGCAACGGAG TCCTATGGACAAGTGGCCACAAACCACCAGAGTGCCCAAGC ACAGGCGCAGACCGGCTGGGTTCAAAACCAAGGAATACTTC CGGGTATGGTTTGGCAGGACAGAGATGTGTACCTGCAAGGA CCCATTTGGGCCAAAATTCCTCACACGGACGGCAACTTTCA CCCTTCTCCGCTGATGGGAGGGTTTGGAATGAAGCACCCGC CTCCTCAGATCCTCATCAAAAACACACCTGTACCTGCGGAT CCTCCAACGGCCTTCAACAAGGACAAGCTGAACTCTTTCAT CACCCAGTATTCTACTGGCCAAGTCAGCGTGGAGATCGAGT GGGGAGCTGCAGAAGGAAAACAGCAAGCGCTGGAACCCGGA GATCCAGTACACTTCCAACTATTACAAGTCTAATAATGTTGA ATTTGCTGTTAATACTGAAGGTGTATATAGTGAACCCCGCCC CATTGGCACCAGATACCTGACTCGTAATCTGTAA |
| 7 | AAV- PHP.B | ATGGCTGCCG ATGGTTATCT TCCAGATTGG CTCGAGGACA ACCTTAGTGAAGGAATTCGC GAGTGGTGGG CTTTGAAACC TGGAGCCCCT CAACCCAAGGCAAATCAACA ACATCAAGAC AACGCTCGAG GTCTTGTGCT TCCGGGTTACAAATACCTTG GACCCGGCAA CGGACTCGAC AAGGGGGAGC GGTCAACGC AGCAGACGCG GCGGCCCTCG AGCACGACAA GCCTACGAC CAGCAGCTCAAGGCCGGAGA CAACCCGTAC CTCAAGTACA ACCACGCCGA CGCCGAGTTCCAGGAGCGGC TCAAAGAAGA TACGTCTTTT GGGGGCAACC TCGGGCGAGCAGTCTTCCAG GCCAAAAAGA GGCTTCTTGA ACCTCTTGGT CTGGTTGAGG AAGCGGCTAA GACGGCTCCT GGAAAGAAGA GGCCTGTAGA GCAGTCTCCTCAGGAACCGG ACTCCTCCGC GGGTATTGGC AAATCGGGTG CACAGCCCGCTAAAAAGAGA CTCAATTTCG GTCAGACTGG CGACACAGAG TCAGTCCCAGACCCTCAACC AATCGGAGAA CCTCCCGCAG CCCCCTCAGG TGTGGGATCT CTTACAATGG CTTCAGGTGG TGGCGCACCA GTGGCAGACA ATAACGAAGGTGCCGATGGA GTGGGTAGTT CCTCGGGAAA TTGGCATTGC GATTCCCAATGGCTGGGGGA CAGAGTCATC ACCACCAGCA CCCGAACCTG GCCCTGCCCACCTACAACA ATCACCTCTA |

TABLE 5-continued

| SEQ ID NO: | Identifier | Sequence |
|---|---|---|
| | | CAAGCAAATC TCCAACAGCA CATCTGGAGG |
| | | ATCTTCAAAT GACAACGCCT ACTTCGGCTA CAGCACCCCC |
| | | TGGGGGTATTTTGACTTCAA CAGATTCCAC TGCCACTTCT |
| | | CACCACGTGA CTGGCAGCGACTCATCAACA ACAACTGGGG |
| | | ATTCCGGCCT AAGCGACTCA ACTTCAAGCTCTTCAACATT |
| | | CAGGTCAAAG AGGTTACGGA CAACAATGGA |
| | | GTCAAGACCA TCGCCAATAA CCTTACCAGC ACGGTCCAGG |
| | | TCTTCACGGA CTCAGACTATCAGCTCCCGT ACGTGCTCGG |
| | | GTCGGCTCAC GAGGGCTGCC TCCCGCCGTTCCCAGCGGAC |
| | | GTTTTCATGA TTCCTCAGTA CGGGTATCTG |
| | | ACGCTTAATGATGGAAGCCA GGCCGTGGGT CGTTCGTCCT |
| | | TTTACTGCCT GGAATATTTC CCGTCGCAAA TGCTAAGAAC |
| | | GGGTAACAAC TTCCAGTTCA GCTACGAGTTTGAGAACGTA |
| | | CCTTTCCATA GCAGCTACGC TCACAGCCAA |
| | | AGCCTGGACCGACTAATGAA TCCACTCATC GACCAATACT |
| | | TGTACTATCT CTCTAGAACT ATTAACGGTT CTGGACAGAA |
| | | TCAACAAACG CTAAAATTCA GTGTGGCCGG |
| | | ACCCAGCAAC ATGGCTGTCC AGGGAAGAAA CTACATACCT |
| | | GGACCCAGCTACCGACAACA ACGTGTCTCA ACCACTGTGA |
| | | CTCAAAACAA CAACAGCGAATTTGCTTGGC CTGGAGCTTC |
| | | TTCTTGGGCT CTCAATGGAC GTAATAGCTT GATGAATCCT |
| | | GGACCTGCTA TGGCCAGCCA CAAAGAAGGA |
| | | GAGGACCGTTTCTTTCCTTT GTCTGGATCT TTAATTTTTG |
| | | GCAAACAAGG TACCGGCAGAGACAACGTGG |
| | | ATGCGGACAA AGTCATGATA ACCAACGAAG |
| | | AAGAAATTAAAACTACTAAC CCGGTAGCAA CGGAGTCCTA |
| | | TGGACAAGTG GCCACAAACCACCAGAGTGC CCAAACTTTG |
| | | GCGGTGCCTT TTAAGGCACA GGCGCAGACCGGTTGGGTTC |
| | | AAAACCAAGG AATACTTCCG GGTATGGTTT |
| | | GGCAGGACAGAGATGTGTAC CTGCAAGGAC CCATTTGGGC |
| | | CAAAATTCCT CACACGGACG GCAACTTTCA CCCTTCTCCG |
| | | CTGATGGGAG GGTTTGGAAT GAAGCACCCGCCTCCTCAGA |
| | | TCCTCATCAA AAACACACCT GTACCTGCGG |
| | | ATCCTCCAACGGCCTTCAAC AAGGACAAGC TGAACTCTTT |
| | | CATCACCCAG TATTCTACTGGCCAAGTCAG CGTGGAGATC |
| | | GAGTGGGAGC TGCAGAAGGA AAACAGCAAG |
| | | CGCTGGAACC CGGAGATCCA GTACACTTCC AACTATTACA |
| | | AGTCTAATAATGTTGAATTT GCTGTTAATA CTGAAGGTGT |
| | | ATATAGTGAA CCCCGCCCCATTGGCACCAG ATACCTGACT |
| | | CGTAATCTGT AA |
| 8 | AAV-PHP.S | ATGGCTGCCGATGGTTATCTTCCAGATTGGCTCGAGGACAA |
| | | CCTTAGTGAAGGAATTCGCGAGTGGTGGGCTTTGAAACCTG |
| | | GAGCCCCTCAACCCAAGGCAAATCAACAACATCAAGACAA |
| | | CGCTCGAGGTCTTGTGCTTCCGGGTTACAAATACCTTGGACC |
| | | CGGCAACGGACTCGACAAGGGGGAGCCGGTCAACGCAGCA |
| | | GACGCGGCGGCCCTCGAGCACGACAAGGCCTACGACCAGC |
| | | AGCTCAAGGCCGGAGACAACCCGTACCTCAAGTACAACCAC |
| | | GCCGACGCCGAGTTCCAGGAGCGGCTCAAAGAAGATACGTC |
| | | TTTTGGGGGCAACCTCGGGCGAGCAGTCTTCCAGGCCAAAA |
| | | AGAGGCTTCTTGAACCTCTTGGTCTGGTTGAGGAAGCGGCT |
| | | AAGACGGCTCCTGGAAAGAAGAGGCCTGTAGAGCAGTCTCC |
| | | TCAGGAACCGGACTCCTCCGCGGGTATTGGCAAATCGGGTG |
| | | CACGCCCGCTAAAAAGAGACTCAATTTCGGTCAGACTGGC |
| | | GACACAGAGTCAGTCCCAGACCCTCAACCAATCGGAGAACC |
| | | TCCCGCAGCCCCCTCAGGTGTGGGATCTCTTACAATGGCTTC |
| | | AGGTGGTGGCGCACCAGTGGCAGACAATAACGAAGGTGCC |
| | | GATGGAGTGGGTAGTTCCTCGGGAAATTGGCATTGCGATTC |
| | | CCAATGGCTGGGGGACAGAGTCATCACCACCAGCACCCGAA |
| | | CCTGGGCCCTGCCCACCTACAACAATCACCTCTACAAGCAA |
| | | ATCTCCAACAGCACATCTGGAGGATCTTCAAATGACAACGC |
| | | CTACTTCGGCTACAGCACCCCCTGGGGGTATTTTGACTTCAA |
| | | CAGATTCCACTGCCACTTCTCACCACGTGACTGGCAGCGAC |
| | | TCATCAACAACAACTGGGGATTCCGGCCTAAGCGACTCAAC |
| | | TTCAAGCTCTTCAACATTCAGGTCAAAGAGGTTACGGACAA |
| | | CAATGGAGTCAAGACCATCGCCAATAACCTTACCAGCACGG |
| | | TCCAGGTCTTCACGGACTCAGACTATCAGCTCCCGTACGTGC |
| | | TCGGGTCGGCTCACGAGGGCTGCCTCCCGCCGTTCCCAGCG |
| | | GACGTTTTCATGATTCCTCAGTACGGGTATCTGACGCTTAAT |
| | | GATGGAAGCCAGGCCGTGGGTCGTTCGTCCTTTTACTGCCTG |
| | | GAATATTTCCCGTCGCAAATGCTAAGAACGGGTAACAACTT |
| | | CCAGTTCAGCTACGAGTTTGAGAACGTACCTTTCCATAGCA |
| | | GCTACGCTCACAGCCAAAGCCTGGACCGACTAATGAATCCA |
| | | CTCATCGACCAATACTTGTACTATCTCTCAAAGACTATTAAC |
| | | GGTTCTGGACAGAATCAACAAACGCTAAAATTCAGTGTGGC |

TABLE 5-continued

| | VP1 Capsid Protein Nucleic Acid Sequences | |
|---|---|---|

| SEQ ID NO: | Identifier | Sequence |
|---|---|---|
| | | CGGACCCAGCAACATGGCTGTCCAGGGAAGAAACTACATAC CTGGACCCAGCTACCGACAACAACGTGTCTCAACCACTGTG ACTCAAAACAACAACAGCGAATTTGCTTGGCCTGGAGCTTC TTCTTGGGCTCTCAATGGACGTAATAGCTTGATGAATCCTGG ACCTGCTATGGCCAGCCACAAAGAAGGAGAGGACCGTTTCT TTCCTTTGTCTGGATCTTTAATTTTTGGCAAACAAGGAACTG GAAGAGACAACGTGGATGCGGACAAAGTCATGATAACCAA CGAAGAAGAAATTAAAACTACTAACCCGGTAGCAACGGAG TCCTATGGACAAGTGGCCACAAACCACCAGAGTGCCCAACA GGCGGTTAGGACGTCTTTGGCACAGGCGCAGACCGGCTGGG TTCAAAACCAAGGAATACTTCCGGGTATGGTTTGGCAGGAC AGAGATGTGTACCTGCAAGGACCCATTTGGGCCAAAATTCC TCACACGGACGGCAACTTTCACCCTTCTCCGCTGATGGGAG GGTTTGGAATGAAGCACCCGCCTCCTCAGATCCTCATCAAA AACACACCTGTACCTGCGGATCCTCCAACGGCCTTCAACAA GGACAAGCTGAACTCTTTCATCACCCAGTATTCTACTGGCCA AGTCAGCGTGGAGATCGAGTGGGAGCTGCAGAAGGAAAAC AGCAAGCGCTGGAACCCGGAGATCCAGTACACTTCCAACTA TTACAAGTCTAATAATGTTGAATTTGCTGTTAATACTGAAGG TGTATATAGTGAACCCCGCCCCATTGGCACCAGATACCTGA CTCGTAATCTGTAA |
| 9 | AAV-PHP.eB | ATGGCTGCCGATGGTTATCTTCCAGATTGGCTCGAGGACAA CCTTAGTGAAGGAATTCGCGAGTGGTGGGCTTTGAAACCTG GAGCCCCTCAACCCAAGGCAAATCAACAACATCAAGACAA CGCTCGAGGTCTTGTGCTTCCGGGTTACAAATACCTTGGACC CGGCAACGGACTCGACAAGGGGGAGCCGGTCAACGCAGCA GACGCGGCGGCCCTCGAGCACGACAAGGCCTACGACCAGC AGCTCAAGGCCGGAGACAACCCGTACCTCAAGTACAACCAC GCCGACGCCGAGTTCCAGGAGCGGCTCAAAGAAGATACGTC TTTTGGGGGCAACCTCGGGCGAGCAGTCTTCCAGGCCAAAA AGAGGCTTCTTGAACCTCTTGGTCTGGTTGAGGAAGCGGCT AAGACGGCTCCTGGAAAGAAGAGGCCTGTAGAGCAGTCTCC TCAGGAACCGGACTCCTCCGCGGGTATTGGCAAATCGGGTG CACAGCCCGCTAAAAAGAGACTCAATTTCGGTCAGACTGGC GACACAGAGTCAGTCCCAGACCCTCAACCAATCGGAGAACC TCCCGCAGCCCCCTCAGGTGTGGGATCTCTTACAATGGCTTC AGGTGGTGGCGCACCAGTGGCAGACAATAACGAAGGTGCC GATGGAGTGGGTAGTTCCTCGGGAAATTGGCATTGCGATTC CCAATGGCTGGGGGACAGAGTCATCACCACCAGCACCCGAA CCTGGGCCCTGCCCACCTACAACAATCACCTCTACAAGCAA ATCTCCAACAGCACATCTGGAGGATCTTCAAATGACAACGC CTACTTCGGCTACAGCACCCCCTGGGGGTATTTTGACTTCAA CAGATTCCACTGCCACTTCTCACCACGTGACTGGCAGCGAC TCATCAACAACAACTGGGGATTCCGGCCTAAGCGACTCAAC TTCAAGCTCTTCAACATTCAGGTCAAAGAGGTTACGGACAA CAATGGAGTCAAGACCATCGCCAATAACCTTACCAGCACGG TCCAGGTCTTCACGGACTCAGACTATCAGCTCCCGTACGTGC TCGGGTCGGCTCACGAGGGCTGCCTCCCGCCGTTCCCAGCG GACGTTTTCATGATTCCTCAGTACGGGTATCTGACGCTTAAT GATGGAAGCCAGGCCGTGGGTCGTTCGTCCTTTTACTGCCTG GAATATTTCCCGTCGCAAATGCTAAGAACGGGTAACAACTT CCAGTTCAGCTACGAGTTTGAGAACGTACCTTTCCATAGCA GCTACGCTCACAGCCAAAGCCTGGACCGACTAATGAATCCA CTCATCGACCAATACTTGTACTATCTCTCTAGAACTATTAAC GGTTCTGGACAGAATCAACAAACGCTAAAATTCAGTGTGGC CGGACCCAGCAACATGGCTGTCCAGGGAAGAAACTACATAC CTGGACCCAGCTACCGACAACAACGTGTCTCAACCACTGTG ACTCAAAACAACAACAGCGAATTTGCTTGGCCTGGAGCTTC TTCTTGGGCTCTCAATGGACGTAATAGCTTGATGAATCCTGG ACCTGCTATGGCCAGCCACAAAGAAGGAGAGGACCGTTTCT TTCCTTTGTCTGGATCTTTAATTTTTGGCAAACAAGGTACCG GCAGAGACAACGTGGATGCGGACAAAGTCATGATAACCAA CGAAGAAGAAATTAAAACTACTAACCCGGTAGCAACGGAG TCCTATGGACAAGTGGCCACAAACCACCAGAGTGATGGGAC TTTGGCGGTGCCTTTTAAGGCACAGGCGCAGACCGGTTGG TTCAAAACCAAGGAATACTTCCGGGTATGGTTTGGCAGGAC AGAGATGTGTACCTGCAAGGACCCATTTGGGCCAAAATTCC TCACACGGACGGCAACTTTCACCCTTCTCCGCTGATGGGAG GGTTTGGAATGAAGCACCCGCCTCCTCAGATCCTCATCAAA AACACACCTGTACCTGCGGATCCTCCAACGGCCTTCAACAA GGACAAGCTGAACTCTTTCATCACCCAGTATTCTACTGGCCA AGTCAGCGTGGAGATCGAGTGGGAGCTGCAGAAGGAAAAC AGCAAGCGCTGGAACCCGGAGATCCAGTACACTTCCAACTA TTACAAGTCTAATAATGTTGAATTTGCTGTTAATACTGAAGG |

TABLE 5-continued

| VP1 Capsid Protein Nucleic Acid Sequences |
| --- |

```
SEQ
ID NO:  Identifier  Sequence

TGTATATAGTGAACCCCGCCCCATTGGCACCAGATACCTGA
                    CTCGTAATCTGTAA
```

II. Methods

A. Methods of Producing AAVs

Disclosed herein are methods of identifying a recombinant AAV (rAAV), such as those disclosed herein. The AAV peptide specific to target in vivo environments are identified using multiplexed Cre recombination-based AAV targeted evolution (M-CREATE). FIG. 1 provides a workflow using M-CREATE. M-CREATE uses an rAAV capsid genome (rAAV-Cap-in-cis-lox or rAAV-ΔCap-in-cis-lox2 as described in Example 2 below) that couples a full-length AAV Cap gene, controlled by regulatory elements from the AAV Rep gene, with a Cre-invertible switch. The rAAV-ΔCap-in-cis-lox2 backbone has a bi-directional polyA flanked by two Lox sites (lox71 and lox66). The ΔCap backbone is nonfunctional as it is missing a portion of the capsid gene. Upon insertion of a library fragment with mutagenesis at a specific site into the capsid, it then becomes a fully functional vector. In a cell expressing the Cre recombinase, the Cre-Lox recombination facilitates inversion of the polyA in addition to flipping the Lox sites to Lox72 and LoxP. (See FIGS. 1 and 36) The randomized 7-mer and 11-mers disclosed herein are generated using PCR, which are then inserted into the rAAV-ΔCap-in-cis-lox to generate virus libraries with randomized insertions or substitutions in the capsid protein sequence (e.g., at the AA588_589). (FIG. 1). In a first round of in vivo selection, the virus libraries are injected into the blood stream (e.g., intravenously) of transgenic animals expressing Cre recombinase. Tissues obtained from the transgenic animals following injection in in vivo environment (e.g., brain/liver). The inverted reporter expression cassette is detected using selective amplification expression of the reporter gene expression product. The rAAVs in the tissues are isolated and the viral genome around the insertion site is sequenced and aligned with an AAV9 template DNA fragment. The 7-mers and 11-mers that were recovered were enriched in the target in vivo environment, and were cloned into another rAAV-ΔCap-in-cis-lox2 backbone, and another round of in vivo selection is performed. The 7-mers and 11-mers enriched in the target in vivo environment, and negatively enriched in an off-target in vivo environment are sequenced using suitable methods, such as next generation sequencing. FIGS. 33-35 provide DNA sequences identified using the methods provided herein.

Methods comprise providing a rAAV genome comprising an AAV capsid gene, and a recognition sequence for a Cre recombinase. In some cases, the rAAV genome has two recognition sequences for Cre recombinase that flank a reporter expression cassette. The recognition sequences for Cre recombinase (e.g., LoxP) are oriented such that an inversion of the reporter cassette is facilitated in the presence of Cre recombinase in a cell. Methods comprise transfecting a population of cells expressing the Cre recombinase with the rAAV genome. The Cre recombinase induces an inversion (e.g., "flip" of the reporter gene into a genome of the transgenic animal). In some cases, the rate of inversion (e.g., a level of expression of the reporter gene in a target cell) may be measured using any suitable method, such as quantitative polymerase chain reaction, or immunohistochemistry. The level of expression of the reporter gene is compared to a reference value, which in some cases is the rate of inversion by a reference AAV (e.g., AAV9). Methods disclosed herein provide that an increase in the rate of inversion is detected in a target in vivo environment, as compared to the rate of inversion of a reference AAV. In some cases, a decrease in a rate of inversion is detected in an off-target cell, as compared to the rate of inversion of a reference AAV. The rAAV genome recovered using the methods described herein encodes for an AAV capsid particle (e.g., capsid protein, capsid) with an increased specificity for the target cell, and a decreased specificity for the off-target cell.

Disclosed herein are methods of producing a rAAV disclosed herein. In some instances, all elements that are required for AAV production in target cell (e.g., HEK293cells) are transiently transfected into the target cell using suitable methods known in the art. For example, the rAAV of the present disclosure can be product by co-transfecting three plasmid vectors, a first vector with ITR-containing plasmid carrying the transgene (e.g., therapeutic nucleic acid), a second vector that carries the AAV Rep and Cap genes; and (3), a third vector that provides the helper genes isolated from adenovirus. The methods described herein generate high-titer AAV vectors that are free of adenovirus. The Cap gene disclosed here comprises any one of SEQ ID NOS: 10-434, 860-863, 868-949, 1068-5661, 14841-14880, and 14961-15053 which are DNA sequences encoding the modified AAV capsid protein portions of the present disclosure. In some cases, rAAVs of the present disclosure are generated using the methods described in Challis, R. C. et al. Systemic AAV vectors for widespread and targeted gene delivery in rodents. Nat. Protoc. 14, 379 (2019), which is hereby incorporated by reference in its entirety. Briefly, triple transfection of HEK293T cells (ATCC) using polyethylenimine (PEI) is performed, viruses are collected after 120 hours from both cell lysates and media, and purified over iodixanol.

Disclosed herein, are methods comprising: (a) introducing into a cell a nucleic acid comprising: (1) a first nucleic acid sequence encoding a therapeutic gene expression product; (2) a second nucleic acid sequence encoding viral genome components comprising: (i) a Replication (Rep) gene encoding a Rep protein; and (ii) a modified capsid (Cap) gene encoding a modified AAV capsid protein described herein, and (3) a third nucleic acid sequence encoding a genome of an AAV helper virus; and (b) assembling a recombinant AAV (rAAV) capsid encapsidating the first nucleic acid, the rAAV capsid comprising a tropism with an increased specificity for a target in vivo environment in a subject and a decreased specificity for an off-target in vivo environment, relative to a tropism of a corresponding parental AAV capsid protein. In some instances, the methods further comprise packing the first nucleic acid sequence encoding the therapeutic gene expression product such that it becomes encapsidated by the modified AAV capsid protein. In some embodiments, the rAAV particles are isolated, concentrated, and purified using suitable viral purification methods, such as those described herein.

In a non-limiting example, the rAAVs are generated by triple transfection of precursor cells (e.g., HEK293T) cells using a standard transfection protocol (e.g., PEI). Viral particles are harvested from the media after a period of time (e.g., 72 h post transfection) and from the cells and media at a later point in time (e.g., 120 h post transfection). Virus present in the media is concentrated by precipitation with 8% poly(ethylene glycol) and 500 mM sodium chloride and the precipitated virus is added to the lysates prepared from the collected cells. The viruses are purified over iodixanol (Optiprep, Sigma) step gradients (15%, 25%, 40% and 60%). Viruses are concentrated and formulated in PBS. Virus titers are determined by measuring the number of DNaseI-resistant vector genome copies (VGs) using qPCR and the linearized genome plasmid as a control.

The Rep protein can be selected from the group consisting of Rep78, Rep68, Rep52, and Rep40. The genome of the AAV helper virus comprises an AAV helper gene selected from the group consisting of E2, E4, and VA. The second nucleic acid and the first nucleic acid can be in trans. The second nucleic acid and the first nucleic acid can be in cis.

The cell can be selected from a group consisting of a human, a primate, a murine, a feline, a canine, a porcine, an ovine, a bovine, an equine, an epine, a caprine and a lupine host cell. In some instances, the cell is a progenitor or precursor cell, such as a stem cell. In some instances, the stem cell is a mesenchymal cell, embryonic stem cell, induced pluripotent stem cell (iPSC), fibroblast or other tissue specific stem cell. The cell can be immortalized. In some cases, the immortalized cell is a HEK293cell. In some instances, the cell is a differentiated cell. Based on the disclosure provided, it is expected that this system can be used in conjunction with any transgenic line expressing a recombinase in the target cell type of interest to develop AAV capsids that more efficiently transduce that target cell population.

B. Methods of rAAV-Mediated Delivery of a Heterologous Nucleic Acid

Disclosed herein are methods of delivering a heterologous nucleic acid (e.g., therapeutic nucleic acid or transgene disclosed herein) to subject in need thereof. The transgene may be encapsidated by a recombinant AAV (rAAV) capsid protein or rAAV particle such as those described herein.

Methods may be ex vivo, e.g., scientific research purposes or for producing adoptive cellular therapies. The subject may be a human primary cell or a mature cell, or cell line. The subject may be a cell from a monkey, hamster, or mouse. In either case, delivery may include contacting the composition with the cell or cell line.

Methods may be in vivo, e.g., treating a disease or a condition in a subject in need thereof. In some instances, the subject may be mammal, such as a human or non-human primate, in which case delivery of the composition may comprise administering the composition to the subject. In some embodiments, delivery of the heterologous nucleic acid comprises administering to the subject the composition using any one of the routes of administration described herein.

In some embodiments, methods of increasing transduction of a heterologous nucleic acid in a target in vivo environment comprise delivering a rAAV particle described herein, the rAAV engineered to have an increased transduction efficiency in a target in vivo environment (e.g., tissue or cell type). In some instances, the increased transduction efficiency comprises a 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold increase, or more, relative to a reference AAV. In some instances, the increased transduction efficiency is at least 30-fold. In some instances, the increased transduction efficiency is at least 40-fold. In some instances, the increased transduction efficiency is at least 50-fold. In some instances, the increased transduction efficiency is at least 60-fold. In some instances, the increased transduction efficiency is at least 80-fold. In some instances, the increased transduction efficiency is at least 90-fold. In some instances, the increased transduction efficiency is at least 100-fold.

Methods of delivering a heterologous nucleic acid to a target in vivo environment are also provided comprising delivering the rAAV particle described herein that has been engineered to have an increased specificity in a target in vivo environment (e.g., tissue or cell type), as compared to a reference AAV. Methods, in some cases, comprise detecting whether a rAAV possesses more specificity for a target in vivo environment than a reference AAV, includes measuring a level of gene expression product (e.g., RNA or protein) expressed from the heterologous nucleic acid encapsidated by the rAAV in a tissue sample obtained from the target in vivo environment in a subject; and comparing the measured level to a control level (such as, for e.g., the gene expression product expressed from a heterologous nucleic acid encapsidated by a reference AAV (e.g., AAV9)). Suitable methods for measuring expression of a gene expression product luciferase reporter assay and quantitative polymerase chain reaction (qPCR).

In some instances, the reference AAV has a serotype selected from the group consisting of AAV1, AAV2, AAV3, AAV4, AAVS, AAV6, AAV7, AAV8, AAV9, AAV10, AAV11, AAV12, or variant thereof. For example, the reference AAV can have a serotype selected from the group consisting of AAV-PHP.B, AAV-PHP.eB, and AAV-PHP.S.

Delivery to the CNS

Provided herein are methods of delivering a heterologous nucleic acid to a target in vivo environment comprising delivering a composition to the target in vivo environment selected from the group consisting of a central nervous system (CNS) in a subject, the composition comprising a rAAV particle with a rAAV capsid protein, the rAAV capsid protein encapsidating a viral vector encoding a heterologous nucleic acid (e.g., therapeutic nucleic acid). In some embodiments, the rAAV particle encapsidating the heterologous nucleic acid comprises a rAAV capsid protein engineered with an increased specificity and, in some cases, transduction efficiency when measured in the CNS or the PNS of the subject, even when administered to the subject systemically, as compared to a reference AAV.

Methods comprise delivering a rAAV particle comprising an rAAV capsid protein with increased specificity and/or transduction efficiency when measured in the CNS in the subject, as compared to a reference AAV (e.g., AAV9). In some embodiments, delivery is systemic. Alternatively, delivery is direct (e.g., into the affected area of the CNS).

The rAAV capsid protein may comprise a substitution of at least one, two, three, four, five, six, seven, eight, nine, ten, or eleven amino acids provided in an amino acid sequence provided in any one of Tables 2-3, in an amino acid sequence of a parental AAV. In some instances, X1 is selected from the group consisting of A, E, D, G, R, S and T. In some instances, the insertion further comprises two amino acids, wherein X2 is selected from the group consisting of A, G, I, L, M, N, Q, R, T, and Y. In some instances, the insertion further comprises three amino acids, wherein X3 is selected from the group consisting of E, K, L, T, and Q. In some instances, the insertion further comprises at least four amino acids, wherein X1 is selected from the group consisting of A, E, D, G, R, S and T, X2 is selected from the group consisting of A, G, I, L, M, N, Q, R, T, and Y, X3 is selected from the group consisting of E, K, L, T, and Q, and X4 is selected from the group consisting of G, I, K, L, M, R, T, and V. In some instances, the insertion further comprises five amino acids wherein X5 is selected from the group consisting of A, D, G, P, L, Q, and V. In some instances, the insertion further comprises at least six amino acids, wherein X6 is selected from the group consisting of F, K, L, N, P, Q, S, and V. In some instances, the insertion further comprises at least seven amino acids, wherein X7 is selected from the group consisting of I, K, L, P, S, and V.

Disclosed herein are methods comprising delivering a rAAV particle encapsidating a heterologous nucleic acid to a CNS in a subject, the rAAV particle comprising (i) an increased specificity and/or transduction efficiency of the heterologous nucleic acid for the CNS, wherein the rAAV particle has an rAAV capsid protein comprising an insertion of at least or about three, four, five, six, or seven amino acids of an amino acid sequence TALKPFL, TTLKPFL, TLQIPFK, TMQKPFI, or RYQGDSV, or any amino acid sequence provided in Tables 2-3 or FIG. 33, at an amino acid position 588_589 in a parental AAV capsid protein. In some embodiments, the delivering is systemic. In some embodiments, the delivery is direct (e.g., injected into the in vivo environment). In some embodiments, the parental AAV capsid protein is AAV9 capsid protein (for e.g., provided in SEQ ID NO: 1). In some embodiments, delivery is more specific than a delivery of the heterologous nucleic acid by a reference AAV, e.g., AAV9. In some embodiments, the delivery is systemic (e.g., intravenous). In some embodiments, the subject is a mammal. In some embodiments, the subject is a human.

Delivery to the Liver

In some cases, the methods of delivering a heterologous nucleic acid comprise delivering to a target in vivo environment in a subject a composition, the composition comprising a rAAV particle with a rAAV capsid protein, the rAAV capsid protein encapsidating a viral vector encoding a heterologous nucleic acid (e.g., therapeutic nucleic acid). In some cases, the target in vivo environment is the liver. In some embodiments, the rAAV particle encapsidating the heterologous nucleic acid comprises a rAAV capsid protein engineered with an increased specificity and, in some cases, transduction efficiency when measured in the target in vivo environment of the subject, even when administered to the subject systemically.

In some embodiments, methods comprise delivering a rAAV particle comprising an rAAV capsid protein with increased specificity and/or transduction efficiency of the heterologous nucleic acid for the liver in the subject, as compared to a reference AAV (e.g., AAV9). In some embodiments, rAAVs optimized for targeting the liver have amino acid sequences that comprise an amino acid sequence provided in SEQ ID NOS: 950-1031 and 15054-15146 (FIG. 35).

The rAAV capsid protein suitable for delivery of the heterologous nucleic acid to the liver can comprise an insertion of at least one amino acid in a parental AAV capsid protein. In some instances, the insertion comprises at least one, two, three, four, five, six, seven, eight, nine, ten, or eleven amino acids provided in an amino acid sequence provided in Table 4, or FIG. 35.

Disclosed herein are methods comprising delivering a rAAV particle encapsidating a heterologous nucleic acid to the target in vivo environment selected from the group consisting of the liver in a subject, the rAAV particle comprising an increased specificity and/or transduction efficiency of the heterologous nucleic acid for the target in vivo environment, wherein the rAAV particle has an rAAV capsid protein comprising an insertion of at least or about three, four, five, six, seven, eight, nine, ten, or eleven amino acids of an amino acid sequence provided in Table 4, or FIG. 35. In some embodiments, delivery is more specific than a delivery of the heterologous nucleic acid by a reference AAV, e.g., AAV9. In some embodiments, methods further comprise reducing or ablating delivery of the heterologous nucleic acid in an off-target in vivo environment, such as the liver, compared to a reference AAV. In some embodiments, delivery is characterized by an increase in efficiency of transduction (e.g., of the heterologous nucleic acid) in the target in vivo environment than a transduction efficiency in the target in vivo environment of the reference AAV. In some embodiments, the delivery is systemic (e.g., intravenous). In some embodiments, the subject is a mammal. In some cases, the mammal is a human.

C. Methods of Treatment

Disclosed herein are methods of treating a disease or condition, or a symptom of the disease or condition, in a subject, comprising administrating of therapeutically effective amount of one or more compositions (e.g., rAAV particle, AAV vector, pharmaceutical composition) disclosed herein to the subject. In some embodiments, the composition is a rAAV capsid protein described herein. In some embodiments, the composition is an isolated and purified rAAV capsid protein described herein. In some embodiments, the rAAV particle encapsidates an AAV vector comprising a transgene (e.g., therapeutic nucleic acid). In some embodiments, the composition is a rAAV capsid protein described herein conjugated with a therapeutic agent disclosed herein. In some embodiments, the composition is a pharmaceutical composition comprising the rAAV particle and a pharmaceutically acceptable carrier. In some embodiments, the one or more compositions are administered to the subject alone (e.g., standalone therapy). In some embodiments, the one or more compositions are administered in combination with an additional agent. In some embodiments, the composition is a first-line therapy for the disease or condition. In some embodiments, the composition is a second-line, third-line, or fourth-line therapy, for the disease or condition.

Provided herein are methods of treating a disease or a condition, or a symptom of the disease or condition, in a subject, comprising: (a) diagnosing a subject with a disease or a condition affecting a target in vivo environment; and (b) treating the disease or the condition by administering to the subject a therapeutically effective amount of a composition disclosed herein (e.g., rAAV particle, AAV vector, pharmaceutical composition), wherein the composition is engineered with an increased specificity for the target in vivo environment.

Disclosed herein are methods of treating a disease or a condition, or a symptom of the disease or the condition, afflicting a target in vivo environment in a subject comprising: (a) administering to the subject a composition (e.g., rAAV particle, AAV vector, pharmaceutical composition); and (b) expressing the therapeutic nucleic acid into a target in vivo environment in the subject with an increased specificity and/or transduction efficiency, as compared to a reference AAV. In some cases, the reference AAV is AAV9, or a variant thereof.

Methods of treating a disease or condition affecting the central nervous system (CNS) comprise administering a rAAV particle to a CNS in a subject, the rAAV particle comprising an rAAV capsid protein comprising an insertion of at least or about three, four, five, six, seven, eight, nine, ten, or eleven amino acids of an amino acid sequence TALKPFL, TTLKPFL, TLQIPFK, TMQKPFI, RYQGDSV, or TTLKPFS, or any amino acid sequence provided in Tables 2-3, or FIG. 33, at an amino acid position 588_589 in a parental AAV capsid protein. In some cases, the insertion is not TLAVPFK, KFPVALT, SVSKPFL, FTLTTPK, MNATKNV, NGGTSSS, TRTNPEA, or YTLSQGW. In some embodiments, the parental AAV capsid protein is AAV9 capsid protein (for e.g., provided in SEQ ID NO: 1. In some instances, the parental AAV capsid protein comprises an amino acid sequence that is at least 95%, 96%, 96.1, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.7%, 98.8%, 98.9%, 99.0%, 99.1%, 99.2%, 99.3%, 99.4%, 99.5%, 99.6%, 99.7%, 99.8%, 99.9%, or 100.0% identical to SEQ ID NO: 1. In some embodiments, delivery is more specific than a delivery of the heterologous nucleic acid by a reference AAV, e.g., AAV9. In some embodiments, delivery is systemic (e.g., intravenous). In some embodiments, the subject is a human or a non-human primate.

Methods of treating a disease or a condition afflicting a target in vivo environment comprising a liver comprise administering a rAAV particle to the target in vivo environment in a subject, the rAAV particle comprising an rAAV capsid protein comprising a substitution of at least or about three, four, five, six, seven, eight, nine, ten, or eleven, amino acids of an amino acid sequence provided in any one of SEQ ID NOS: 950-1031 and 15054-15146 (FIG. 35). In some embodiments, methods comprise delivering a rAAV particle comprising an rAAV capsid protein with increased specificity for the liver in the subject, as compared to a reference AAV (e.g., AAV9). In some embodiments, rAAVs optimized for targeting the liver have amino acid sequences comprising an amino acid sequence KAYSVQV, PSGSARS, and RTANALG at an amino acid position 588_589 in a parental AAV capsid protein. In some embodiments, the parental AAV capsid protein is AAV9 capsid protein (for e.g., provided in SEQ ID NO: 1). In some instances, the parental AAV capsid protein comprises an amino acid sequence that is at least 95%, 96%, 96.1, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.7%, 98.8%, 98.9%, 99.0%, 99.1%, 99.2%, 99.3%, 99.4%, 99.5%, 99.6%, 99.7%, 99.8%, 99.9%, or 100.0% identical to SEQ ID NO: 1. In some embodiments, delivery is more specific than a delivery of the heterologous nucleic acid by a reference AAV, e.g., AAV9. In some embodiments, the delivery is systemic (e.g., intravenous or intranasal). In some embodiments, the subject is a human or a non-human primate.

Also provided are methods of modulating a target gene expression product, the methods comprising administering to a subject in need thereof a composition (e.g., rAAV particle, AAV vector, pharmaceutical composition) disclosed herein. For example, methods provided herein comprise administering to a subject a rAAV with a rAAV capsid protein encapsidating a viral vector comprising a heterologous nucleic acid that modulates the expression or the activity of the target gene expression product. In some embodiments, the disease or the condition is characterized by an increased or enhanced expression or activity of a gene or gene expression product thereof, as compared to a normal individual. In some cases, administering the therapeutically effective amount of the composition restores the expression or the activity of the gene or gene expression product thereof to a level that is typical in a normal individual. The term "normal individual" refers to an individual that is not afflicted with the disease or the condition characterized by the variation in expression or activity of the gene or gene expression product thereof.

Non-limiting examples of genes involved in central nervous system (CNS) diseases or disorders include Sarcoglycan Alpha (SGCA), glutamic acid decarboxylase 65 (GAD65), glutamic acid decarboxylase 67 (GAD67), CLN2 gene, Nerve Growth Factor (NGF), glial cell derived neurotrophic factor (GDNF), Neurturin, Survival Of Motor Neuron 1, Telomeric (SMN1), β-Glucocerebrosidase (GCase), Frataxin (FXN), Huntingtin (HTN), methyl-CpG binding protein 2 (MECP2), peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and NPS3. In some embodiments, the peroxisomal biogenesis factor (PEX) is selected from the group consisting of PEX1, PEX2, PEX3, PEX4, PEX5, PEX6, PEX7, PEX10, PEX11(3, PEX12, PEX13, PEX14, PEX16, PEX19, and PEX26. Non-limiting examples of genes implicated in disease or disorder of a particular organ (e.g., lung, heart, liver, muscle, eye) include Cystic Fibrosis Transmembrane Conductance Regulator (CFTR), Factor X (FIX), RPE65, Retinoid Isomerohydrolase (RPE65), Sarcoglycan Alpha (SGCA), and sarco/endoplasmic reticulum Ca2+-ATPase (SERCA2a). In some instances, the expression of a gene or expression or activity of a gene expression product is inhibited by the administration of the composition to the subject. In some instances, the expression of a gene or the expression or the activity of a gene expression product is enhanced by the administration of the composition to the subject.

In some cases, the composition is administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic effect.

In some cases, the viral genome (vg) concentration of the composition that is administered is between $1.0 \times 10^{11}$ vg per kilogram (kg) and $1.0 \times 10^{16}$ vg/kg. In some cases, the concentration of infectious particles of at least or about $10^7$, $10^8$, $10^9$, $10^{10}$, $10^{11}$, $10^{12}$, $10^{13}$, $10^{14}$, $10^{15}$, $10^{16}$, or $10^{17}$. In some cases, the concentration of infectious particles is $2 \times 10^7$, $2 \times 10^8$, $2 \times 10^9$, $2 \times 10^{10}$, $2 \times 10^{11}$, $2 \times 10^{12}$, $2 \times 10^{13}$, $2 \times 10^{14}$, $2 \times 10^{15}$, $2 \times 10^{16}$, or $2 \times 10^{17}$. In some cases, the concentration of the infectious particles $3 \times 10^7$, $3 \times 10^8$, $3 \times 10^9$, $3 \times 10^{10}$, $3 \times 10^{11}$, $3 \times 10^{12}$, $3 \times 10^{13}$, $3 \times 10^{14}$, $3 \times 10^{15}$, $3 \times 10^{16}$, or $3 \times 10^{17}$. In some cases, the concentration of the infectious particles $4 \times 10^7$, $4 \times 10^8$, $4 \times 10^9$, $4 \times 10^{10}$, $4 \times 10^{11}$, $4 \times 10^{12}$, $4 \times 10^{13}$, $4 \times 10^{14}$, $4 \times 10^{15}$, $4 \times 10^{16}$, or $4 \times 10^{17}$. In some cases, the concentration of the infectious particles $5 \times 10^7$, $5 \times 10^8$, $5 \times 10^9$, $5 \times 10^{10}$, $5 \times 10^{11}$, $5 \times 10^{12}$, $5 \times 10^{13}$, $5 \times 10^{14}$, $5 \times 10^{15}$, $5 \times 10^{16}$, or $5 \times 10^{17}$. In some cases, the concentration of the infectious particles $6 \times 10^7$, $6 \times 10^8$, $6 \times 10^9$, $6 \times 10^{10}$, $6 \times 10^{11}$, $6 \times 10^{12}$, $6 \times 10^{13}$, $6 \times 10^{14}$, $6 \times 10^{15}$, $6 \times 10^{16}$, or $6 \times 10^{17}$. In some cases, the concentration of the infectious particles $7 \times 10^7$, $7 \times 10^8$, $7 \times 10^9$, $7 \times 10^{10}$, $7 \times 10^{11}$, $7 \times 10^{12}$, $7 \times 10^{13}$, $7 \times 10^{14}$, $7 \times 10^{15}$, $7 \times 10^{16}$, or $7 \times 10^{17}$. In some cases, the concentration of the infectious particles $8 \times 10^7$, $8 \times 10^8$, $8 \times 10^9$, $8 \times 10^{10}$, $8 \times 10^{11}$, $8 \times 10^{12}$, $8 \times 10^{13}$, $8 \times 10^{14}$, $8 \times 10^{15}$, $8 \times 10^{16}$, or $8 \times 10^{17}$. In some cases, the concentration of the infectious particles $9 \times 10^7$, $9 \times 10^8$, $9 \times 10^9$, $9 \times 10^{10}$, $9 \times 10^{11}$, $9 \times 10^{12}$, $9 \times 10^{13}$, $9 \times 10^{14}$, $9 \times 10^{15}$, $9 \times 10^{16}$, or $9 \times 10^{17}$.

In some embodiments, the administering of step is performed once. Alternatively, the administering of step is repeated at least twice. The administering of step may be performed once daily. In some cases, the administering of step comprises intravenous administration. In some cases, the administering comprises pulmonary administration. In some cases, the administering comprises intranasal administration (such as a spray). In some cases, the administering of step comprises injecting the composition into a target in vivo environment. In some cases, the administering of step does not comprise injecting the composition into the target in vivo environment.

Subject

Disclosed herein methods of delivering at least one of an AAV particle and viral vector to a subject, for example—to treat or prevent a disease or condition in a subject. The subject, in some cases, is a mammal. Non-limiting examples of a mammal include a mouse, rat, guinea pig, rabbit, chimpanzee, or farm animal. In some instances, the mammal is a non-human primate. In some instances, the subject is human. The subject of the present disclosure may not be diagnosed with a disease or condition. Alternatively, the subject may be a patient that is diagnosed with a disease or disorder, or suspected of having the disease or the disorder.

Disease or Condition

Disclosed herein are methods of treating a disease or condition in a subject by administering a composition comprising a rAAV such as those disclosed herein. At least one advantage of the rAAVs disclosed herein, is that the rAAV may be used to treat virtually any disease or condition that would benefit from a transgene therapy, including but not limited to spinal muscular atrophy (SMA), amyotrophic lateral sclerosis (ALS), Parkinson's disease, Pompe disease, Huntington's disease, Alzheimer's disease, Battens disease, lysosomal storage disorders, glioblastoma multiforme, Rett syndrome, Leber's congenital amaurosis, Late infantile neuronal ceroid lipofuscinosis (LINCL), chronic pain, stroke, spinal cord injury, traumatic brain injury and lysosomal storage disorders.

The disease or the condition may, in some embodiments, be characterized by a reduced or ablated expression or activity of a gene or gene expression product thereof, as compared to a normal individual. In some embodiments, be characterized by an increased or enhanced expression or activity of a gene or gene expression product thereof, as compared to a normal individual.

In some cases, the disease or condition is localized to a particular in vivo environment in the subject, e.g., the brain or the liver. The compositions of the present disclosure are particularly useful for the treatment of the diseases or conditions described herein because they specifically target the in vivo environment and deliver a therapeutic nucleic acid engineered to modulate the activity or the expression of a target gene expression product involved with the pathogenesis or pathology of the disease or condition.

In some instances, the disease or condition comprises a disease or condition of the central nervous system (CNS). Non-limiting examples of disease of the CNS include Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Subcortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavemous Malformation, Cerebral Gigantism, Cerebral Hypoxia, Cerebral Palsy, Cerebro-Oculo-Facio-Skeletal Syndrome (COFS), Charcot-Marie-Tooth Disease, Charcot-Marie-Tooth syndrome, classical rhizomelic chondrodysplasia punctata (RCDP), Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, Deafness, De Morsier's Syndrome, Dejerine-Klumpke Palsy, Dementia, Dementia-Multi-Infarct, Dementia—Semantic, Dementia—Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Duchenne muscular dystrophy, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, glioblastoma, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Kliiver-Bucy Syndrome, Korsakoff s Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia-Congenital, Myasthenia Gravis, Myelinoclastic Diffuse Sclerosis, Myoclonic Encephalopathy of Infants, Myoclonus, Myopathy, Myopathy-Congenital, Myopathy-Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy-Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, and X-Linked Spinal and Bulbar Muscular Atrophy.

In some instances, the disease or condition comprises a liver disease or disorder, or is associated with a liver disease or disorder. Non-limiting examples include disorders of bile acid synthesis (e.g., Wilson disease, Progressive familial intrahepatic cholestasis type 3), disorders of carbohydrate metabolism (e.g., Hereditary fructose intolerance, Glycogen storage disease type IV), disorders of amino acids metabolism (e.g., tyrosinemia type I), Urea cycle disorders (e.g., argininosuccinate lyase deficiency, citrin deficiency (CTLN2, NICCD)), disorders of lipid metabolism (e.g., cholesteryl ester storage disease), and others including but not limited to Alpha-1 antitrypsin deficiency, cystic fibrosis, hereditary hemochromatosis, Alström syndrome, and congenital hepatic fibrosis.

In some instances, the disease or condition is a disease or condition is of the liver Non-limiting examples of liver diseases or disorders include Alagille Syndrome, Alcohol-Related Liver Disease, Alpha-1 Antitrypsin Deficiency, Autoimmune Hepatitis, Benign Liver Tumors, Biliary Atresia, Cirrhosis, Crigler-Najjar Syndrome, Galactosemia, Gilbert Syndrome, Hemochromatosis, Hepatic Encephalopathy, Hepatitis A, Hepatitis B, Hepatitis C, Hepatorenal Syndrome, Intrahepatic Cholestasis of Pregnancy (ICP), Lysosomal Acid Lipase Deficiency (LAL-D), Liver Cysts, Liver Cancer, Newborn Jaundice, Non-Alcoholic Fatty Liver Disease, Primary Biliary Cholangitis (PBC), Primary Sclerosing Cholangitis (PSC), Reye Syndrome, Type I Glycogen Storage Disease, and Wilson Disease.

Provided here, are methods of treating a disease or a condition associated with an aberrant expression or activity of a target gene or gene expression product thereof, the method comprising modulating the expression or the activity of a target gene or gene expression product in a subject by administering a rAAV encapsidating a heterologous nucleic acid of the present disclosure. In some instances, administration is systemic administration. In some instances, the expression or the activity of the target gene or gene expression product is decreased, relative to that in a normal (non-diseased) individual; and administering the rAAV to the subject is sufficient to increase the expression of the activity of the target gene or gene expression product to that of a normal individual. In some instances, the expression or the activity of the gene or gene expression product is increased, relative to that in a normal individual; and administering the rAAV to the subject is sufficient to decrease the expression or the activity of the target gene or gene expression product. In a non-limiting example, a subject diagnosed with Alzheimer's disease, which is caused, in some cases, by a gain-of-function of a Presenilin 1 and/or Presenilin 2 (encoded by the gene PSEN1 and PSEN2, respectively) is administered a rAAV disclosed herein encapsidating a therapeutic nucleic acid that is a silencing RNA (siRNA), or other RNAi with a loss-of-function effect on PSEN1 mRNA.

Also provided are methods of treating or preventing a disease or condition disclosed herein in a subject comprising administering to the subject a therapeutically effective amount of an AAV vector comprising a nucleic acid sequence encoding a therapeutic gene expression product described herein. The AAV vector may be encapsidated in the modified capsid protein or AAV viral particle described herein. In some instances, the therapeutic gene expression product is effective to modulate the activity or expression of a target gene or gene expression product.

Formulations, Dosages, and Routes of Administration

In general, methods disclosed herein comprise administering a therapeutic rAAV composition by systemic administration. In some instances, methods comprise administering a therapeutic rAAV composition by oral administration. In some instances, methods comprise administering a therapeutic rAAV composition by intraperitoneal injection. In some instances, methods comprise administering a therapeutic rAAV composition in the form of an anal suppository. In some instances, methods comprise administering a therapeutic rAAV composition by intravenous ("i.v.") administration. It is conceivable that one may also administer therapeutic rAAV compositions disclosed herein by other routes, such as subcutaneous injection, intramuscular injection, intradermal injection, transdermal injection percutaneous administration, intranasal administration, intralymphatic injection, rectal administration intragastric administration, intraocular administration, intracerebro-ventricularl administration, intrathecally, or any other suitable parenteral administration. In some instances, methods comprise administering a therapeutic rAAV composition by topical administration, example, by brushing or otherwise contacting the rAAV composition to a region of the subject (e.g., eardrum, bladder). In some embodiments, routes for local delivery closer to site of injury or inflammation are preferred over systemic routes. Routes, dosage, time points, and duration of administrating therapeutics may be adjusted. In some embodiments, administration of therapeutics is prior to, or after, onset of either, or both, acute and chronic symptoms of the disease or condition.

An effective dose and dosage of pharmaceutical compositions to prevent or treat the disease or condition disclosed herein is defined by an observed beneficial response related to the disease or condition, or symptom of the disease or condition. Beneficial response comprises preventing, alleviating, arresting, or curing the disease or condition, or symptom of the disease or condition. In some embodiments, the beneficial response may be measured by detecting a measurable improvement in the presence, level, or activity, of biomarkers, transcriptomic risk profile, or intestinal microbiome in the subject. An "improvement," as used herein refers to shift in the presence, level, or activity towards a presence, level, or activity, observed in normal individuals (e.g. individuals who do not suffer from the disease or condition). In instances wherein the therapeutic rAAV composition is not therapeutically effective or is not providing a sufficient alleviation of the disease or condition, or symptom of the disease or condition, then the dosage amount and/or route of administration may be changed, or an additional agent may be administered to the subject, along with the therapeutic rAAV composition. In some embodiments, as a patient is started on a regimen of a therapeutic rAAV composition, the patient is also weaned off (e.g., step-wise decrease in dose) a second treatment regimen.

In some embodiments, pharmaceutical compositions in accordance with the present disclosure may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, or prophylactic, effect. It will be understood that the above dosing concentrations may be converted to vg or viral genomes per kg or into total viral genomes administered by one of skill in the art.

In some cases, a dose of the pharmaceutical composition may comprise a concentration of infectious particles of at least or about $10^7$, $10^8$, $10^9$, $10^{10}$, $10^{11}$, $10^{12}$, $10^{13}$, $10^{14}$, $10^{15}$, $10^{16}$, or $10^{17}$. In some cases, the concentration of infectious particles is $2\times10^7$, $2\times10^8$, $2\times10^9$, $2\times10^{10}$, $2\times10^{11}$, $2\times10^{12}$, $2\times10^{13}$, $2\times10^{14}$, $2\times10^{15}$, $2\times10^{16}$, or $2\times10^{17}$. In some cases, the concentration of the infectious particles is $3\times10^7$, $3\times10^8$, $3\times10^9$, $3\times10^{10}$, $3\times10^{11}$, $3\times10^{12}$, $3\times10^{13}$, $3\times10^{14}$, $3\times10^{15}$, $3\times10^{16}$, or $3\times10^{17}$. In some cases, the concentration of the infectious particles is $4\times10^7$, $4\times10^8$, $4\times10^9$, $4\times10^{10}$, $4\times10^{11}$, $4\times10^{12}$, $4\times10^{13}$, $4\times10^{14}$, $4\times10^{15}$, $4\times10^{16}$, or $4\times10^{17}$. In some cases, the concentration of the infectious particles is $5\times10^7$, $5\times10^8$, $5\times10^9$, $5\times10^{10}$, $5\times10^{11}$, $5\times10^{12}$, $5\times10^{13}$, $5\times10^{14}$, $5\times10^{15}$, $5\times10^{16}$, or $5\times10^{17}$. In some cases, the concentration of the infectious particles is $6\times10^7$, $6\times10^8$, $6\times10^9$, $6\times10^{10}$, $6\times10^{11}$, $6\times10^{12}$, $6\times10^{13}$, $6\times10^{14}$, $6\times10^{15}$, $6\times10^{16}$, or $6\times10^{17}$. In some cases, the concentration of the infectious particles is $7\times10^7$, $7\times10^8$, $7\times10^9$, $7\times10^{10}$, $7\times10^{11}$, $7\times10^{12}$, $7\times10^{13}$, $7\times10^{14}$, $7\times10^{15}$, $7\times10^{16}$, or $7\times10^{17}$. In some cases, the concentration of the infectious particles is $8\times10^7$, $8\times10^8$, $8\times10^9$, $8\times10^{10}$, $8\times10^{11}$, $8\times10^{12}$, $8\times10^{13}$, $8\times10^{14}$, $8\times10^{15}$, $8\times10^{16}$, or $8\times10^{17}$. In some cases, the concentration of the infectious particles is $9\times10^7$, $9\times10^8$, $9\times10^9$, $9\times10^{10}$, $9\times10^{11}$, $9\times10^{12}$, $9\times10^{13}$, $9\times10^{14}$, $9\times10^{15}$, $9\times10^{16}$, or $9\times10^{17}$.

Disclosed herein, in some embodiments are formulations of pharmaceutically-acceptable excipients and carrier solutions suitable for delivery of the rAAV compositions described herein, as well as suitable dosing and treatment regimens for using the particular compositions described herein in a variety of treatment regimens. In some embodiments, the amount of therapeutic gene expression product in each therapeutically-useful composition may be prepared is such a way that a suitable dosage will be obtained in any given unit dose of the compound. Factors such as solubility, bioavailability, biological half life, route of administration, product shelf life, as well as other pharmacological considerations will be contemplated by one skilled in the art of preparing such pharmaceutical formulations, and as such, a variety of dosages and treatment regimens may be desirable. In some instances, the rAAV compositions are suitably formulated pharmaceutical compositions disclosed herein, to be delivered either intraocularly, intravitreally, parenterally, subcutaneously, intravenously, intracerebro-ventricularly, intramuscularly, intrathecally, orally, intraperitoneally, by oral or nasal inhalation, or by direct injection to one or more cells, tissues, or organs by direct injection.

In some embodiments, the pharmaceutical forms of the AAV-based viral compositions suitable for injectable use include sterile aqueous solutions or dispersions and sterile powders for the extemporaneous preparation of sterile injectable solutions or dispersions. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In some cases, for administration of an injectable aqueous solution, for example, the solution may be suitably buffered, if necessary, and the liquid diluent first rendered isotonic with sufficient saline or glucose. These particular aqueous solutions are especially suitable for intravenous, intramuscular, subcutaneous and intraperitoneal administration. Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by FDA Office of Biologics standards.

Disclosed herein are sterile injectable solutions comprising the rAAV compositions disclosed herein, which are prepared by incorporating the rAAV compositions disclosed herein in the required amount in the appropriate solvent with several of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof. Injectable solutions may be advantageous for systemic administration, for example by intravenous administration.

Also provided herein are formulations in a neutral or salt form. Pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

Pulmonary administration may be advantageously achieved via the buccal administration. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form. Low boiling propellants generally include liquid propellants having a boiling point of below 65° F. at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface-active agent, and/or a preservative such as methylhydroxybenzoate. Droplets provided by this route of administration may have an average diameter in the range from about 0.1 nm to about 200 nm. Formulations described herein useful for pulmonary delivery may also be useful for intranasal delivery. In some embodiments, formulations for intranasal administration comprise a coarse powder comprising the active ingredient and having an average particle size from about 0.2 μm to 500 μm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, comprise 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

Suitable dose and dosage administrated to a subject is determined by factors including, but not limited to, the particular therapeutic rAAV composition, disease condition and its severity, the identity (e.g., weight, sex, age) of the subject in need of treatment, and can be determined according to the particular circumstances surrounding the case, including, e.g., the specific agent being administered, the route of administration, the condition being treated, and the subject or host being treated.

The amount of AAV compositions and time of administration of such compositions will be within the purview of the skilled artisan having benefit of the present teachings. It is likely, however, that the administration of therapeutically-effective amounts of the disclosed compositions may be achieved by a single administration, example, a single injection of sufficient numbers of infectious particles to provide therapeutic benefit to the patient undergoing such treatment. This is made possible, at least in part, by the fact that certain target cells (e.g., neurons) do not divide, obviating the need for multiple or chronic dosing.

Alternatively, in some circumstances, it may be desirable to provide multiple, or successive administrations of the AAV vector compositions, either over a relatively short, or a relatively prolonged period of time, as may be determined by the medical practitioner overseeing the administration of such compositions. For example, the number of infectious particles administered to a mammal may be on the order of about $10^7$, $10^8$, $10^9$, $10^{10}$, $10^{11}$, $10^{12}$, $10^{13}$, or even higher, infectious particles/ml given either as a single dose, or divided into two or more administrations as may be required to achieve therapy of the particular disease or disorder being treated. In fact, in certain embodiments, it may be desirable to administer two or more different AAV vector compositions, either alone, or in combination with one or more other therapeutic drugs to achieve the desired effects of a particular therapy regimen. In various embodiments, the daily and unit dosages are altered depending on a number of variables including, but not limited to, the activity of the therapeutic rAAV composition used, the disease or condition to be treated, the mode of administration, the requirements of the individual subject, the severity of the disease or condition being treated, and the judgment of the practitioner.

In some embodiments, the administration of the therapeutic rAAV composition is hourly, once every 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours 22 hours, 23 hours, 1 day, 2 days, 3 days, 4 days, 5 days, 6 days, 7 days, 8 days, 9 days, 10 days, 11 days, 12 days, 13 days, 14 days, 15 days, 1 month, 2 months, 3 months, 4 months, 5 months, 6 months, 7 months, 8 months, 9 months, 10 months, 11 months, 1 year, 2 years, 3 years, 4 years, or 5 years, or 10 years. The effective dosage ranges may be adjusted based on subject's response to the treatment. Some routes of administration will require higher concentrations of effective amount of therapeutics than other routes.

Although not anticipated given the advantages of the present disclosure, in certain embodiments wherein the patient's condition does not improve, upon the doctor's discretion the administration of therapeutic rAAV composition is administered chronically, that is, for an extended period of time, including throughout the duration of the patient's life in order to ameliorate or otherwise control or limit the symptoms of the patient's disease or condition. In certain embodiments wherein a patient's status does improve, the dose of therapeutic rAAV composition being administered may be temporarily reduced or temporarily suspended for a certain length of time (i.e., a "drug holiday"). In specific embodiments, the length of the drug holiday is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug holiday is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. In certain embodiments, the dose of drug being administered may be temporarily reduced or temporarily suspended for a certain length of time (i.e., a "drug diversion"). In specific embodiments, the length of the drug diversion is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug diversion is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. After a suitable length of time, the normal dosing schedule is optionally reinstated.

In some embodiments, once improvement of the patient's conditions has occurred, a maintenance dose is administered if necessary. Subsequently, in specific embodiments, the dosage or the frequency of administration, or both, is reduced, as a function of the symptoms, to a level at which the improved disease, disorder or condition is retained. In certain embodiments, however, the patient requires intermittent treatment on a long-term basis upon any recurrence of symptoms.

Toxicity and therapeutic efficacy of such therapeutic regimens are determined by standard pharmaceutical procedures in cell cultures or experimental animals, including, but not limited to, the determination of the LD50 and the ED50. The dose ratio between the toxic and therapeutic effects is the therapeutic index and it is expressed as the ratio between LD50 and ED50. In certain embodiments, the data obtained from cell culture assays and animal studies are used in formulating the therapeutically effective daily dosage range and/or the therapeutically effective unit dosage amount for use in mammals, including humans. In some embodiments, the dosage amount of the therapeutic rAAV composition described herein lies within a range of circulating concentrations that include the ED50 with minimal toxicity. In certain embodiments, the daily dosage range and/or the unit dosage amount varies within this range depending upon the dosage form employed and the route of administration utilized.

Additional Therapeutic

A therapeutic nucleic acid may be used alone or in combination with an additional therapeutic agent (together, "therapeutic agents"). In some cases, an "additional therapeutic agent" as used herein is administered alone. The therapeutic agent may be administered together or sequentially in a combination therapy. The combination therapy may be administered within the same day, or may be administered one or more days, weeks, months, or years apart. In some cases, a therapeutic nucleic acid provided herein is administered if the subject is determined to be non-responsive to a first line of therapy.

The additional therapeutic agent can comprise a small molecule. The additional therapeutic agent can comprise an antibody, or antigen-binding fragment. The additional therapeutic agent can comprise a cell-based therapy. Exemplary cell-based therapies include without limitation immune effector cell therapy, chimeric antigen receptor T-cell (CAR-T) therapy, natural killer cell therapy and chimeric antigen receptor natural killer (NK) cell therapy. Either NK cells, or CAR-NK cells, or a combination of both NK cells and CAR-NK cells can be used in combination with the methods disclosed herein. In some embodiments, the NK cells and CAR-NK cells are derived from human induced pluripotent stem cells (iPSC), umbilical cord blood, or a cell line. The NK cells and CAR-NK cells can comprise a cytokine receptor and a suicide gene. The cell-based therapy can comprises a stem cell therapy. The stem cell therapy may be embryonic or somatic stem cells. The stem cells may be isolated from a donor (allogeneic) or isolated from the subject (autologous). The stem cells may be expanded adipose-derived stem cells (eASCs), hematopoietic stem cells (HSCs), mesenchymal stem (stromal) cells (MSCs), or induced pluripotent stem cells (iPSCs) derived from the cells of the subject.

III. Kits

Disclosed herein are kits comprising compositions disclosed herein. Also disclosed herein are kits for the treatment or prevention of a disease or conditions of the central nervous system (CNS), or target organ or environment (e.g., liver). In some instances, the disease or condition is cancer, a pathogen infection, pulmonary disease or condition, neurological disease, muscular disease, or an immune disorder, such as those described herein. In one embodiment, a kit can include a therapeutic or prophylactic composition containing an effective amount of a composition of a rAAV particle encapsidating a recombinant AAV vector encoding a therapeutic nucleic acid (e.g., therapeutic nucleic acid) and a recombinant AAV (rAAV) capsid protein of the present disclosure. In another embodiment, a kit can include a therapeutic or prophylactic composition containing an effective amount of cells modified by the rAAV described herein ("modified cell"), in unit dosage form that express therapeutic nucleic acid. In some embodiments, a kit comprises a sterile container which can contain a therapeutic composition; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments.

In some cases, rAAV are provided together with instructions for administering the rAAV to a subject having or at risk of developing the disease or condition (e.g., disease of the CNS, PNS, liver, and the like). Instructions can generally include information about the use of the composition for the treatment or prevention of the disease or condition.

In some cases, a kit can include allogenic cells. In some cases, a kit can include cells that can comprise a genomic modification. In some cases, a kit can comprise "off-the-shelf" cells. In some cases, a kit can include cells that can be expanded for clinical use. In some cases, a kit can contain contents for a research purpose.

In some cases, the instructions include at least one of the following: description of the therapeutic rAAV composition; dosage schedule and administration for treatment or prevention of the disease or condition disclosed herein; precautions; warnings; indications; counter-indications; overdosage information; adverse reactions; animal pharmacology; clinical studies; and/or references. The instructions can be printed directly on the container (when present), or as a label applied to the container, or as a separate sheet, pamphlet, card, or folder supplied in or with the container. In some cases, instructions provide procedures for administering the rAAV to the subject alone. In some cases, instructions provide procedures for administering the rAAV to the subject at least about 1 hour (hr), 2 hr, 3 hr, 4 hr, 5 hr, 6 hr, 7 hr, 8 hr, 9 hr, 10 hr, 11 hr, 12 hr, 13 hr, 14 hr, 15 hr, 16 hr, 17 hr, 18 hr, 19 hr, 20 hr, 21 hr, 22 hr, 23 hr, 24 hr, 25 hr, 26 hr, 27 hr, 28 hr, 29 hr, 30 hr, or up to 2 days, 3 days, 4 days, 5 days, 6 days, or 7 days after or before administering an additional therapeutic agent disclosed herein. In some instances, the instructions provide that the rAAV is formulated for intravenous injection.

IV. Definitions

The terminology used herein is for the purpose of describing particular cases only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviation, per the practice in the given value. Where particular values are described in the application and claims, unless otherwise stated the term "about" should be assumed to mean an acceptable error range for the particular value.

As used herein "consisting essentially of" when used to define compositions and methods, shall mean excluding other elements of any essential significance to the combination for the stated purpose. Thus, a composition consisting essentially of the elements as defined herein would not exclude other materials or steps that do not materially affect the basic and novel characteristic(s) of the claimed disclosure, such as compositions for treating skin disorders like acne, eczema, psoriasis, and rosacea.

The terms "homologous," "homology," or "percent homology" are used herein to generally mean an amino acid sequence or a nucleic acid sequence having the same, or similar sequence to a reference sequence. Percent homology of sequences can be determined using the most recent version of BLAST, as of the filing date of this application.

The terms "increased," or "increase" are used herein to generally mean an increase by a statically significant amount. In some embodiments, the terms "increased," or "increase," mean an increase of at least 10% as compared to a reference level, for example an increase of at least about 10%, at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, standard, or control. Other examples of "increase" include an increase of at least 2-fold, at least 5-fold, at least 10-fold, at least 20-fold, at least 50-fold, at least 100-fold, at least 1000-fold or more as compared to a reference level.

The terms, "decreased" or "decrease" are used herein generally to mean a decrease by a statistically significant amount. In some embodiments, "decreased" or "decrease" means a reduction by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g., absent level or non-detectable level as compared to a reference level), or any decrease between 10-100% as compared to a reference level. In the context of a marker or symptom, by these terms is meant a statistically significant decrease in such level. The decrease can be, for example, at least 10%, at least 20%, at least 30%, at least 40% or more, and is preferably down to a level accepted as within the range of normal for an individual without a given disease.

The terms "subject" is any organism. In some instances, the organism is a mammal. Non-limiting examples of mammal include, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. In one aspect, the mammal is a human. The term "animal" as used herein comprises human beings and non-human animals. In one embodiment, a "non-human animal" is a mammal, for example a rodent such as rat or a mouse. In some instances, the subject is a patient, which as used herein, may refer to a subject diagnosed with a particular disease or disorder.

The term "gene," as used herein, refers to a segment of nucleic acid that encodes an individual protein or RNA (also referred to as a "coding sequence" or "coding region"), optionally together with associated regulatory region such as promoter, operator, terminator and the like, which may be located upstream or downstream of the coding sequence.

The term "adeno-associated virus," or "AAV" as used herein refers to the adeno-associated virus or derivatives thereof. Non-limited examples of AAV's include AAV type 1 (AAV1), AAV type 2 (AAV2), AAV type 3 (AAV3), AAV type 4 (AAV4), AAV type 5 (AAV5), AAV type 6 (AAV6), AAV type 7 (AAV7), AAV type 8 (AAV8), AAV type 9 (AAV9), AAV type 10 (AAV10), AAV type 11 (AAV11), AAV type 12 (AAV12), avian AAV, bovine AAV, canine AAV, equine AAV, primate AAV, non-primate AAV, and ovine AAV. In some instances, the AAV is described as a "Primate AAV," which refers to AAV that infect primates. Likewise an AAV may infect bovine animals (e.g., "bovine AAV", and the like). In some instances, the AAV is wildtype, or naturally occurring. In some instances, the AAV is recombinant.

The term "AAV capsid" as used herein refers to a capsid protein or peptide of an adeno-associated virus. In some instances, the AAV capsid protein is configured to encapsidate genetic information (e.g., a transgene, therapeutic nucleic acid, viral genome). In some instances, the AAV capsid of the instant disclosure is a modified AAV capsid, relative to a corresponding parental AAV capsid protein.

The term "tropism" as used herein refers to a quality or characteristic of the AAV capsid that may include specificity for, and/or an increase or a decrease in efficiency of, expressing the encapsidated genetic information into one in in vivo environment, relative to a second in vivo environment. An in vivo environment, in some instances, is a cell-type. An in vivo environment, in some instances, is an organ or organ system.

The term "AAV vector" as used herein refers to nucleic acid polymer encoding genetic information related to the virus. The AAV vector may be a recombinant AAV vector (rAAV), which refers to an AAV vector generated using recombinatorial genetics methods. In some instances, the rAAV vector comprises at least one heterologous polynucleotide (e.g. a polynucleotide other than a wild-type or naturally occurring AAV genome such as a transgene).

The term "AAV particle" as used herein refers to an AAV virus, virion, AAV capsid protein or component thereof. In some cases, the AAV particle is modified relative to a parental AAV particle.

The term "gene product" of "gene expression product" refers to an expression product of a polynucleotide sequence such as, for e.g., a polypeptide, peptide, protein or RNA, including interfering RNA (e.g., siRNA, miRNA, shRNA) and messenger RNA (mRNA).

The terms "operatively linked" or "operably linked" refers to a location of two or more elements being close together, and in some cases, next to one other (e.g., genetic elements such as a promoter, enhancer, termination signal sequence, polyadenylation sequence, and the like) that enables a functional relationship between the two or more elements. In one non-limiting example, a promoter that is operatively linked to a coding region enables the initiation of transcription of the coding sequence.

The term "heterologous" as used herein refers to a genetic element (e.g., coding region) or gene expression product (e.g., RNA, protein) that is derived from a genotypically distinct entity from that of the rest of the entity to which it is being compared.

The term "endogenous" as used herein refers to a genetic element (e.g., coding region) or gene expression product (e.g., RNA, protein) that is naturally occurring in or associated with an organism or a particular cell within the organism.

A "detectable moiety" as used herein refers to a moiety that can be covalently or noncovalently attached to a compound or biomolecule that can be detected for instance, using techniques known in the art. In embodiments, the detectable moiety is covalently attached. The detectable moiety may provide for imaging of the attached compound or biomolecule. The detectable moiety may indicate the contacting between two compounds. Exemplary detectable moieties are fluorophores, antibodies, reactive dies, radio-labeled moieties, magnetic contrast agents, and quantum dots. Exemplary fluorophores include fluorescein, rhodamine, GFP, coumarin, FITC, Alexa fluor, Cy3, Cy5, BODIPY, and cyanine dyes. Exemplary radionuclides include Fluorine-18, Gallium-68, and Copper-64. Exemplary magnetic contrast agents include gadolinium, iron oxide and iron platinum, and manganese.

The terms "treat," "treating," and "treatment" as used herein refers to alleviating or abrogating a disorder, disease, or condition; or one or more of the symptoms associated with the disorder, disease, or condition; or alleviating or eradicating a cause of the disorder, disease, or condition itself. Desirable effects of treatment can include, but are not limited to, preventing occurrence or recurrence of disease, alleviation of symptoms, diminishing any direct or indirect pathological consequences of the disease, preventing metastasis, decreasing the rate of disease progression, amelioration or palliation of the disease state and remission or improved prognosis.

The term "therapeutically effective amount" refers to the amount of a compound or therapy that, when administered, is sufficient to prevent development of, or alleviate to some extent, one or more of the symptoms of a disorder, disease, or condition of the disease; or the amount of a compound that is sufficient to elicit biological or medical response of a cell, tissue, system, animal, or human that is being sought by a researcher, veterinarian, medical doctor, or clinician.

The term "pharmaceutically acceptable carrier," "pharmaceutically acceptable excipient," "physiologically acceptable carrier," or "physiologically acceptable excipient" refers to a pharmaceutically acceptable material, composition, or vehicle, such as a liquid or solid filler, diluent, excipient, solvent, or encapsulating material. A component can be "pharmaceutically acceptable" in the sense of being compatible with the other ingredients of a pharmaceutical formulation. It can also be suitable for use in contact with the tissue or organ of humans and animals without excessive toxicity, irritation, allergic response, immunogenicity, or other problems or complications, commensurate with a reasonable benefit/risk ratio. See, Remington: The Science and Practice of Pharmacy, 21st Edition; Lippincott Williams & Wilkins: Philadelphia, PA, 2005; Handbook of Pharmaceutical Excipients, 5th Edition; Rowe et al., Eds., The Pharmaceutical Press and the American Pharmaceutical Association: 2005; and Handbook of Pharmaceutical Additives, 3rd Edition; Ash and Ash Eds., Gower Publishing Company: 2007; Pharmaceutical Preformulation and Formulation, Gibson Ed., CRC Press LLC: Boca Raton, FL, 2004).

The term "pharmaceutical composition" refers to a mixture of a compound disclosed herein with other chemical components, such as diluents or carriers. The pharmaceutical composition can facilitate administration of the compound to an organism. Multiple techniques of administering a compound exist in the art including, but not limited to, oral, injection, aerosol, parenteral, and topical administration.

Non-limiting examples of "sample" include any material from which nucleic acids and/or proteins can be obtained. As non-limiting examples, this includes whole blood, peripheral blood, plasma, serum, saliva, mucus, urine, semen, lymph, fecal extract, cheek swab, cells or other bodily fluid or tissue, including but not limited to tissue obtained through surgical biopsy or surgical resection. In various embodiments, the sample comprises tissue from the large and/or small intestine. In various embodiments, the large intestine sample comprises the cecum, colon (the ascending colon, the transverse colon, the descending colon, and the sigmoid colon), rectum and/or the anal canal. In some embodiments, the small intestine sample comprises the duodenum, jejunum, and/or the ileum. Alternatively, a sample can be obtained through primary patient derived cell lines, or archived patient samples in the form of preserved samples, or fresh frozen samples.

The term "in vivo" is used to describe an event that takes place in a subject's body.

The term "ex vivo" is used to describe an event that takes place outside of a subject's body. An ex vivo assay is not performed on a subject. Rather, it is performed upon a sample separate from a subject. An example of an ex vivo assay performed on a sample is an "in vitro" assay.

The term "in vitro" is used to describe an event that takes places contained in a container for holding laboratory reagent such that it is separated from the biological source from which the material is obtained. In vitro assays can encompass cell-based assays in which living or dead cells are employed. In vitro assays can also encompass a cell-free assay in which no intact cells are employed.

The section headings used herein are for organizational purposes only and are not to be construed as limiting the subject matter described.

V. Examples

Example 1. Method of Producing an rAAV

A recombinant AAV (rAAV) is produced. Three plasmid vectors are triple-transfected into an immortalized HEK293 using a standard transfection protocol (e.g., with PEI). The first vector contains a transgene cassette flanked by inverted terminal repeat (ITR) sequences from a parental AAV virus.

The transgene cassette has a promoter sequence and that drives transcription of a heterologous nucleic acid in the nucleus of the target cell. The second vector contains nucleic acids encoding the AAV Rep gene, as well as a modified Cap gene e.g., AAV2/9 REP-AAP-ΔCap). Modified Cap gene comprises any one of the DNA sequences provided in FIGS. 33-35, which are the DNA sequences encoding the modified AAV capsid proteins of the present disclosure. The third vector contains nucleic acids encoding helper virus proteins needed for viral assembly, and packaging of the heterologous nucleic acid into the modified capsid structure.

Viral particles are harvested from the media after 72 h post transfection and from the cells and media at 120 h post transfection. Virus present in the media is concentrated by precipitation with 8% poly(ethylene glycol) and 500 mM sodium chloride and the precipitated virus is added to the lysates prepared from the collected cells. The viruses are purified over iodixanol (Optiprep, Sigma) step gradients (15%, 25%, 40% and 60%). Viruses are concentrated and formulated in PBS. Virus titers are determined by measuring the number of DNaseI-resistant vector genome copies (VGs) using qPCR and the linearized genome plasmid as a control.

Example 2. Methods of Identifying Variant AAV Capsid Proteins

Plasmid

Library generation. The rAAV-ΔCap-in-cis-Lox2 plasmid (FIG. 36) is a modification of the rAAV-ΔCap-in-cis-Lox plasmid. For 7-mer-i library fragment generation, the pCRII-9Cap-XE plasmid was used as a template. The AAV2/9 REP-AAP-ΔCap plasmid (FIG. 36) was modified from the AAV2/9 REP-AAP plasmid.

The rAAV-ΔCap-in-cis-Lox2 plasmid consists of three major elements that are flanked by AAV2 ITRs. (i) UBC ubiquitous promoter driving the expression of fluorescent protein, mNeongreen, followed by a synthetic polyadenylation sequence. The mCherry expression cassette of the previous version of the plasmid was replaced by mNeon-Green cassette. (ii) A portion of AAV2 rep gene that has the splicing sequences and AAV5 p41 promoter (1680-1974 residues of GenBank AF085716.1) followed by AAV9 cap gene. The prior version of this plasmid, rAAV-ΔCap-in-cis-Lox, has a short 12 bp sequence between restriction sites XbaI and AgeI at AA 450 and 592 of the AAV9 Cap gene. This was replaced by a 723 bp sequence of mRuby2 gene in-frame (acts as filler DNA) in the newer version of the plasmid. (iii) SV40 polyadenylation sequence that is flanked by lox71 and lox66 sites. The minor changes were introduced to the prior version of the plasmid to facilitate ease of cloning and to visualize mammalian cell transfection. The Lox sites in these rAAV plasmids show modest levels of Cre-independent flipping. This was minimized during PCR-based capsid recovery by lowering the number of amplification cycles to a point where we cannot recover any rAAV capsids from the control DNA extracted from wild-type mice (i.e., lacking Cre expression) that were injected with the library. The pCRII-9Cap-XE plasmid contains the AAV9 capsid gene sequence from AAs 450-592 and is flanked by XbaI and AgeI restriction sites.

The AAV2/9 REP-AAP-ΔCap plasmid has the five previously existing stop codons of AAV2/9 REP-AAP in addition to the deletion of AAs 450-592 of the AAV9 capsid sequence. These modifications did not affect vector production. The deletion of the overlapping fragment between REP-AAP and rAAV-ΔCap-in-cis-Lox2 plasmids minimizes recombination between plasmids that could potentially generate AAV9 wild-type capsids during co-transfection in vector production.

Capsid Characterization

AAV capsids. The AAV capsid variants with 7-mer insertions or 11-mer substitutions were made between positions 587-597 of AAV-PHP.B capsid using the pUCmini-iCAP-PHP.B backbone (Addgene ID: 103002).

ssAAV genomes. To characterize the AAV capsid variants, the single stranded (ss) rAAV genomes were used. Genomes such as pAAV:CAG-mNeonGreen27 (equivalent plasmid, pAAV: CAG-eYFP35; Addgene ID: 104055), pAAV:CAG-NLS-EGFP26 (equivalent version with one NLS is on Addgene ID 104061), pAAV:CAG-DIO-EYFP35 (Addgene ID: 104052), pAAV: GfABC1D-2xNLS-mTurquoise235 (Addgene ID: 104053), and pAAV-Ple261-iCre30 (Addgene ID 49113) were used.

pAAV:CAG-mNeonGreen2 genome consists of a ubiquitous CMV-β-Actin-intron-β-Globin (CAG) hybrid promoter driving the expression of a fluorescent protein, mNeonGreen (equivalent plasmid, pAAV: CAG-eYFP3; Addgene ID: 104055). pAAV:CAG-NLS-EGFP1 consists of NLS sequences at the N- and C-termini of EGFP and is driven by the CAG promoter. An equivalent version with one NLS is on Addgene (ID 104061). pAAV:CAG-DIO-EYFP3 (Addgene ID: 104052) consists of a EYFP gene built in the reverse direction of the CAG promoter, and it is flanked by a pair of Cre-Lox sites (Lox P and Lox 2272) on either ends.

In cells expressing Cre, the Cre-lox pair inverts EYFP enabling transcription and translation, followed by excision in the lox site to prevent re-inversion. pAAV: GfABC1D-2xNLS-mTurquoise23, referred to elsewhere as pAAV: GFAP-2xNLS-mTurquoise2 (Addgene ID: 104053), consists of NLS sequences at the N- and C-termini of mTurquoise2 and is driven by the astrocyte-specific promoter GfABC1D4. pAAV:Ple261-iCre5 (Addgene ID 49113) contains an endothelial-cell-specific promoter driving the expression of iCre.

pAAV:CAG-XFP (mNeongreen) was packaged for characterizing AAV variants. However, when performing quantification of cell-types: neurons, astrocytes and oligodendrocytes, CAG-NLS-EGFP was used to restrict the expression to nucleus for easier quantification using microscope images. GFAP-NLS-mTurq2 is used to quantify astrocytes. CAG-DIO-EYFP is used for Cre driver lines, due to the presence of lox sites in this plasmid.

The self-complementary genome from Dr. Guangping Gao, scAAV:CB6-EGFP genome has a hybrid ubiquitous CB6 promoter (975 bp) comprising a CMV enhancer (cytomegalovirus immediate early enhancer), a chicken-f3-actin promoter and hybrid intron, that drives the expression of EGFP. The genome has a rabbit globin poly A (127 bp) following the EGFP gene. The scAAV:CAG-EGFP (Addgene ID:83279), vector uses a ubiquitous CMV-β-Actin-intron-β-Globin (CAG) hybrid promoter to drive the expression of EGFP.

Round-I AAV Capsid Library Generation

Mutagenesis strategy. The 7-mer randomized insertion was designed using the NNK saturation mutagenesis strategy, involving degenerate primers (from Integrated DNA Technologies, Inc.) containing mixed bases. N can be A, C, G, or T bases and K can be G, or T. Using this strategy, combinations of all 20 AAs at each position of the 7-mer peptide using 33 codons were obtained, resulting in a library size of 1.28 billion at the level of AA combinations. The mutagenesis strategy for the 3-mer-s PHP.B library is described in Chan, K. Y. et al. Engineered AAVs for efficient noninvasive gene delivery to the central and peripheral nervous systems. *Nat. Neurosci.* 20, 1172-1179 (2017).

Library cloning. The 480 bp AAV capsid fragment (450-592 AAs) with the 7-mer random insertion between AAs 588 and 589 was generated by conventional PCR methods with a mixed base degenerate primer. The library fragment was amplified from the pCRII-9Cap-XE template by Q5 Hot Start High-Fidelity 2× Master Mix (NEB; M0494S) with forward primer, XF: 5'-ACTCATCGACCAATACTTGTAC-TATCTCTCTAGAAC-3' and reverse primer, 7×MNN-588i: 5'-GTATTCCTTGGTTTTGAACCCAACCGGTCTGCG-CCT- GTGCMNNMNNMNNMNNMNN MNNMNNTTG-GGCACTCTGGTGGTTTGTG-3'. To avoid PCR-induced biases resulting from point mutations, recombination, and template switching, PCR amplification was limited to 15-20 cycles and the reactions were scaled up to get the required yield. The resulting PCR products were run on a 1% agarose gel and extracted with a Zymoclean Gel DNA Recovery kit (Zymo Research; D4007). It is critical to avoid AAV contamination during this step by taking precautionary measures like using a clean gel-running box and freshly prepared 1×TAE buffer.

rAAV-ΔCap-in-cis-Lox2 plasmid (6960 bp) was linearized with the restriction enzymes AgeI and XbaI by following the NEB recommended protocol for double digestion. The digested plasmid was run on a 0.8%-1% agarose gel to extract the linearized backbone (6237 bp) with a Zymoclean Gel DNA Recovery kit.

The amplified library fragment was assembled into the linearized vector with the NEBuilder HiFi DNA Assembly Master Mix (NEB; E2621S) and a 1:2 molar ratio of vector to insert, to assemble at 50° C. for 60 min.

Library purification. The assembled library was then subjected to Plasmid Safe (PS) DNase (Epicentre; E3105K) treatment to purify the assembled product by degrading the un-assembled DNA fragments from the mixture. For the R1 library, around 3U of PS DNase per 1 μg of input DNA was used in a 30 min reaction at 37° C. Alternatively, Exonuclease V (RecBCD) was used following the NEB recommended protocol (NEB; M0345S). Both procedures yielded comparable results. The resulting mixture was further purified with a DNA Clean and Concentrator kit (Zymo Research; D4013).

Library yield. With an assembly efficiency of 15%-20% post-PS treatment, a yield of about 15-20 ng per 100 ng of input DNA per 20 μL reaction was obtained. For building the 7-mer-i DNA library, approximately 5-6 μg of input DNA was used to obtain around 800 ng of assembled library.

Quality control. To validate successful assembly of the library, 1 ng of the final assembled library was transformed into *E. coli* SURE 2 Supercompetent Cells (Integrated Sciences; 200152). Colonies on an LB/Agar plate containing carbenicillin antibiotic after overnight incubation at 37° C. were identified. The DNA library was sequenced around the insertion site (Laragen; Sanger Sequencing). A non-biased library shows multiple nucleotide peaks of equal diversity (25% each of A, T, G, C) across every base position of the diversified region. To verify that the ITRs were intact, SmaI digestion was carried out as per the NEB recommended protocol (NEB; R0141S). To validate successful transfection and assess the vector-production yield per 150 mm dish, 10 ng of 7-mer-i library was used to transfect HEK293 producer cells. Uniform expression of mNeonGreen protein across HEK cells was observed, and an average yield of 0.1-1×10^{11} vg was obtained per 150 mm dish. Using the average yield per dish, the vector production for in vivo selection was scaled up (See FIG. 45).

Round-2 AAV Capsid DNA Library

PCR pool design. To maintain proportionate pooling, the fraction of each sample/library that needs to be pooled based on an individual library's diversity was mathematically determined. This process involved estimation of the diversity precluding noise and consideration of amplification of this diversity across samples by determining the area under the curve for the interval of high-confidence variants that falls in the higher RC range. The area under the curve (AUC) was estimated using the composite Simpson's rule by plotting all the recovered variants in a library (X-coordinate) to their read counts (RCs or copy number from deep sequencing data, Y-coordinate) (see FIG. 40). To determine the definite intervals for AUC, the data was sorted based on the decreasing order of the RCs. Noticeably, the distribution has two phases, with a steadier slope of variants in the higher RC range, followed by a steep drop in the slope of the curve (~50-1000 fold lower RCs). By observation, this steeper side of the curve is predominant in sequencing errors/PCR mutations, hence this error dominant slope otherwise called noise from was precluded from the AUC estimation. When comparing composite Simpson's rule with another function, such as composite trapezoidal rule, the difference was miniscule.

This area is then used to determine the fraction of an individual library that needs to be pooled into PCR pool library using the formula: [Area under the curve/total number of libraries pooled].

The pooled sample was used as a template for further amplification with 12 cycles of 98° C. for 10 s, 60° C. for 20 s, and 72° C. for 30 s by Q5 polymerase, using the primers 588-R2lib-F: 5'-CACTCATCGACCAATACTTGTACTAT-CTCTCT-3' and 588-R2lib-R: 5'-GTATTCCTTGGTTTT-GAACCCAACCG-3'. Similar to R1 library generation, the PCR product was assembled into the rAAV-ΔCap-in-cis-Lox2 plasmid and the virus was produced.

The R1 libraries used to build R2 were the Cre-Lox flipped rAAV DNA from half of the mouse brains (~0.3 g) and portion of spinal cords (0.1-0.2 g) from all Cre lines. The amount of tissue processed here was sufficient for complete capsid library recovery. The differentially pooled and amplified libraries (by PCR pool or synthetic pool) were assembled using gibson assembly with a follow-up PS or Exonuclease V treatment (as described in R1 library generation). Successful library generation was validated by transformation, Sanger sequencing, and an ITR SmaI digest.

For vector production, about 10 ng of the purified and assembled library was used to transfect each 150 mm dish of 293T cells, and a yield of about 6×10^{11} vg per 150 mm dish was obtained (i.e. the R2 yield was six times that of R1, unsurprisingly given these sequences have already produced well enough to survive R1 selection).

Synthetic pool design. As described in the PCR pool strategy, high-confidence variants were chosen with RCs above the error-dominant noise slope from the plot of library distribution (see FIG. 40). This came to about 9000 sequences from all brain and spinal cord samples of all Cre lines. A similar primer design as mentioned in the description of the R1 library generation was used. Primers XF: 5'-ACTCATCGACCAATACTTGTACTATCTCTCTAG-AAC-3' and 11-mer-588i: 5'-GTATTCCTTGGTTTTGAA-CCCAACCGGTCTGCGCXXXXXXMNNMNNM- NNM-NNMNN MNNMNNXXXXXXACTCTGGTGGTTTGTG-3', where "XXXXXXMNNMNNMNNMNNMNNMNN-MNNXXXXXX" was replaced with unique nucleotide sequence of a 7-mer tissue recovered variant (7×MNN) along with modification of two adjacent codons flanking on either end of the 7-mer insertion site (6×X), which are residues 587-588 "AQ" and residues 589-590 "AQ" on AAV9 capsid. To select sequences for synthesis, the R1 brain and spinal cord libraries were chosen and used the same threshold limit for RC as described in the PCR pool strategy. This came to about 9000 sequences from all brain and spinal cord samples of all Cre lines. Since spike-in library has 11-mer mutated variants, the same primer design where "XXXXXXMNNMNNMNNMNNMNNMNNM-NNXXXXXX" was replaced with a specific nucleotide sequence of a 11-mer variant. A duplicate of each sequence in this library was designed with different codons optimized for mammals. The primers were designed using a custom built python based script (code will be made available in Github). The custom-designed oligopool was synthesized in an equimolar ratio by Twist Biosciences. The oligopool was used to amplify the pCRII-XE Cap9 template over 13 cycles of 98° C. for 10 s, 60° C. for 20 s, and 72° C. for 30 s. To obtain a higher yield for large-scale library preparation, the product of the first PCR was used as a template for the second PCR using the primers XF and 588-R2lib-R (described above) and amplified for 13 cycles. As described in the description of the R1 library generation, the PCR product was assembled into an rAAV backbone and processed and purified for virus production. About 10 ng per 150 mm dish of HEK293 cells produced about $6 \times 10^{11}$ vg of virus library.

AAV Viral Library Production and Purification

To prevent capsid mosaic formation of the 7-mer-i library in HEK293 producer cells, only 10 ng of assembled library per 150 mm dish were transfected along with other required reagents for AAV vector production. In addition to the 10 ng of library transfection per 150 mm dish of 293T producer cells, three plasmids were transfected: AAV2/9 REP-AAP-ΔCap, pUC18 and pHelper (genes encoding adenoviral proteins for AAV replication) at a ratio of 1:1:2. The plasmid pUC18 acts as a filler DNA to compensate for the low amount of library DNA in order to maintain the N:P ratio required for optimal transfection using polyethylenimine (PEI, Polysciences; 24765-1) transfection). The cells and culture media were harvested at 60 h post-transfection to collect the viral particles. rAAV harvest and purification were performed as per the protocol. The small amount of library DNA per plate and early cell harvest time are critical for reducing the possibility of mosaic capsid assemblies during vector production (similar considerations seen in prior reports).

For 7-mer-i library, the production was scaled up to 60 dishes (~$1.8 \times 10^7$ cells/dish) and with ~10% transfected with the library, resulted in ~$1 \times 10^8$ total transformants. For an NNK 7mer library with ~$1 \times 10^8$ total transformants, the number of unique variants is $9.99 \times 10^7$.

For the rAAV DNA extraction from purified rAAV viral library, ~10% of the purified viral library was used to extract the viral genome by proteinase K treatment. In order to degrade any contaminating DNA from the purified library, it was treated with DNase I enzyme (5 μl of 10 U/μl) (Sigma-Aldrich; 4716728001) in 100 μl of DNase I buffer and incubated for 1 h at 37° C. The enzyme was inactivated by adding 5 μl of 0.5 M EDTA at 70° C. for 10 min. Following DNase I treatment, the capsid protein shell was digested by adding 120 μl of proteinase solution containing 5 μl of 20 μg/μl of proteinase K and incubated at 50° C. overnight. To inactivate the proteinase K, the mixture was boiled at 95° C. The extracted rAAV library DNA was then concentrated and purified using phenol chloroform and ethanol. An equal volume of Phenol:Chloroform:Isoamyl Alcohol 25:24:1, pH8.0 (~250 μl; ThermoFisher Scientific; 15593031) was added and vortexed for 30 s. The mixture is incubated for 5 min at room temperature (RT) before centrifugation at 15,000 rpm for 10 min at 4° C. The upper aqueous phase was separated and mixed with an equal volume of chloroform and vortexed for 30 s. Following 5 min incubation at RT, centrifuge at 15,000 rpm for 10 min at 4° C. The upper aqueous phase was separated and one-tenth volume of 3M sodium acetate (pH 5.2) along with 2 μl Co-Precipitant Pink (Bioline; BIO-37075) and 2.5 volumes of ice cold 100% ethanol was added before vortexing for 30 s. The mixture was incubated for at least 1 hr at –20° C. before centrifugation at 15,000 rpm for 15 min at 4° C. The pellet was air dried and resuspended in TE buffer. The DNA concentration was determined using the Qubit ssDNA assay.

Animals

All animal procedures performed in this study were approved by the California Institute of Technology Institutional Animal Care and Use Committee (IACUC). C57BL/6J (000664), Tek-Cre (8863), SNAP25-Cre (23525), GFAP-Cre (012886), Syn1-Cre (3966), and Ai14 (007908) mice lines used in this study were purchased from the Jackson Laboratory (JAX). For in vivo library selection, 6- to 8-week-old adult male and female mice were intravenously injected with the viral libraries. Both genders were used for capsid selection to recover capsid variants with minimal gender bias. The IV injection of rAAVs was into the retro-orbital sinus of adult mice. For testing the transduction phenotypes of rAAVs, 6- to 8-week-old C57BL/6J or Tek-Cre or Ai14 adult male mice were randomly assigned. The experimenter was not blinded for any of the experiments performed in this study.

In Vivo Selection

Figures 43, 44, 45:
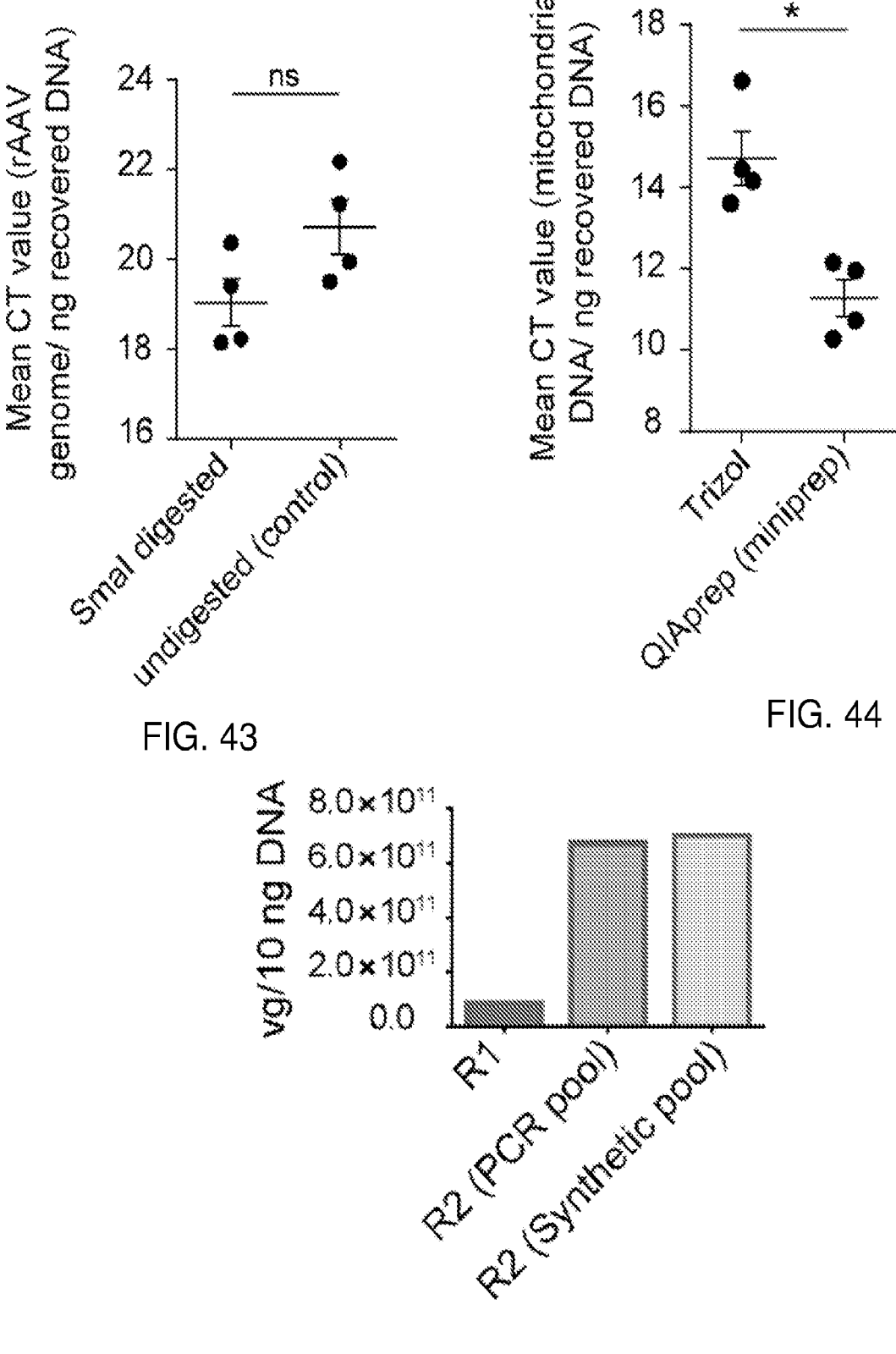
FIG. 43 shows the CT value (cycle threshold from qPCR) of rAAV genome extracted by trizol that were treated with SmaI restriction enzyme or untreated.
FIG. 44 shows CT value of mitochondrial DNA (internal control for smaller genome recovery, fold change=10.79 (2ΔCT)) recovered from 1 ng of total DNA from liver tissue.
FIG. 45 shows the vector yields obtained per 10 ng of capsid DNA library across R1 and R2 vector productions.

The 7-mer-i viral library selections were carried out in different lines of Cre transgenic adult mice: Tek-Cre, SNAP25-Cre, and GFAP-Cre for the R1 selections, and those three plus Syn1-Cre for the R2 selections. Male and female adult mice were intravenously administered with a viral vector dose of $2 \times 10^{11}$ vg/mouse for the R1 selection, and a dose of $1 \times 10^{12}$ vg/mouse for the R2 selection. The dose was determined based on the virus yield which was different across selection rounds (FIG. 45). Both genders were used to recover capsid variants with minimal gender bias. Two weeks post-injection, mice were euthanized and all organs including brain were collected, snap frozen on dry ice, and stored at –80° C.

rAAV Genome Extraction from Tissue

Optimization. For rAAV genome extraction from tissues, both the Trizol method (Life Technologies; 15596) and the QlAprep Spin Miniprep kit (Qiagen, Inc; 27104) were used according to the manufacturers' recommended protocols, and found the Trizol method to be more efficient. The total rAAV genome recovery from 0.1 g of mouse liver was quantified by quantitative PCR using the primers mNeon-Green-F: 5'-CGACACATGAGTTACACATCTTTGGCTC-3' and mNeonGreen-R: 5'-GGAGGTCACCCTT-GGTGGACTTC-3', which binds to the mNeonGreen gene of the ssAAV-ΔCap-in-cis-Lox2 genome. As an internal control, the amount of mitochondrial DNA (a measure of the recovery of smaller genomes) was quantified using primers Mito-F: 5'-CCCAGCTACTACCATCATTCAAGT-3' and Mito-R: 5'-GATGGTTTGGGAGATTGGTTGATGT-3'. Although the percentage of viral DNA per 1 ng total extracted DNA was about 1.5 fold higher with the QlAprep kit than with the Trizol method, the overall recovery was lower with the QlAprep kit.

The extracted viral genome was digested with a restriction enzyme, such as SmaI (found within the ITRs), to improve rAAV genome recovery by PCR. This was analyzed by quantitative PCR with Cre+ primers, CapF-56: 5'-AT-TGGCACCAGATACCTG ACTCGTAA-3', Cre+R-58: 5'-CAAGTAAAACCTCTACAAATGTGGTAAAATCG-3' and Cre-primers, CapF-56 (see above) and Cre-R-57: 5'-GTCCAAACTCATCAATGTATCTTATCATGTCTG-3'.

rAAV genome extraction with the Trizol method. Half of a frozen brain hemisphere (0.3 g approx.) was homogenized with a 2 ml glass homogenizer (Sigma Aldrich; D8938) or a motorized plastic pestle (Fisher Scientific; 12-141-361, 12-141-363) (for smaller tissues) and processed as described in prior work. The extracted DNA was then treated with 3-6

µl of 10 µg/µl RNase Cocktail Enzyme Mix (ThermoFisher Scientific; AM2286) to remove RNA and digested with SmaI restriction enzyme. The treated mixture was then purified with a Zymo DNA Clean and Concentrator kit (D4033). From deep sequencing data analysis, it was observed that the amount of tissue processed for rAAV genome recovery is sufficient.

rAAV genome recovery by Cre-dependent PCR. rAAV genomes with Lox sites flipped by Cre recombination were selectively recovered and amplified using PCR with primers that yield a PCR product only if the Lox sites are flipped (See FIG. 37). The primers 71F: 5'-CTTCCAGTTCAGC-TACGAGTTTGAGAAC-3' and CDF/R: 5'-CAAGT-AAAACCTCTACAAATGTGGTAAAATCG-3' were used and amplified the Cre-recombined genomes over 25 cycles of 98° C. for 10 s, 58° C. for 30 s, and 72° C. for 1 min, using Q5 DNA polymerase Total rAAV genome recovery by PCR (Cre-independent). To recover all rAAV genomes from a tissue, the primers XF (5'-ACTCATCGACCAATACTTGTACTATCTCTCT-AGAAC-3') and 588-R2lib-R (5'-GTATTCCTTGGTTTT-GAACCCAACCG-3') were used to amplify the genomes over 25 cycles of 98° C. for 10 s, 60° C. for 30 s, and 72° C. for 30 min, using Q5 DNA polymerase.

Sample Preparation for NGS

To analyze selections using deep sequencing, the DNA library was processed, the virus library, and the tissue libraries post-in vivo selection to add flow cell adaptors around the diversified 7-mer insertion region (See FIG. 37).

Preparation of rAAV DNA and Viral DNA library. The Gibson-assembled rAAV DNA library and the DNA extracted from the viral library were amplified by Q5 DNA polymerase using the primers 588i-lib-PCR1-6bpUID-F: 5'-CACGACGCTCTTCCGATCTAANNNNNNAGTCC-TATGGACAAGTGGCCACA-3' and 588i-lib-PCR1-R: 5'-GTGACTGGAGTTCAGACGTGTGCTCTTCC-GATCTTCCTTGGTTTTGAACCCAACCG-3' that are positioned around 50 bases from the randomized 7-mer insertion on the capsid, and that contain the Read1 and Read2 flow cell sequences on the 5' end.

The primer, 588i-lib-PCR1-6bpUID-F: 5' CACGACGCTCTTCCGATCTAANNNNNNAGTCC-TATGGACAAGTGGCCACA-3' used to minimally amplify DNA and virus libraries for NGS has 6 nucleotides long UID (unique identifier) "NNNNNN" that sits after 19 nucleotides of Read-1 sequence used in NGS "5'-CACGACG-CTCTTCCGATCT" and linker "AA". The sequence after UID "AGTCCTATGGACAAGTGGCCACA" is the region that anneals to the AAV9 capsid. UID is an optional feature for NGS data analysis to identify potential PCR amplification errors. However, this feature wasn't utilized in the NGS data analysis in this study to maintain consistency with the primers used in rAAV genome recovery from tissues which lacks this UID feature (primers 71F: 5'-CTTC-CAGTTCAGCTACGAGTTIG.AGAAC-3 and CDF/R: 5' CAAGTAAAACCTCT ACA A ATGTGGTAA AATCG-3). The UID or any kind of overhangs seemed to affect the PCR based recovery from tissue. Presumably, the primer thermo-stability has a key role to play in very low amount of extracted rAAV genomes from tissues.

Using 5-10 ng of template DNA in a 50 µl reaction, the DNA was minimally amplified for 4 cycles of 98° C. for 10 s, 60° C. for 30 s, and 72° C. for 10 s. The mixture was then purified with a PCR purification kit. The eluted DNA was then used as a template in a second PCR to add the unique indices (single or dual) via the recommended primers (NEB; E7335S, E7500S, E7600S) in a 12-cycle reaction using the same temperature cycle as described above. The samples were then sent for deep sequencing following additional processing and validation.

The PCR products post indices addition were run on a freshly prepared 2% low-melting-point agarose gel (ThermoFisher Scientific; 16520050) for better separation and recovery of the approx. 120 bp DNA band on the gel. Before sending the sample for NGS, the nucleotide diversity at the randomized 7-mer position was verified by Sanger sequencing. If needed, an optional PCR was carried out to send sufficient sample for Sanger sequencing using 15-20 cycles of 98° C. for 10 s, 60° C. for 30 s, and 72° C. for 10 s with the primers NGS-QC-F: 5'-AATGATACGGCGACCA-CCGAG-3' and NGS-QC-R: 5'-CAAGCAGAAGACGG-CATACGA-3'. Upon validation, the libraries were sent for deep sequencing using the Illumina HiSeq 2500 System (Millard and Muriel Jacobs Genetics and Genomics Laboratory, Caltech; Integrative Genomics Core, City of Hope).

Preparation of rAAV tissue DNA library. The PCR-amplified rAAV DNA library from tissue (see section: In vivo selection (i) (c)) was further amplified with a 1:100 dilution of this DNA as a template to the primers 1527: 5'-ACACTCTTTCCCTACACGACGCTCTTCCGATCTG-ACAAGTGGCCACAAACCACCAG-3' and 1532: 5'-GT-GACTGGAGTTCAGACGTGTGCTCTTCCGATCT-CCTTGGTTTTGAACCCAACCG-3' that are positioned around 50 bases from the randomized 7-mer insertion on the capsid, and that contain the Read1 and Read2 sequences on the 5' end. The DNA was amplified by Q5 Hot Start High-Fidelity 2× Master Mix or NEBNext Ultra II Q5 Master Mix (NEB; M0544) for 10 cycles of 98° C. for 10 s, 59° C. for 30 s, and 72° C. for 10 s. The mixture was purified with a PCR purification kit. The eluted DNA was then used as a template in a second PCR to add the unique indices (single or dual) using the recommended primers (NEB; E7335S, E7500S, E7600S) in a 10-cycle reaction with the same temperature cycle as described above (for DNA and virus library preparation). The extracted DNA was validated by Sanger sequencing and sent for deep sequencing as described in the previous section.

In Vivo Characterization of AAV Vectors

Cloning AAV capsid variants. The AAV capsid variants were cloned into a pUCmini-iCAP-PHP.B backbone (Addgene ID: 103002) using overlapping forward and reverse primers with 11-mer substitution (in case of 7-mer-i variants, the flanking amino acids from AAV9 capsid AA587-588 "AQ" and AA589-590 "AQ" were subjected to codon modification) that spans from the MscI site (at position 581 AA) to the AgeI site (at position 600 AA) on the pUCmini plasmid. The primers were designed for all capsid variants using a custom python script (Code will be made available on github), and since they cover the entire fragment insertion, these primers are self-annealed and amplified using PCR to create a dsDNA fragment without the use of a template DNA. They are amplified by Q5 Hot Start High-Fidelity 2× Master Mix for 20 cycles of 98° C. for 10 s, 60° C. for 30 s, and 72° C. for 10 s. This fragment was then assembled into the MscI/AgeI digested pUCmini-iCAP-PHP.B backbone by the Gibson assembly method. There is a second MscI site on the backbone; however, this was blocked by methylation. The assembled plasmids were then transformed into NEB Stable Competent E. coli (New England Biolabs, Inc; C3040H), and colonies were selected on carbenicillin/ampicillin-LB agar plates.

List of primers used to clone AAV-PHP variants: The variants from 7-mer-i and 3-mer-s libraries were cloned as 11-mer substitution.

TABLE 6

Primers For AAV-PHP Variants

| Variant Name | Amino acid | Nucleotide sequence | Forward primer (5'-3') | Reverse primer (5'-3') |
|---|---|---|---|---|
| AAV-PHP.V1 | AQTALKP FLAQ | GCCCAAA CCGCCCTC AAACCCTT CCTCGCAC AG | GGAGTCCTATGGAC AAGTGGCCACAAA CCACCAGAGTGCCC AAACCGCCCTCAAA CCC (SEQ ID NO: 1032) | TTCCTTGGTTTTGAAC CCAACCGGTCTGCGC CTGTGCGAGGAAGGG TTTGAGGGCGGTTTGG GC (SEQ ID NO: 1047) |
| AAV-PHP.V2 | AQTTLKP FLAQ | GCCCAAA CCACCCTC AAACCCTT CCTCGCAC AG | GGAGTCCTATGGAC AAGTGGCCACAAA CCACCAGAGTGCCC AAACCACCCTCAAA CCC (SEQ ID NO: 1033) | TTCCTTGGTTTTGAAC CCAACCGGTCTGCGC CTGTGCGAGGAAGGG TTTGAGGGTGGTTTGG GC (SEQ ID NO: 1048) |
| AAV-PHP.B4 | AQTLQIPF KAQ | GCCCAAA CGTTGCAG ATTCCTTT TAAGGCA CAG | GGAGTCCTATGGAC AAGTGGCCACAAA CCACCAGAGTGCCC AAACGTTGCAGATT CCT (SEQ ID NO: 1034) | TTCCTTGGTTTTGAAC CCAACCGGTCTGCGC CTGTGCCTTAAAAGG AATCTGCAACGTTTGG GC (SEQ ID NO: 1049) |
| AAV-PHP.B5 | AQTLQLP FKAQ (SEQ ID NO: 1062) | GCCCAAA CCCTCCAA CTCCCCTT CAAAGCC CAA (SEQ ID NO: 1068) | GGAGTCCTATGGAC AAGTGGCCACAAA CCACCAGAGTGCCC AAACCCTCCAACTC CCC (SEQ ID NO: 1035) | TTCCTTGGTTTTGAAC CCAACCGGTCTGCGCT TGGGCTTTGAAGGGG AGTTGGAGGGTTTGG GC (SEQ ID NO: 1050) |
| AAV-PHP.B6 | AQTLQQP FKAQ (SEQ ID NO: 1063) | GCCCAAA CTTTGCAG CAGCCGTT TAAGGCA CAG (SEQ ID NO: 1069) | GGAGTCCTATGGAC AAGTGGCCACAAA CCACCAGAGTGCCC AAACTTTGCAGCAG CCG (SEQ ID NO: 1036) | TTCCTTGGTTTTGAAC CCAACCGGTCTGCGC CTGTGCCTTAAACGGC TGCTGCAAAGTTTGG GC (SEQ ID NO: 1051) |
| AAV-PHP.B7 | AQSIERPF KAQ | GCCCAAA GCATCGA AAGACCCT TCAAAGC ACAG | GGAGTCCTATGGAC AAGTGGCCACAAA CCACCAGAGTGCCC AAAGCATCGAAAG ACCC (SEQ ID NO: 1037) | TTCCTTGGTTTTGAAC CCAACCGGTCTGCGC CTGTGCTTTGAAGGGT CTTTCGATGCTTTGGG C (SEQ ID NO: 1052) |
| AAV-PHP.B8 | AQTMQKP FIAQ | GCCCAAA CCATGCAA AAACCCTT CATCGCAC AG | GGAGTCCTATGGAC AAGTGGCCACAAA CCACCAGAGTGCCC AAACCATGCAAAA ACCC (SEQ ID NO: 1038) | TTCCTTGGTTTTGAAC CCAACCGGTCTGCGC CTGTGCGATGAAGGG TTTTTGCATGGTTTGG GC (SEQ ID NO: 1053) |
| AAV-PHP.C1 | AQRYQGD SVAQ | GCCCAAA GGTATCAG GGTGATTC TGTTGCAC AG | GGAGTCCTATGGAC AAGTGGCCACAAA CCACCAGAGTGCCC AAAGGTATCAGGG TGAT (SEQ ID NO: 1039) | TTCCTTGGTTTTGAAC CCAACCGGTCTGCGC CTGTGCAACAGAATC ACCCTGATACCTTTGG GC (SEQ ID NO: 1054) |
| AAV-PHP.C2 | AQWSTNA GYAQ | GCCCAAT GGTCGAC AAACGCT GGTTACG CACAG | GGAGTCCTATGGA CAAGTGGCCACAA ACCACCAGAGTGC CCAATGGTCGACA AACGCT (SEQ ID NO: 1040) | TTCCTTGGTTTTGAA CCCAACCGGTCTGCG CCTGTGCGTAACCAG CGTTTGTCGACCATT GGGC (SEQ ID NO: 1055) |
| AAV-PHP.C3 | AQERVGF AQAQ | GCCCAAG AGCGTGT AGGTTTC GCACAGG CACAG | GGAGTCCTATGGA CAAGTGGCCACAA ACCACCAGAGTGC CCAAGAGCGTGTA GGTTTC (SEQ ID NO: 1041) | TTCCTTGGTTTTGAA CCCAACCGGTCTGCG CCTGTGCCTGTGCGA AACCTACACGCTCTT GGGC (SEQ ID NO: 1056) |
| AAV-PHP.N | AQTLAVP FSNP (SEQ ID NO: | GCGCAGA CCCTAGCT GTCCCTTT | GGAGTCCTATGGAC AAGTGGCCACAAA CCACCAGAGTGCGC | TTCCTTGGTTTTGAAC CCAACCGGTCTGCGC AGGGTTCGAAAAAGG |

TABLE 6-continued

| | | | Primers For AAV-PHP Variants | |
| --- | --- | --- | --- | --- |
| Variant Name | Amino acid | Nucleotide sequence | Forward primer (5'-3') | Reverse primer (5'-3') |
| | 1064) | TTCGAACC CT (SEQ ID NO: 1070) | AGACCCTAGCTGTC CCT (SEQ ID NO: 1042) | GACAGCTAGGGTCTG CGC (SEQ ID NO: 1057) |
| AAV-PHP.X1 | AQARQM DLSAQ (SEQ ID NO: 1065) | GCCCAAG CCAGACA AATGGAC CTCAGCGC ACAG (SEQ ID NO: 1071) | GGAGTCCTATGGAC AAGTGGCCACAAA CCACCAGAGTGCCC AAGCCAGACAAAT GGAC (SEQ ID NO: 1043) | TTCCTTGGTTTTGAAC CCAACCGGTCTGCGC CTGTGCGCTGAGGTCC ATTTGTCTGGCTTGGG C (SEQ ID NO: 1058) |
| AAV-PHP.X2 | AQTNKVG NIAQ (SEQ ID NO: 1066) | GCCCAAA CCAACAA AGTCGGC AACATCGC ACAG (SEQ ID NO: 1072) | GGAGTCCTATGGAC AAGTGGCCACAAA CCACCAGAGTGCCC AAACCAACAAAGT CGGC (SEQ ID NO: 1044) | TTCCTTGGTTTTGAAC CCAACCGGTCTGCGC CTGTGCGATGTTGCCG ACTTTGTTGGTTTGGG C (SEQ ID NO: 1059) |
| AAV-PHP.X3 | AQQNVTK GVAQ | GCCCAAC AGAACGT AACGAAG GGTGTGG CACAG | GGAGTCCTATGGA CAAGTGGCCACAA ACCACCAGAGTGC CCAACAGAACGTA ACGAAG (SEQ ID NO: 1045) | TTCCTTGGTTTTGAA CCCAACCGGTCTGCG CCTGTGCCACACCCT TCGTTACGTTCTGTT GGGC (SEQ ID NO: 1060) |
| AAV-PHP.X4 | AQLNAIK NIAQ (SEQ ID NO: 1067) | GCCCAAC TCAACGC TATCAAG AACATCG CACAG (SEQ ID NO: 1073) | GGAGTCCTATGGA CAAGTGGCCACAA ACCACCAGAGTGC CCAACTCAACGCT ATCAAG (SEQ ID NO: 1046) | TTCCTTGGTTTTGAA CCCAACCGGTCTGCG CCTGTGCGATGTTCT TGATAGCGTTGAGTT GGGC (SEQ ID NO: 1061) |

AAV vector production. Using an optimized protocol, AAV vectors were produced from 5-10 150 mm plates, which yielded sufficient amounts for administration to adult mice.

AAV vector administration. AAV vectors were administered intravenously to adult male mice (6-8 weeks of age) via retro-orbital injection at doses of 1-10×10$^{11}$ vg. The AAV doses are determined by the experimental needs. CAG-NLS-GFP related experiments for quantification were done at medium dose of 1×10$^{11}$ vg given this was the dose previously determined for AAV-PHP.eB characterization. Otherwise, the non-NLS genome related experiments were done at 3×10$^{11}$ vg, with the exception of Cre-driver lines (GFAP-Cre or Tek-Cre), or a lower strength promoter containing genome (GFAP-NLS-mTurq) where the dose was 1×10$^{12}$ vg. The high dose was chosen to understand the full potential of the new vectors in these systems.

All experiments with vectors carrying CAG, a strong ubiquitous promoter, were incubated for 3 weeks. The 4 week incubations are those that involved expression from Cre driver lines or cell-type specific promoter where it is generally recommended for a longer wait time. The 2 week incubations are those where the vectors carried self-complementary genomes with strong ubiquitous promoters.

Tissue processing. After 3 weeks of expression (unless noted otherwise), the mice were anesthetized with Euthasol (pentobarbital sodium and phenytoin sodium solution, Virbac AH) and transcardially perfused with 30-50 mL of 0.1 M phosphate buffered saline (PBS) (pH 7.4), followed by 30-50 ml of 4% paraformaldehyde (PFA) in 0.1 M PBS. After this procedure, all organs were harvested and post-fixed in 4% PFA at 4° C. overnight. The tissues were then washed and stored at 4° C. in 0.1 M PBS and 0.05% sodium azide. All solutions used for this procedure were freshly prepared. For the brain and liver, 100-μm thick sections were cut on a Leica VT1200 vibratome.

For vascular labeling, the mice were anesthetized and transcardially perfused with 20 mL of ice-cold PBS, followed by 10 mL of ice-cold PBS containing Texas Red-labeled Lycopersicon Esculentum (Tomato) Lectin (1:100, Vector laboratories, TL-1176), and then placed in 30 mL of ice-cold 4% PFA for fixation.

Immunohistochemistry. Tissue sections—typically 100-μm thick—were first incubated in blocking buffer (10% normal donkey serum, 0.1% Triton X-100, and 0.01% sodium azide in 0.1 M PBS, pH 7.4) with primary antibodies at appropriate dilutions for 24 h at room temperature on a rocker. The primary antibodies used in this study were rabbit S100 (1:400, Abcam, ab868), rabbit Olig2 (1:400; Abcam, ab109186), rabbit NeuN (1:400, Abcam, ab177487), and rabbit GLUT-1 (1:400; Millipore Sigma, 07-1401). After primary antibody incubation, the tissues were washed 1-3 times with wash buffer 1 (0.1% Triton X-100 in 0.1 M PBS buffer, pH 7.4) over a period of 5-6 h in total. The tissues were then incubated in blocking buffer with the secondary antibodies at appropriate dilutions for 12-24 h at room temperature and then washed in three times in 0.1 M PBS, pH 7.4 over a total duration of 5-6 h. The secondary antibody used in this study was Alexa Fluor 647 AffiniPure donkey anti-rabbit IgG (H+L) (Jackson ImmunoResearch Lab, 711-605-152). When performing nuclear staining, 4',6-Diamidine-2'-phenylindole dihydrochloride (DAPI, Sigma Aldrich, 10236276001) is used at a 1:1000 dilution in 0.1 M PBS, pH 7.4 and incubated with tissues for 15 minutes followed by a single wash for 10 minutes in 0.1 M PBS, pH 7.4. The DAPI and/or antibody-stained tissue sections were mounted with ProLong Diamond Antifade Mountant (ThermoFisher Scientific, P36970).

Hybridization chain reaction (HCR) based RNA labeling in tissues. Fluorescence in situ hybridization chain reaction (FITC-HCR) was used to label excitatory neurons with VGLUT1 and inhibitory neurons with GAD1 to characterize the AAV capsid variant AAV-PHP.N in brain tissue using an adapted third-generation HCR protocol. To characterize the AAV capsid variant AAV-PHP.N in brain tissue, HCR method was sought to label excitatory and inhibitory neurons. Fluorescence in situ hybridization chain reaction (FITC-HCR) was used to label excitatory neurons with VGLUT1 and inhibitory neurons with GAD1. Adapting the third-generation HCR, 13 probe sets were designed for each target by using custom-made software (https://github.com/GradinaruLab/HCRprobe). After 3 weeks of expression, the mice were transcardially perfused and fixed as described earlier (Section D. Tissue processing). To minimize RNase enzyme exposure in fixed tissues, following overnight fixation in 4% PFA, the tissues were washed and stored at 4° C. in 0.1 M RNase-free PBS and 0.05% sodium azide. The harvested brains were henceforth handled with care to avoid exposure to RNase using reagents such as RNAlater stabilization solution/RNase-free PBS/RNaseZap (ThermoFisher Scientific, AM7021, AM9624, AM9780). Once the harvested brains were sagittally sliced to 100-µm thick sections, FITC-HCR was performed to detect both genes. Tissue slices were permeabilized with 0.1% Triton X-100 in 0.1 M RNase-free PBS for 1 h at RT and pre-hybridized in hybridization solution (10% dextran sulfate and 10% ethylene carbonate in 2×SSC buffer (saline-sodium citrate)) for >30 min at 37° C. The designed probes were diluted in hybridization solution to get a final concentration of 2 nM. The tissue sections were then subjected to hybridization with the probes overnight at 37° C. Following this, the sections were washed with pre-warmed wash buffer (10% ethylene carbonate in 2×SSC) at 37° C. for 30 min twice, followed by 2×SSC at RT for 30 min twice. Amplification with hairpin pairs (Molecular Technologies, CA) were performed in amplification buffer (10× dextran sulfate in 2×SSC); hairpins were snap-cooled at 95° C. for 90 s, followed by RT for 30 min, and diluted with amplification buffer (60 nM). Tissues were then incubated in this amplification buffer with hairpins overnight at RT with gentle agitation. Once the amplification was done, samples were briefly washed with 2×SSC and mounted in Prolong Diamond for imaging.

Imaging and image processing. All images in this study were acquired either with a Zeiss LSM 880 confocal microscope using the objectives Fluar 5×0.25 M27, Plan-Apochromat 10×0.45 M27 (working distance 2.0 mm), and Plan-Apochromat 25×0.8 Imm Con DIC M27 multi-immersion; or with a Keyence BZ-X700 microscope. The acquired images were processed in Zen Black 2.3 SP1 (Zeiss), BZ-X Analyzer (Keyence), Illustrator CC 2018 (Adobe), Photoshop CC 2018 (Adobe), and Imaris (Bitplane). To prevent any imaging artifacts resulting from multiple fluorescence spectral overlap, the fluorescence excitation and emission spectra were kept distinct following the recommended linear unmixed acquisition of individual colors. A far-red fluorescent dye was chosen for any additional marker staining to keep the imaging parameters distinct from in vivo fluorescent expression thereby preventing any spectral overlap across detector channels. The tissues were routinely monitored for auto fluorescence or imaging artifacts before acquisition, and imaging parameters were adjusted if needed. The imaging parameters were cross-checked with tissues lacking in vivo transduction to avoid any imaging artifacts. The regions used for the images were closely matched across experimental groups to minimize bias during comparisons.

Tissue clearing and imaging of thick tissues. To demonstrate the ability of PHP.V1 to transduce the vasculature across thick tissues, such as half of a mouse-brain hemisphere or a femur bone, tissue from Tek-Cre mice was assessed after 4 weeks' of expression.

The brain hemisphere was stained with the primary antibody, Anti-GFP (Ayes Labs, GFP-1020), and the secondary antibody, goat anti-Chicken IgY, Alexa Fluor 633 (ThermoFisher Scientific, A-21103), and cleared via the iDISCO protocol[38]. For imaging, a commercial light-sheet microscope (Lavision BioTec) with a custom objective lens (4×) was used. The resulting image files were reorganized by a custom MATLAB script to allow stitching with TeraStitcher. For 3-D visualization, Imaris (Bitplane) was used.

To image the mouse femur bone, the bones were sectioned to 300 µm thickness for antibody penetration and stained with the primary antibody, Anti-GFP, and the secondary antibody, Alexa Fluor 488 donkey anti-chicken IgY (Jackson ImmunoResearch Lab, 703-545-155), and then cleared via the TDE (2-2'-thiodiethanol) clearing method[41]. The images were acquired with a confocal microscope (Zeiss LSM 880) and visualized in Imaris software.

Tissue processing and imaging for quantification of rAAV transduction in vivo. For quantification of rAAV transduction, 6- to 8-week-old male mice were intravenously injected with the virus, which was allowed to express for 3 weeks (unless specified otherwise). The mice were randomly assigned to groups and the experimenter was not blinded. The mice were perfused and the organs were fixed in PFA. The brains and livers were cut into 100-µm thick sections and immunostained with different cell-type-specific antibodies, as described above. The images were acquired either with a 25× objective on a Zeiss LSM 880 confocal microscope or with a Keyence BZ-X700 microscope; images that are compared directly across groups were acquired and processed with the same microscope and settings.

For quantification of PHP.B-family variant transduction in tissues, the images were acquired using 25× objective with 1× digital zoom on a Zeiss LSM 880 confocal microscope. With n=3 mice per variant, images were acquired across 4 brain regions—cortex, striatum, ventral midbrain and thalamus, and tissues were stained with 3 cell type markers (NeuN, Olig2, and S100). For each mouse, 2 images per brain region per cell type marker were acquired, and the mean were plotted.

For PHP.N transduction analysis, the images were acquired using 20× objective on Keyence BZ-X700 microscope. With n=3 mice, images across 4 brain regions—cortex, striatum, ventral midbrain and thalamus were acquired to cover the entire brain regions for 3 cell type markers (NeuN, Olig2, and S100). This involved 6-8 images to cover cortex, thalamus and striatum, and 2 images to cover ventral midbrain per mouse per cell-type marker. For each mouse, across each region, the mean from the images were plotted.

For PHP.V GLUT1⁺ transduction analysis, the images were acquired using 25× objective with 1× digital zoom on a Zeiss LSM 880 confocal microscope. Each distinct blood vessel in the image with GLUT1⁺ staining and XFP expression was determined as positive for transduction. Quantification of expression from the CAG-mNeonGreen vector was performed across the cortex (n=3 per group). Each data point is drawn from the mean of 3-2 images per mouse. Different brain regions were quantified for Tek-Cre and Ai14 mouse experiments with n=2 per group. For cortex, cerebellum, striatum and ventral midbrain, the mean was plotted from 3-4 images per mouse per region.

In Vitro Characterization of AAV Vectors

Human Brain Microvascular Endothelial Cells (HBMEC) (ScienCell Research Laboratories, Cat. 1000) were cultured as per the instructions provided by the vendor. HBMEC were cultured from a frozen stock vial in fibronectin-coated T-75 flask (7000-9000 cells/cm$^2$ seeding density) using the Endothelial Cell Medium (Cat. 1001). The cells were sub-cultured in fibronectin-coated 48-well plates (0.95 cm$^2$ growth area) at the recommended seeding density and incubated at 37° C. for ~24-48 h till the cells were completely adherent with ~70-80% confluence. The viral vectors packaging pAAV-CAG-mNeongreen were added to the cell culture at a dose of either 1×10$^8$ or 1×10$^{10}$ vg per well (3 wells per dose per vector). The media was changed 24 hours later and the culture was assessed for fluorescence expression at 3 days' post infection. Per vendor recommendation, the culture media was changed every other day to maintain the cell culture.

Data Analysis

Quantification of rAAV vector transduction in mouse tissue. Manual counting was performed with the Adobe Photoshop CC 2018 Count Tool for cell types in which expression and/or antibody staining covered the whole cell morphology. The Keyence Hybrid Cell Count software (BZ-H3C) was used where the software could reliably detect distinct cells in an entire dataset. To maintain consistency in counting across different markers and groups, one person was assigned to quantify across all groups in all brain areas.

Manual counting was performed for GLUT-1-stained blood vessels and expression of the ssAAV:CAG-mNeon-Green and ssAAV:CAG-DIO-EYFP, where the efficiency was calculated as the percentage of XFP+ vessels relative to the GLUT-1 staining. Manual counting was also performed to quantify nuclear or soma stained cells, including NeuN−, Olig2−, and S100-stained cells. The efficiency was calculated as the percentage of XFP+ cells relative to cell-marker+ cells.

Keyence Hybrid Cell Count software (BZ-H3C) was used to quantify expression of nuclear localized AAV genomes in liver hepatocytes that co-localized with the DNA stain, DAPI; and also for the study involving ssAAV:GFAP-2xNLS-mTurquoise2 genomes with S100 cell marker.

The mean fluorescence intensity across microscopic images were quantified using ImageJ software. The images were processed for background subtraction and using the Threshold operation, the mean fluorescence intensity was measured.

NGS data alignment and processing. The raw fastq files from NGS runs were processed with custom built scripts (codes will be made available on Github) that align the data to AAV9 template DNA fragment containing the diversified region 7×NNK (for R1) or 11×NNN (for R2 since it was synthesized as 11×NNN). The pipeline to process these datasets involved filtering the dataset to remove the low-quality reads by using the deep sequencing quality score for each sequence. The variant sequences were then recovered from the sequencing reads by searching for the flanking template sequences, and extracting the nucleotides of the diversified region (perfect string match algorithm). The quality of the aligned data was further investigated to remove any erroneous sequences (such as ones with stop codons). The raw data was plotted (as shown in Supplementary FIG. 1e) to study the quality of recovery across every library. Based on the RC distribution, we adapted a thresholding method to remove plausible erroneous mutants that may have resulted from PCR or NGS based errors. The assumption is that if there is a PCR mutation or NGS error on the recovered parent sequence, the parent must have existed at least one round earlier than the erroneous sequence, and thus a difference in RCs should exist.

For R1 tissue libraries, a steep drop was observed in the slope of the distribution curve following a long tail of low count sequences, and were found to be rich in sequences that are variations of the parents in the higher counts range. A threshold for RCs was manually set to remove such erroneous mutants. The thresholded data were then processed differently based on the experimental needs as described elsewhere using custom Python based scripts.

For R2 tissue libraries from PCR pool and synthetic pool, given the smaller library size compared to R1, the data was thresholded in two steps. Only the tissue recovered sequences that were present in the respective input DNA and virus library were considered (after removing lower count variants from input libraries following the same principle as R1 tissue libraries). This step partially removed the long tail of low count reads. As a second step, the thresholding that was described for R1 tissue libraries was applied.

While it is plausible that true variants may be lost during thresholding, this method minimized false positives as the low count mutants in tissue and virus libraries often seemed to have very high enrichment score (as RCs are normalized to input library). In other words, thresholding allowed selective investigation on positively and negatively enriched variants that had a higher-confidence in their NGS RCs.

As an alternative to the manual thresholding method, an optional error correction method called "Collapsing" was built to further validate the outcome from filtered datasets. This method starts at the lowest count variants (variants of count 1) and searches for potential parent variants that are off by one nucleotide but have at least 2-fold higher counts (fold change=$2^{ACT}$) where CT is PCR cycle threshold). This error correction method then transfers the counts of these potential erroneous sequences to their originating sequences and repeats recursively until all sequences have been considered. On applying this error correction to the thresholded data, an additional ~0.002-0.03% of sequences were captured (compared to >19% captured by thresholding), confirming that the thresholding strategy was largely successful.

NGS data analysis. The aligned data were then further processed via a custom data-processing pipeline, with scripts written in Python (available on Github). The enrichment scores of variants (Total=N) across different libraries were calculated from the read counts (RCs) according to the following formula: Enrichment score=log 10 [(Variant 1 RC in tissue library1/Sum of variants N RC in library1)/(Variant 1 RC in virus library/Sum of variants N RC in virus library)]

To consistently represent library recovery between R1 and R2 selected variants, the enrichment score of the variants in R1 selection was estimated. The standard score of variants in a specific library was calculated using this formula: Standard score=(read count_i−mean)/standard deviation. Where read count_i is raw copy number of a variant i, Mean is the mean of read counts of all variants across a specific library, Standard deviation is the standard deviation of read counts of all variants across a specific library.

Since the DNA and virus libraries were not completely sampled unlike the tissue libraries, we assigned an estimated RC for variants that were not present in the input library but were present in the output library. For instance, R1 virus library is the input library to the R1 tissue libraries. The estimated RC is defined as a number that is lower than the lowest RC in the library with the assumption that these variants were found at a relatively lower abundance than the variants recovered from the deep sequencing. In virus libraries, since RC of 1.0 was the lowest, we assigned all missing variants an estimated RC of 0.9. We use this method to calculate the enrichment score of the R1 tissue libraries which is normalized to R1 virus library (FIG. 1d). This was done to represent libraries across two selection rounds consistently. Although, the individual enrichment score among R1 variants didn't add a significant value to the variants selected for R2 selection as described in the criteria to separate signal vs noise in R1 using the RCs.

Heatmap generation. The relative AA distributions of the diversified regions are plotted as heatmaps. The plots were generated using the Python Plotly plotting library. The heatmap values were generated from custom scripts written in Python, using functions in the custom "pepars" Python package. Each heatmap uses both an expected (input) distribution of amino acid sequences and an output distribution. The output distribution must be a list of sequences and their count, and the input distribution can be either a list of sequences and their count, or an expected amino acid frequency from a template, such as NNK. For both input and output, the total count of amino acids in each position is tallied in accordance to each sequence's count and then divided by the total sum of counts, giving a frequency of each amino acid at each position. Then, the log 2 fold change is calculated between the output and the input. For amino acids with a count of 0 in either the input or output, no calculation is performed. In order to distinguish between statistically significant amino acid biases, a statistical test was performed using the statsmodels Python library. For the case where there are two amino acid counts, a two-sided, two-proportion z-test was performed; for comparing the output amino acid count to an expected input frequency from a template, a one-proportion z-test was performed. All p-values were then corrected for multiple comparisons using Bonferroni correction. Only bias differences below a significance threshold of 1e-4 are then outlined on the heatmap; all other (insignificant) squares are left empty.

Clustering analysis. Using custom scripts written in MAT-LAB (version R2017b; MathWorks) the reverse Hamming distances representing the number of shared AAs between two peptides was determined. Cytoscape (version 3.7.1[53]) software was then used to cluster the variants. The AA frequency plot representing the highlighted cluster was created using Weblogo (Version 2.8.2). The reverse Hamming distances (representing the number of shared AAs between two peptides) was determined for all unique capsid variants with greater than 10 count and greater than 2.5-fold enrichment after R2 selection. This process iteratively compares each variant with all other variants within the group. Capsid variants were then clustered by their reverse Hamming distances using Cytoscape. The minimum reverse Hamming distance for visualization was chosen manually based on sequence similarity.

For the amino acid frequency plots, the number on the bottom represents the position of the diversified motif starting from 1. The size of the amino acid in the stack reflects the proportion of unique clones in which the AA appears at that specific position in the motif. The color code is based on the AA properties. The positively charged residues K, R, and H are in blue. The negatively charged residues D and E are in red. The amide containing polar residues Q, and N are in magenta. The polar residues T, and S, are in green. The hydrophobic residues A, L, V, I, P, F, M, and W are in black.

Example 3. Multiplexed-CREATE Allows Detailed Characterization of the Capsid Libraries During Round-1 Selection To identify variants that enrich in specific cell types or organs parallel selections across multiple targets were performed, and the enrichment or depletion of each capsid variant across those targets was mapped.

Figure 3:
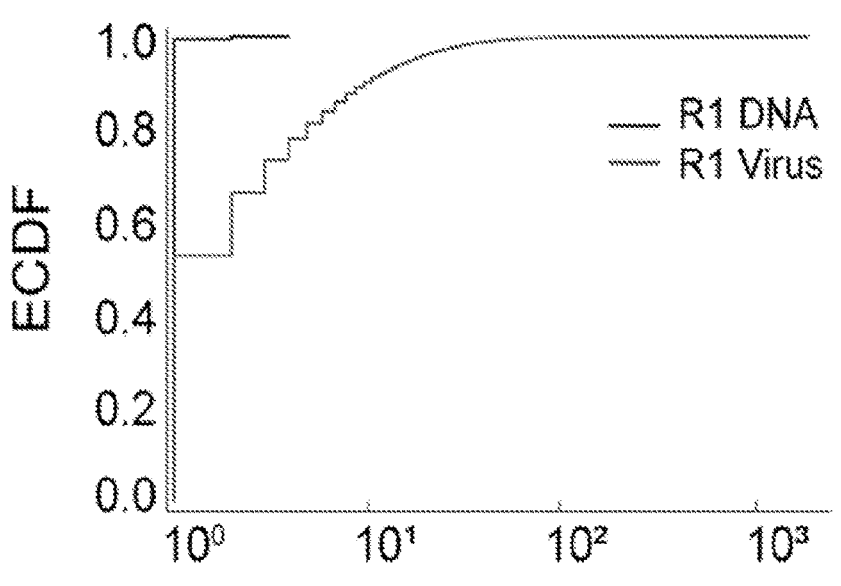
FIG. 3 shows Empirical Cumulative Distribution Frequency (ECDF) of R1 DNA and virus libraries that were recovered by deep sequencing post Gibson assembly and virus production, respectively.
Figure 38:
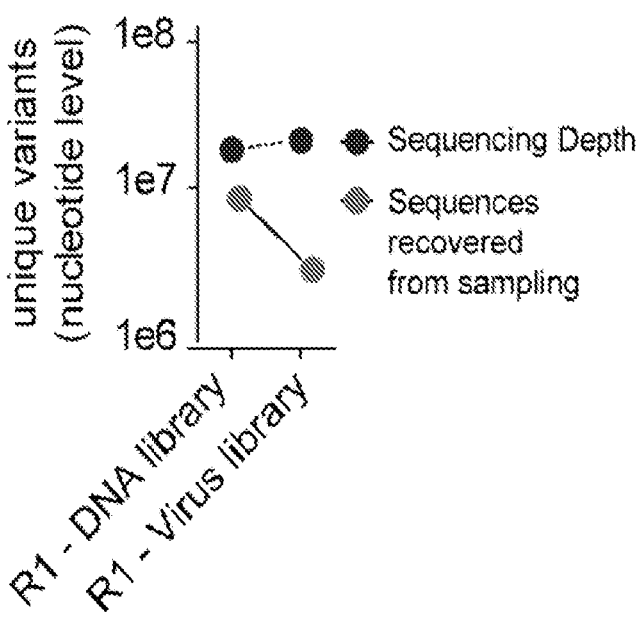
FIG. 38 illustrates the library coverage for R1 DNA and virus libraries obtained from specific sequencing depths.
Figure 39:
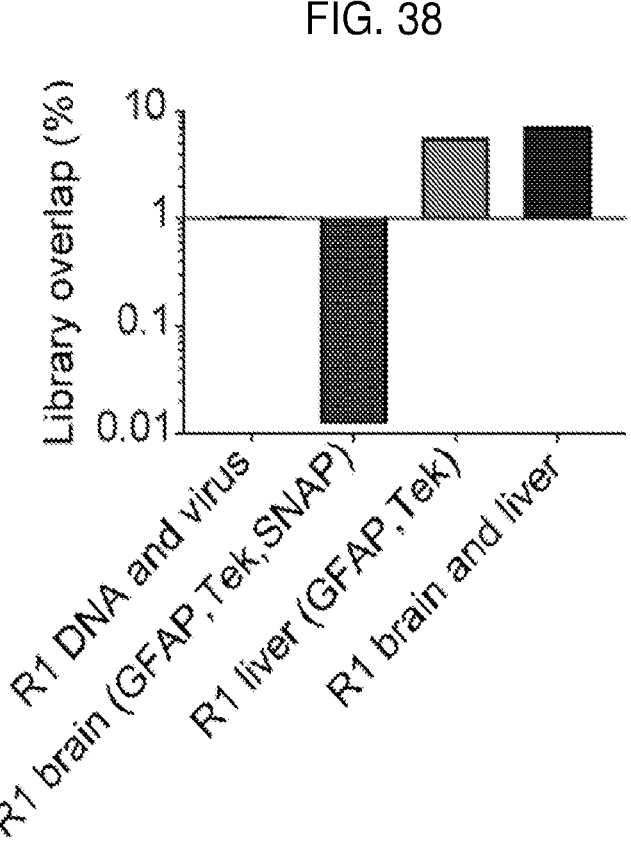
FIG. 39 shows the percentage of variant overlap within the sampled DNA and virus, or across different Cre lines within tissues, or across tissues from R1 selection.

During DNA and virus library generation there is potential for accumulation of biases that over-represent certain capsid variants, obscuring their true enrichment during in vivo selection. These biases may result from PCR amplification bias in the DNA library or sequence bias in the efficiency of virus production across various steps: capsid assembly, genome packaging and stability during purification. This was investigated with the 7-mer-i library, a randomized 7-mer library inserted between positions 588-589 of AAV9 (FIGS. 1 and 2) in rAAV-ΔCap9-in-cis-Lox2 plasmid (FIG. 36). Sequencing libraries after DNA assembly and virus purification to a depth of 10-20 million (M) reads was adequate to capture the bias among variants during virus production (FIG. 3; despite ~1% variant overlap among these libraries; FIGS. 38 and 39), demonstrating that even permissive sites like 588-589 will impose biological constraints on sampled sequence space. The DNA library had a uniform distribution of 9.6 M unique variants within ~10 M total reads (read count (RC) mean=1.0, S.D.=0.074), indicating minimal bias. In contrast, the virus library had 3.6 M unique variants within ~20 M depth (RC mean=4.59, S.D.=11.15) indicating enrichment of a subset of variants during viral production.

For in vivo selection, the 7-mer-i viral library was intravenously injected at a dose of $2 \times 10^{11}$ vg per adult transgenic mouse expressing Cre in different brain cell types: GFAP-Cre mice for astrocytes, SNAP25-Cre mice for neurons, and Tek-Cre mice for endothelial cells (n=2 mice per Cre transgenic line, see Methods). Two weeks after intravenous (IV) injection, the brain and liver tissues were harvested, with the latter serving as a control organ since AAV9 transduces it with high efficiency. The rAAV genomes were extracted from tissues and the capsids that transduced Cre-expressing cells were selectively amplified (FIGS. 40-44). Upon deep sequencing, $\sim 8 \times 10^4$ unique nucleotide variants recovered from brain tissues and <50 variants in spinal cords (~48% of which were identified in virus library) were observed across the transgenic lines, and each variant was represented with an enrichment score reflecting the

| Design Parameters | Synthetic pool design | PCR pool design |
| --- | --- | --- | change in relative abundance between the brain and the starting virus library (FIG. 4).

Two features of this dataset stand out. First, the recovered variants in brain tissue were disproportionately represented among the fraction of the transformed capsid library observed by sequencing after viral production demonstrating how production biases skew selection results. Second, the distribution of capsid read counts (RCs) revealed that more than half of the unique recovered variants after selection appear at remarkably low read counts. These variants may either be unintended mutants from experimental manipulation or AAV9-like variants with low basal level of CNS transduction (FIG. 40).

Example 4. A Novel Round-2 Library Design Improves the Selection Outcome

Concerned that the sequence bias during viral production and recovery would propagate across selection rounds despite post-hoc enrichment scoring, an unbiased library was designed based on the round-1 (R1) output (synthetic pool library) via oligo pools (Twist Bioscience). This library was compared to a library PCR amplified directly from the recovered R1 DNA (PCR pool library) (FIG. 5, Table 7).

Table 7: Comparison between the two methods for R2 selection. The table summarizes the pros and cons of selection design parameters by the synthetic pool and PCR pool R2 selection methods.

| Carryover of R1 selection bias among variants | No, likelihood of false positives is low | Yes, potential to minimize by normalization |
|---|---|---|
| Carryover of R1 selection induced mutants | No | Yes |
| Confidence in library performance | High, using alternate codon replicates | Low |
| Customize library or add internal controls | Yes, in an unbiased manner | Yes, with greater risk of bias |
| Control library size | Yes, without reducing libraries or pooling | Yes, with libraries reduced for pooling |
| Cost for R2 library generation | High | Low |

The synthetic pool library design comprised: (1) equimolar amounts of ~8950 capsid variants present at high read counts in at least one of the R1 selections from brain and spinal cord (FIG. 40); (2) alternative codon replicates of those ~8950 variants (optimized for mammalian codons) to reduce false positives; and (3) a "spike-in" library of controls (FIGS. 74 and 75), resulting in a total library size of 18,000 nucleotide variants.

Figure 7:
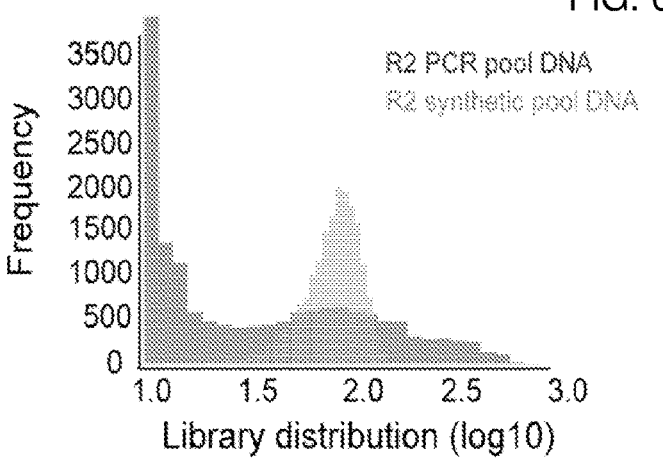
FIG. 7 shows histograms of DNA and virus libraries from the two methods, where the variants in a library are binned by their read counts (in log 10 scale) and the height of the histogram is proportional to their frequency.
Figure 46:
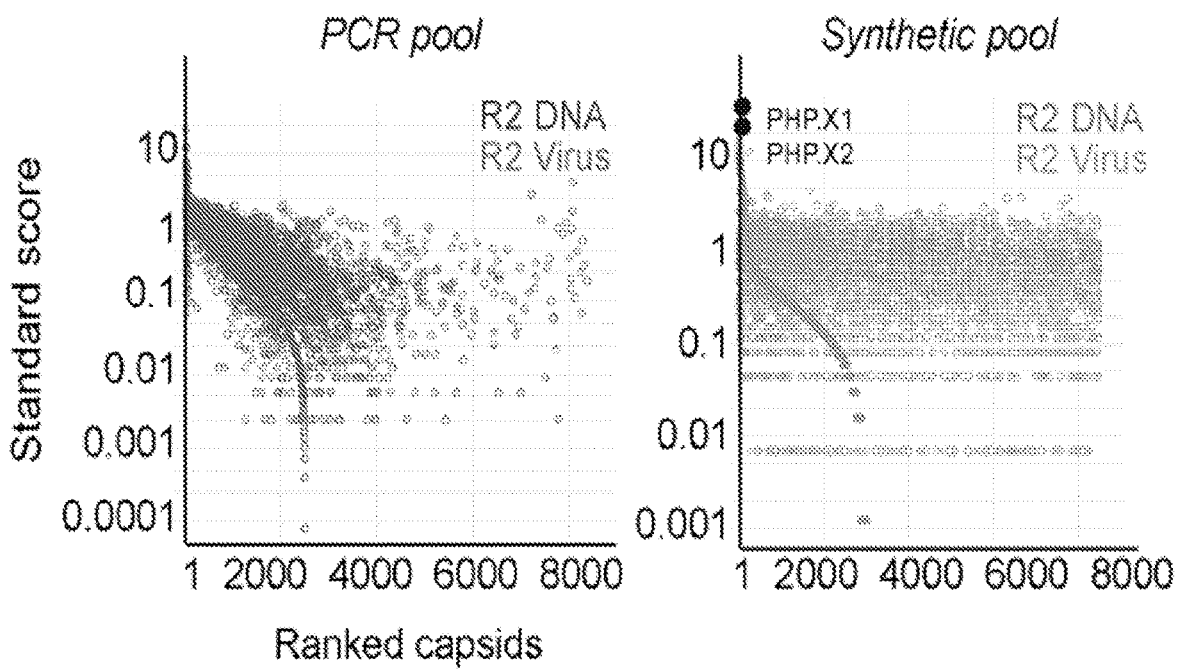
FIG. 46 shows distributions of the DNA and virus libraries produced by the synthetic pool and PCR pool methods by the standard score of NGS read counts. The variants in virus libraries are sorted by the decreasing order of standard score and their scores from respective DNA libraries are mapped onto them.
Figure 47:
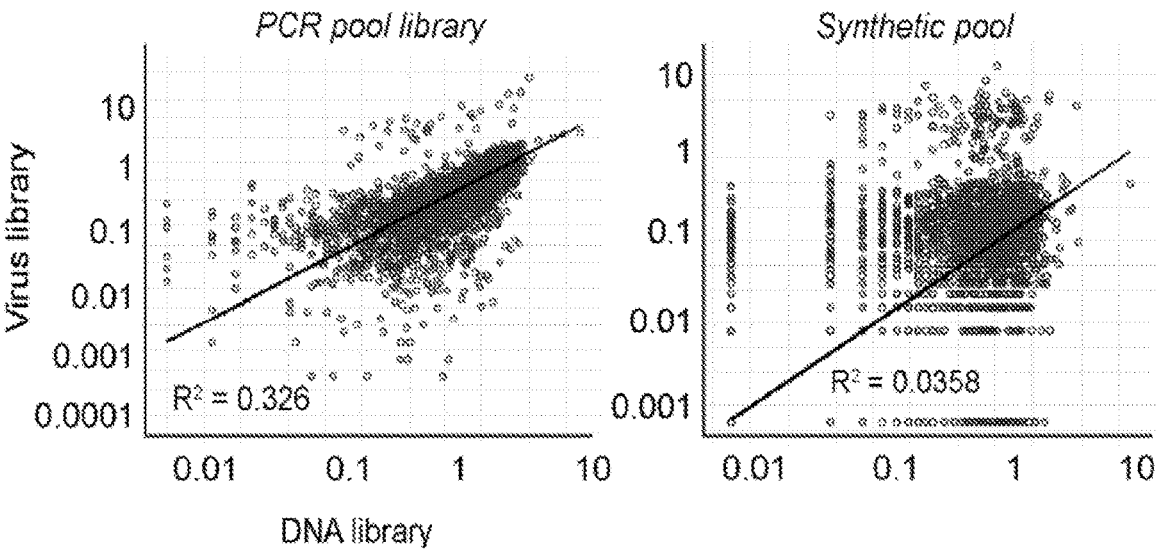
FIG. 47 shows correlations between the standard scores of read counts for the DNA and virus libraries (n=1 per library) produced by the synthetic pool and PCR pool methods is determined by linear least-squares regression, and the regression line (best fit) and R2 representing the coefficient of determination.

As anticipated, both round-2 (R2) virus libraries produced a high titer (~6×10$^{11}$ vg per 10 ng of R2 DNA library per 150 mm dish; FIG. 45), and ~99% of variants from the R2 DNA were found after viral production (FIG. 6). However, the distribution of the DNA and virus libraries from both designs differed significantly. The PCR pool library carries forward the R1 selection biases (FIGS. 7, 46, and 47) where the abundance reflects prior enrichment across tissues in R1 as well as bias from viral production and sample mixing. Comparatively, the synthetic pool DNA library is more evenly distributed, minimizing bias amplification across selection rounds.

Figure 8:
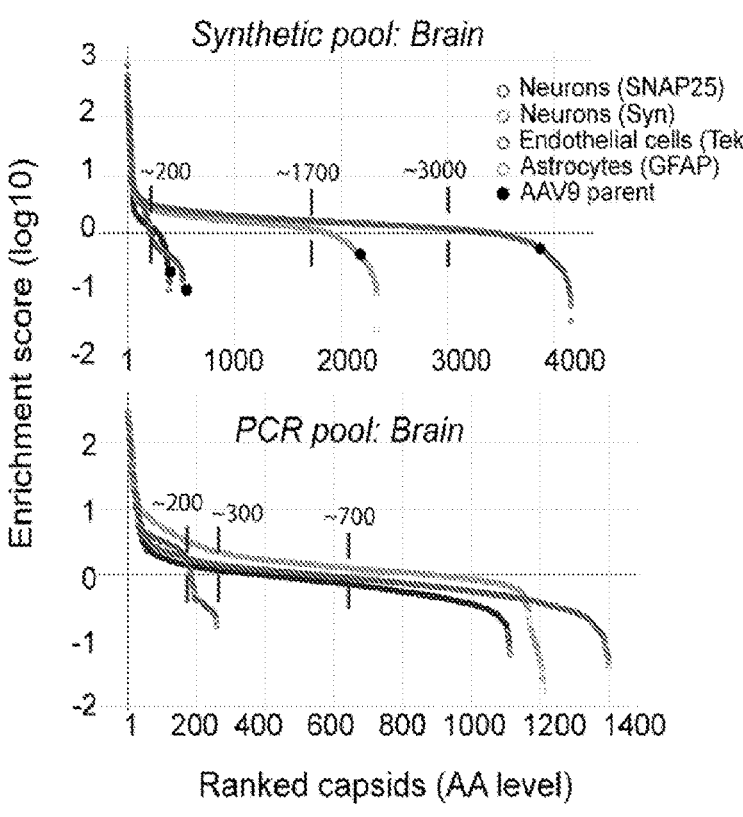
FIG. 8 shows distributions of R2 brain libraries from all Cre transgenic lines (n=2 mice per Cre Line, mean is plotted) and both methods, where the libraries are sorted in decreasing order of enrichment score (log 10 scale). The total number of positively enriched variants from these libraries are highlighted by dotted straight lines and AAV9's relative enrichment is mapped on the synthetic pool plot.
Figure 48:
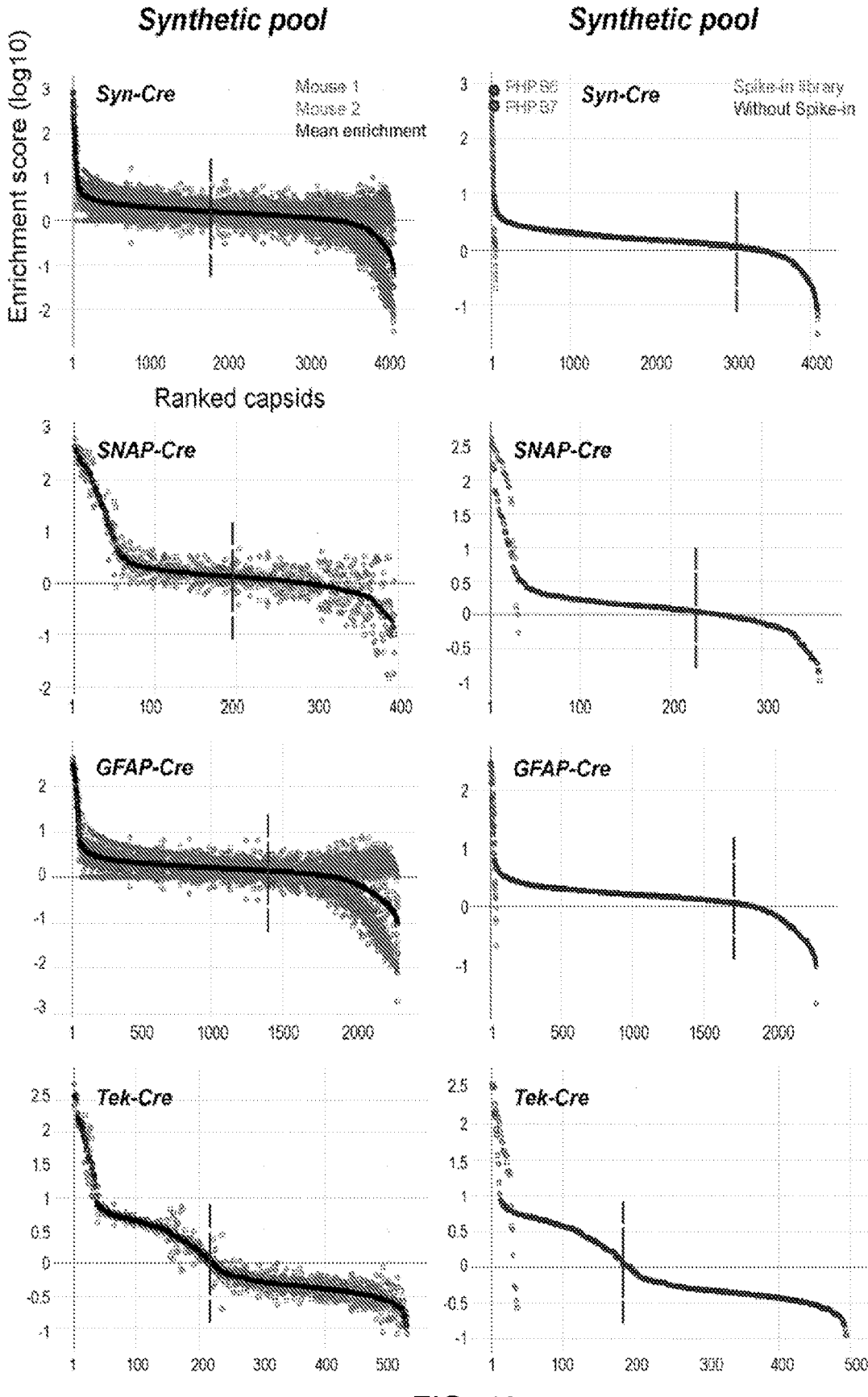
FIG. 48 shows distributions of capsid libraries from brain tissue of two mice used in each Cre line selection, as produced by the synthetic pool (left) and PCR pool (right) designs. The distribution of spike-in library introduced in the synthetic pool library design is shown at center.
Figure 48:
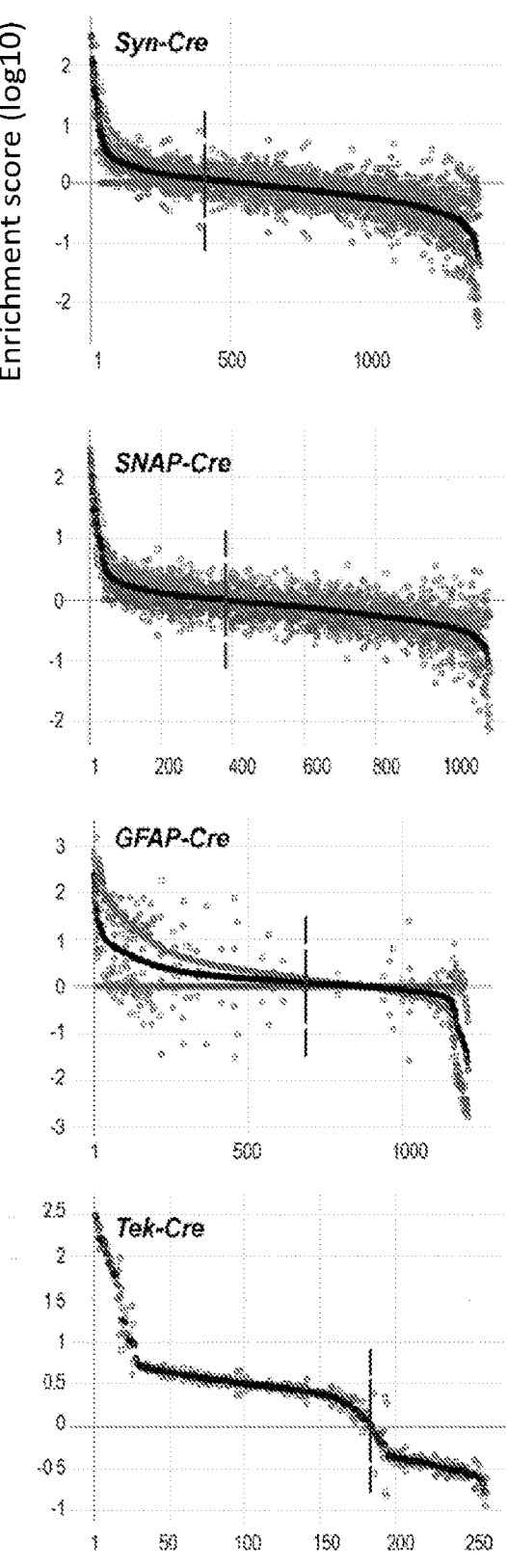

For in vivo selection, a dose of 1×10$^{12}$ vg per adult transgenic mouse was administered into three of the previously used lines (n=2 mice per Cre transgenic line—GFAP, SNAP25, Tek), as well as the Syn-Cre line (for neurons). Two weeks after IV injection, rAAV genomes from brain samples were extracted, selectively amplified, and deep sequenced (as in R1). The synthetic pool library produced a greater number of positively enriched capsid variants than the PCR pool brain library (e.g. ~1700 versus ~700 variants/tissue library at amino acid (AA) level in GFAP-Cre) (FIGS. 8 and 48). In the synthetic pool, ~90% of the variants from the spike-in library were positively enriched as expected (FIG. 48, middle panel; FIG. 74).

Figure 9:
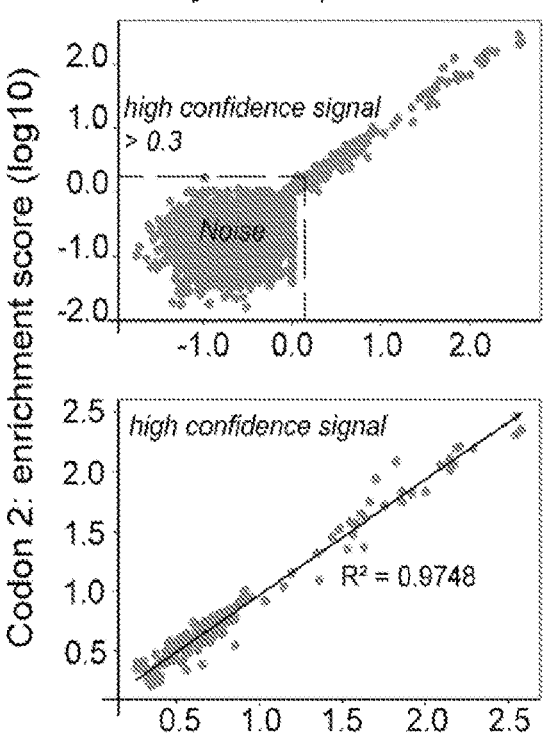
FIG. 9 shows a comparison of the enrichment scores (log 10 scale) of two alternate codon replicates for 8462 variants from the Tek-Cre brain library (n=2 mice, mean is plotted). The broken line separates the high-confidence signal (>0.3) from noise. For the high-confidence signal (below), a linear least-squares regression is determined between the 2 codons and the regression line (best fit). The coefficient of determination R2 is shown.
Figure 50:
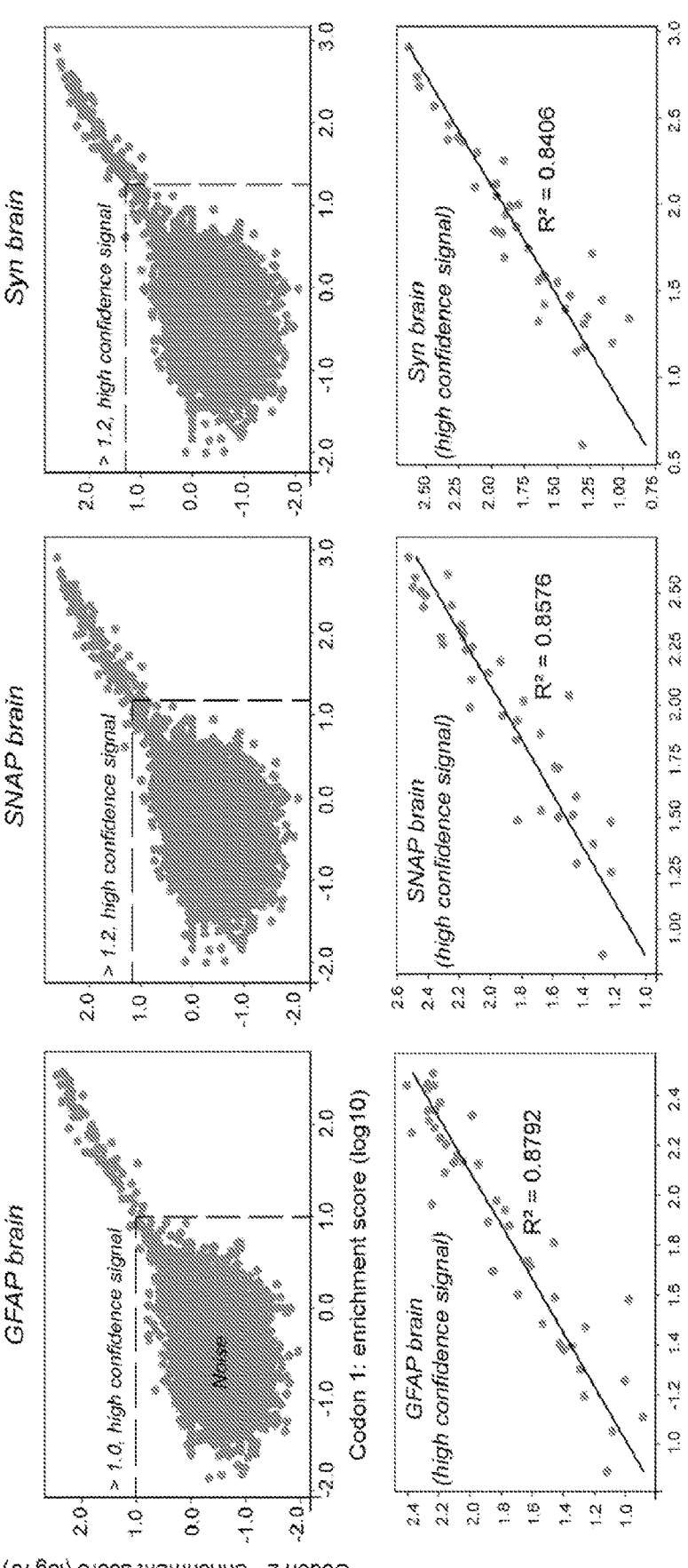
FIG. 50 shows correlation analysis between the enrichment score (log 10) of two alternate codon replicates of variants from the GFAP-Cre (left), SNAP-Cre (center), and Syn-Cre (right) brain libraries by linear least-squares regression (n=2 per Cre line, mean is plotted). The dotted line separates the high-confidence signal from noise. High confidence signal (below) is assessed by a linear regression line (best fit) and R2 represents the coefficient of determination.
Figure 51:
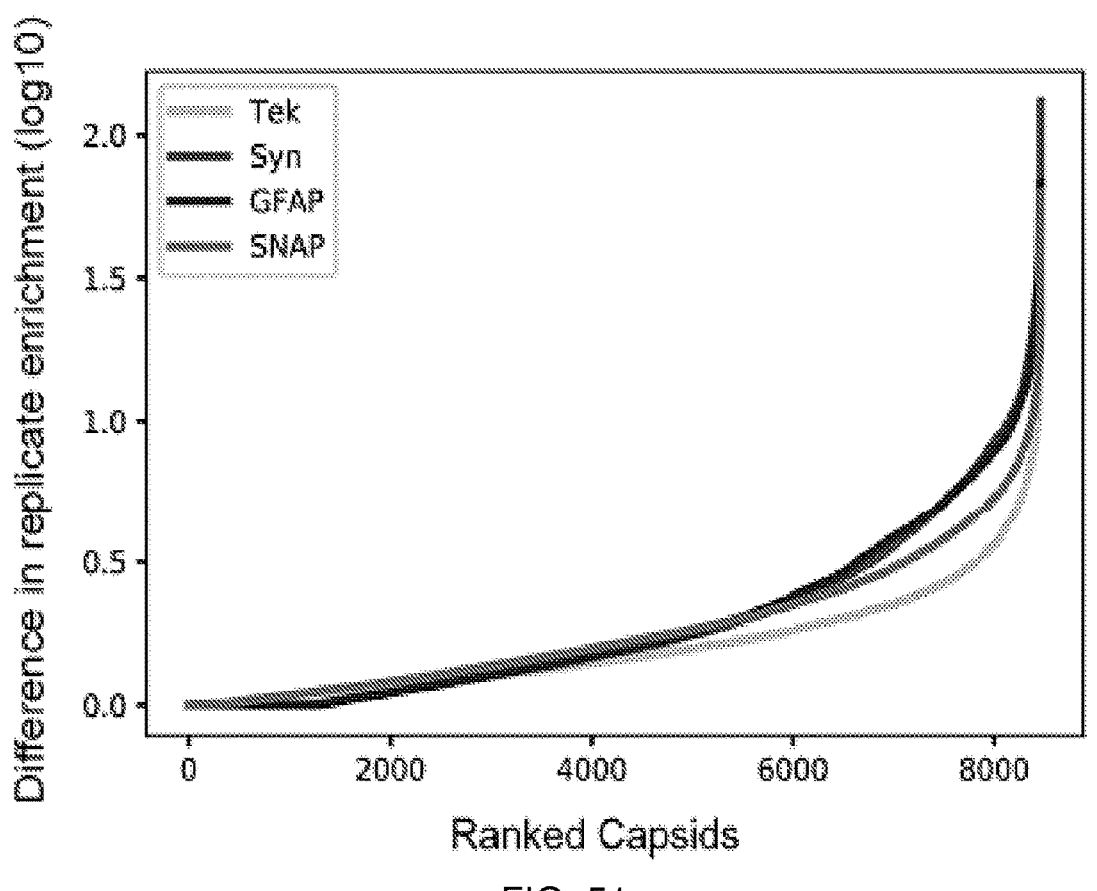
FIG. 51 shows the difference in enrichment score between the two codon replicates of a variant, across different brain libraries, with over 8000 variants recovered in replicates.

The degree of correlation for enrichment scores of variants recovered from both PCR and synthetic pool libraries varies in each Cre transgenic line, demonstrating the presence of noise within experiments (FIG. 49). The synthetic pool's codon replicate feature addresses this predicament by pinpointing the level of enrichment needed within each selection to rise above noise (FIGS. 9, 50, and 51). This is a significant advantage over the PCR pool design, allowing researchers to confidently interpret enrichment scores in a given selection.

The degree of enrichment at which correlation breaks down appears to vary with Cre-line. A downside of PCR pool is that there is no way to tell whether it or synthetic pool is the more 'true' enrichment score or even that there may be cause for concern regarding certain enrichment values. The correlation among positively enriched variants between the two methods was found to improve with the magnitude of positive enrichment. For each experiment there is a level of enrichment below which the scores become irreproducible, or noisy. FIG. 50 demonstrates that neither PCR pool nor Synthetic pool is inherently more 'true' at lower enrichment scores. This is because Synthetic pool methodology with its codon replicates has a self-contained control to determine an enrichment level below which enrichment value has no further predictive power. The term 'noise' has been used herein to refer to regions of enrichment in a particular experiment below which values lose their reproducibility and predictive power. Being able to experimentally determine enrichment signal above noise allows researchers to focus their attention and data analyses on enrichment levels that are internally reproducible and thereby avoid selecting false positive variants or drawing invalid conclusions.

Thus, if one is interested in only the highest enriched variants for a particular tissue, PCR pool design coupled with enrichment normalization to virus library may not drastically differ from synthetic pool design over one additional round of selection for a subset of in vivo selections (such as Tek-Cre or SNAP-Cre). Without additional validation, however, it is difficult to predict whether a given in vivo system will perform akin to Tek-Cre. This becomes critical in a multiplexed selection study where target-specific variants may not garner the highest enrichments in one particular in vivo selection.

Example 5. Analysis of AAV Capsid Libraries After Round-2 Selections

Figure 10:
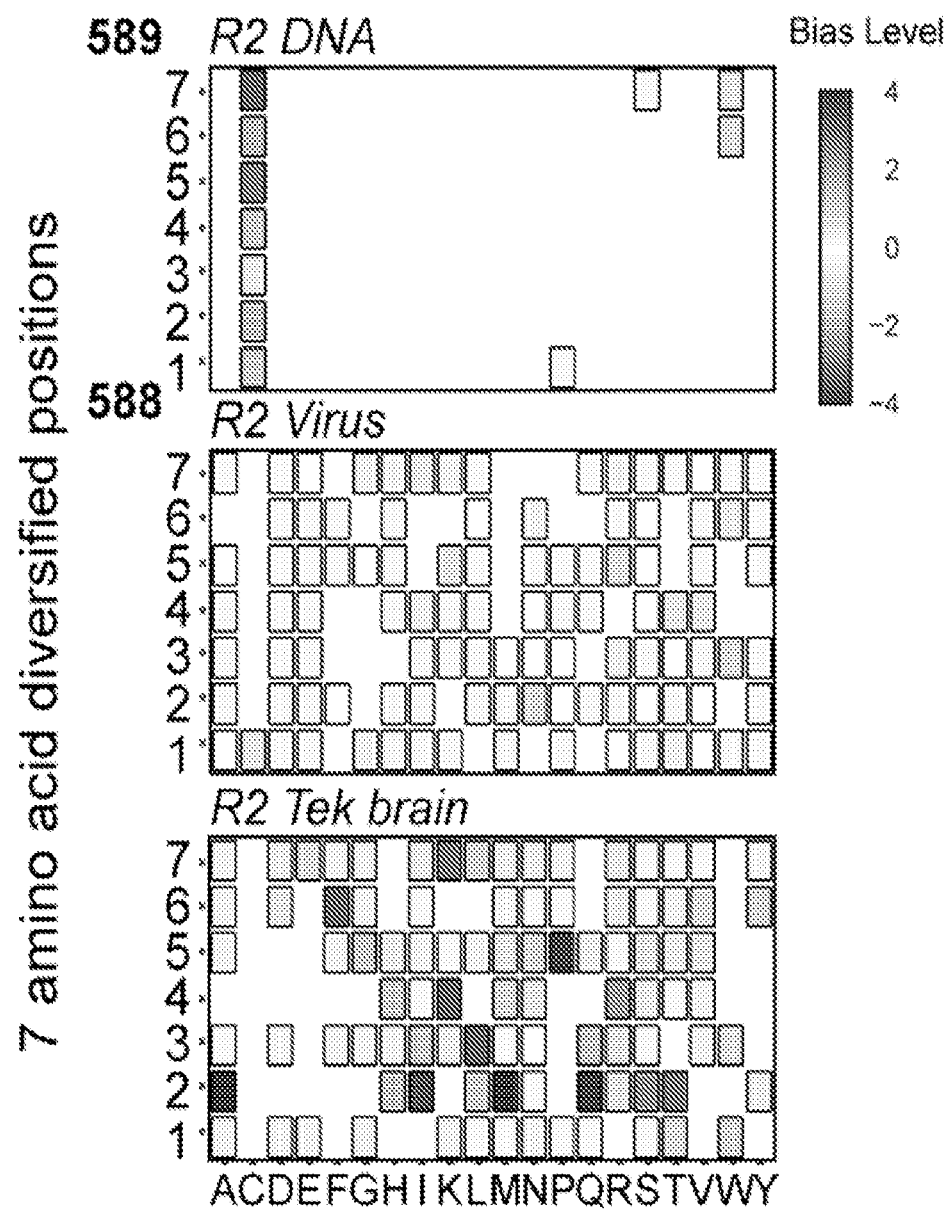
FIG. 10 shows heatmaps representing the magnitude (log 2 fold change) of a given AA's relative enrichment or depletion at each position given statistical significance is reached (boxed if P-value≤0.0001, two-sided, two-proportion z-test, p-values corrected for multiple comparisons using Bonferroni correction). R2 DNA normalized to oligopool (top, ~9000 AA sequences), R2 virus normalized to R2 DNA (middle, n=~9000 sequences), R2 Tek brain library with enrichment over 0.3 (high-confidence signal) from synthetic pool method normalized to R2 virus (bottom, 154 sequences) (n=2 for brain library, one per mouse. All other libraries, n=1).
Figure 52:
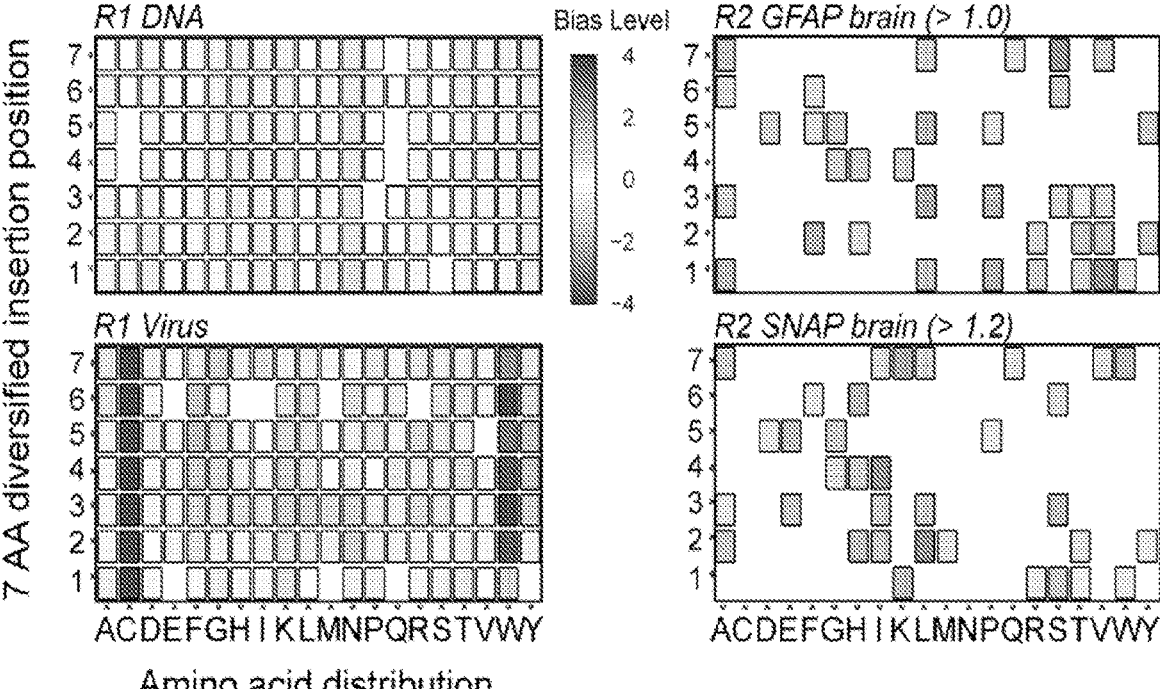
FIG. 52 shows heatmaps represent the magnitude (log 2 fold change) of AA bias in "output" library 1 normalized to "input" library 2 that reach statistical significance (boxed if P-value≤0.0001, two-sided, two-proportion z-test, except in R1 DNA normalized to known NNK template where one-proportion z-test was performed, and P-values corrected for multiple comparisons using Bonferroni correction). R1 DNA library normalized to NNK template (top left, ~9 million sequences), R1 virus normalized to R1 DNA libraries (bottom left, ~10 million sequences), R2 GFAP library with enrichment score above 1.0 in brain normalized to R2 virus (top right, 20 sequences,) and R2 SNAP library with enrichment score above 1.2 normalized to R2 virus (bottom right, 17 sequences) are shown (n=1 for DNA, virus, and n=2 for brain libraries).

Whereas the AA distribution of the DNA library closely matched the Oligopool design, virus production selected for a motif with Asn (N) at position 2, β-branched AAs (I, T, V) at position 4, and positively charged AAs (K, R) at position 5 (FIGS. 10, 52). Fitness for BBB crossing resulted in a very different pattern. In comparison to the R2 virus library, highly enriched variants share preferences, for example, proline (P) in position 5, and phenylalanine (F) in position 6.

Figure 11:
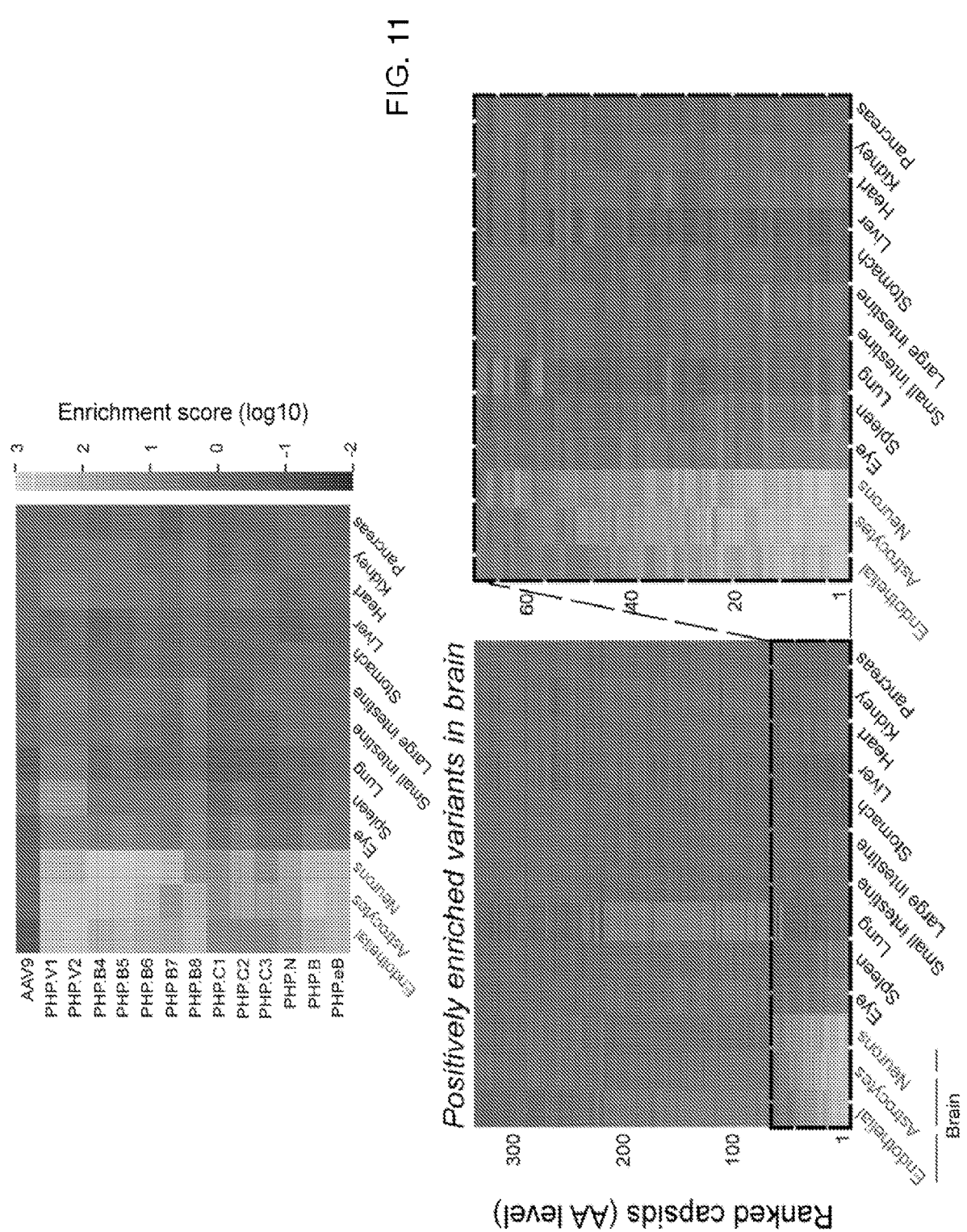
FIG. 11 shows heatmaps of Cre-independent relative enrichment across organs (n=2 mice per Cre line, mean across 6 samples from 3 Cre lines is plotted) for variants enriched in the brain tissue of at least one Cre-dependent synthetic pool selection (lighter text, n=2 mice per cell-type, mean is plotted) (left). Zoom-in of the most CNS-enriched variants (middle), and of the variants that are characterized in the current study along with spike-in library controls (right) are shown.

The distribution of the positively enriched variants from brain across all peripheral organs was then determined (FIG. 11, left). About 60 variants that are highly enriched in brain are comparatively depleted across all other organs (FIG. 11, middle). Encouraged by the expected behavior of spike-in control variants (AAV9, PHP.B, PHP.eB), eleven novel variants were chosen for further validation (FIG. 11, right), including several that would have been overlooked if the choice had been based on PCR pool or CREATE (Table 8).

TABLE 8

Ranking of AAV-PHP capsids across methods.Ranks of selected variants
among all capsids recovered from R2 Tek-Cre selection by synthetic pool enrichment score
(representing M-CREATE), PCR pool enrichment score (representing closer to M-CREATE), or
PCR pool read counts (representing CREATE), the highest ranks of which starts from 1, and
"Not recovered" represent absence of the variant from R2 sequencing data.

| AAV Variants | Synthetic pool enrichment rank | PCR pool enrichment rank | PCR pool read count rank |
|---|---|---|---|
| PHP.V1 | 1 | 4 | 3 |
| PHP.V2 | 2 | 1 | 1 |
| PHP.B4 | 4 | 10 | 56 |
| PHP.B7 | 6 | 13 | 36 |
| PHP.B8 | 3 | 7 | 23 |
| PHP.C1 | 13 | 34 | 74 |
| PHP.C2 | 12 | 20 | 293 |
| PHP.C3 | 16 | Not recovered | Not recovered |

Figure 12:
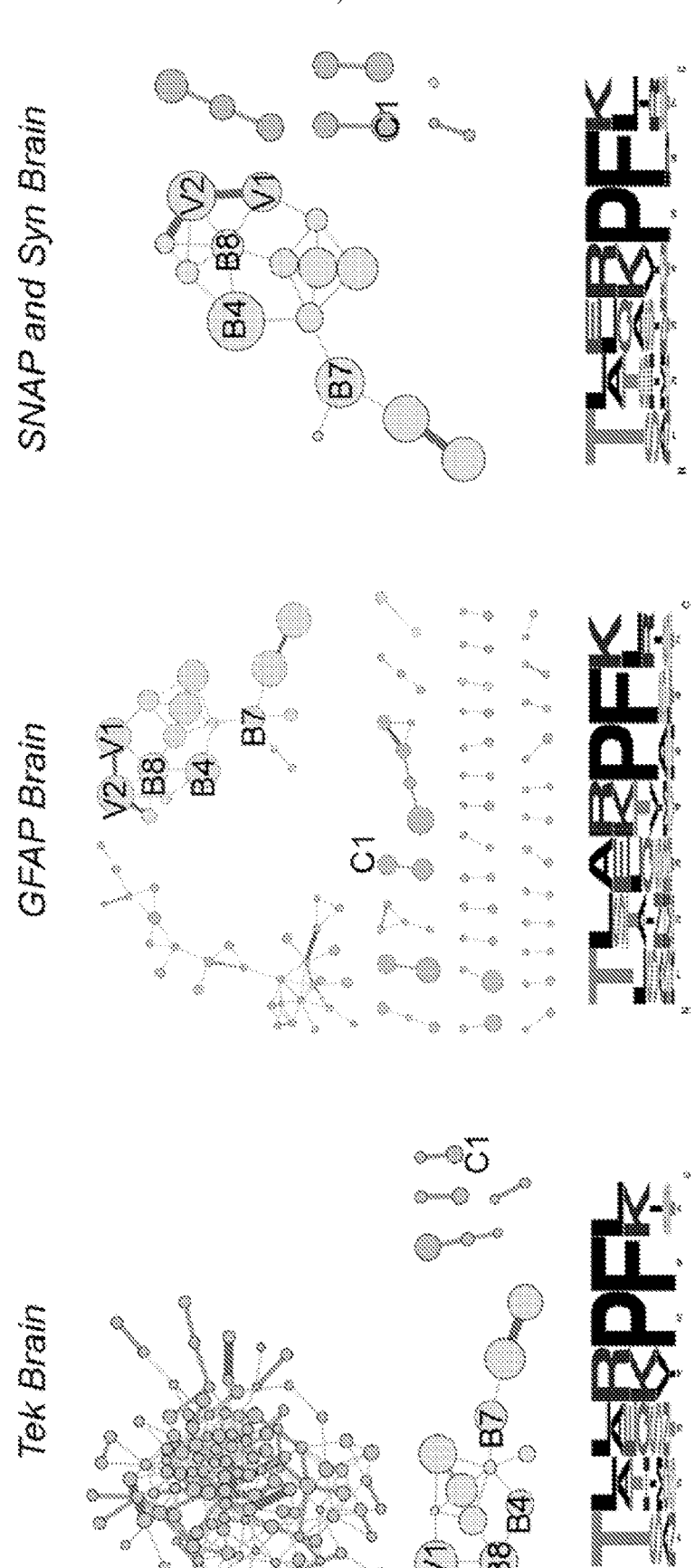
FIG. 12 shows clustering analysis of variants from synthetic pool brain libraries after enrichment in Tek-Cre (left), GFAP-Cre (middle), and combined SNAP-Cre and Syn-Cre (right) selections. Size of nodes represents relative enrichment in brain. Thickness of edges (connecting lines) representing degree of relatedness. Distinct families (yellow) with the corresponding AA frequency logos (AA size represents prevalence and color encodes AA properties).
Figure 53:
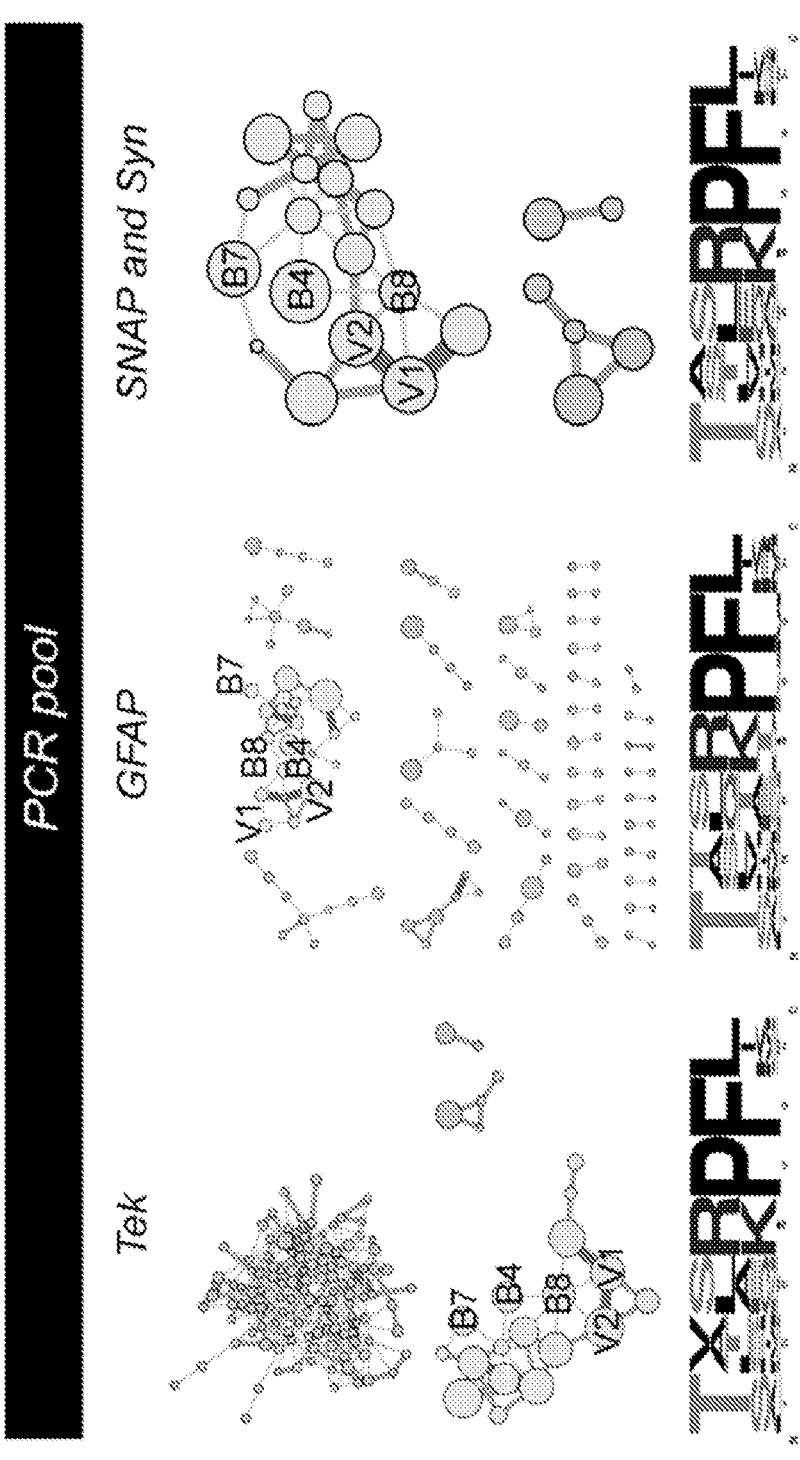
FIG. 53 shows clustering analysis of positively enriched variants from Tek, GFAP, and combined neuron brain libraries (SNAP and Syn) by PCR pool design, and by synthetic pool design with spike-in library are shown with size of nodes representing their relative enrichment in brain, and the thickness of edges (connecting lines) representing the extent of shared AA identity between nodes. A distinct family is highlighted in yellow with the corresponding AA frequency logo below (AA size reflects prevalence and color coded based on AA properties).

These variants were chosen due to their enrichments and where they fall in sequence space. The positively enriched variants were found to cluster into distinct families based on sequence similarity. In agreement with the heatmaps discussed above, the most enriched variants form a distinct family across selections that share a common motif: T in position 1, L in position 2, P in positive 5, F in position 6, and K or L in position 7 (FIGS. 12, 53). This AA pattern closely resembles the previously identified variant, AAV-PHP.B—TLAVPFK. Given the sequence similarity among members, we predicted that they may similarly cross the BBB and target the central nervous system.

The ability to twice recover the AAV-PHP.B sequence family from completely independently constructed and selected libraries confirms that the viral library's sequence space coverage was broad enough to recover a family of variants sharing a common motif. Unlike CREATE which identified only one variant, AAV-PHP.B, M-CREATE yielded a diverse PHP.B-like family that hints toward important chemical features of this motif. The sequence diversity within this family suggests that isolating AAV-PHP.B was not simply good fortune in previous experiments (considering a theoretical starting library size of ~1.3 billion), and that this is a dominant family for this particular experiment.

Figure 14:
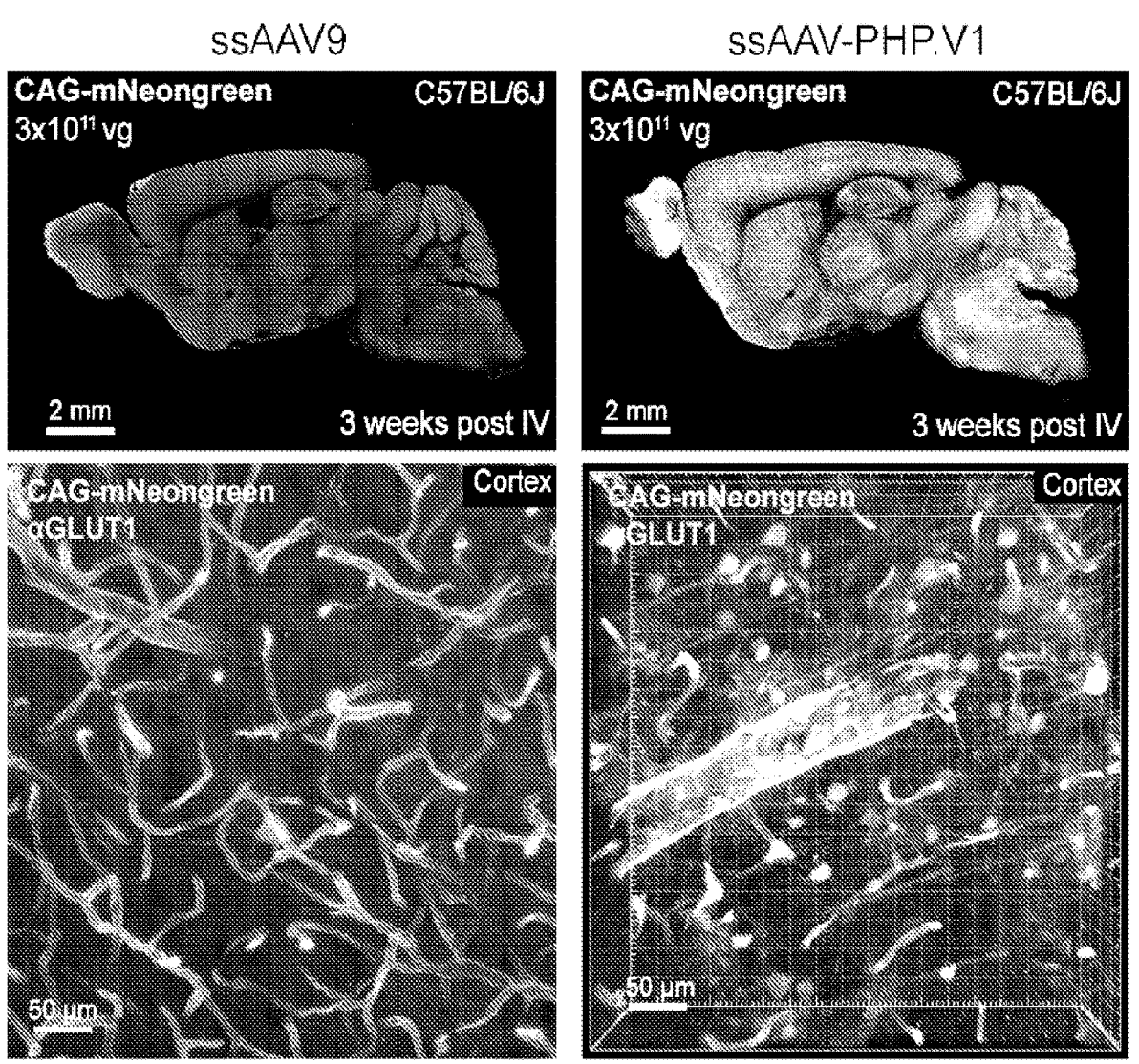
FIG. 14 shows AAV9 (left) and AAV-PHP.V1 (right) mediated expression using ssAAV:CAG-mNeongreen genome (n=3, 3 weeks of expression in C57BL/6J adult mice with $3×10^{11}$ vg IV dose/mouse). The images were acquired under same microscope settings as that of the sagittal sections of brain (top) with higher magnification image from cortex (bottom). αGLUT1 antibody staining was used in the image to show vasculature.
Figures 16, 17:
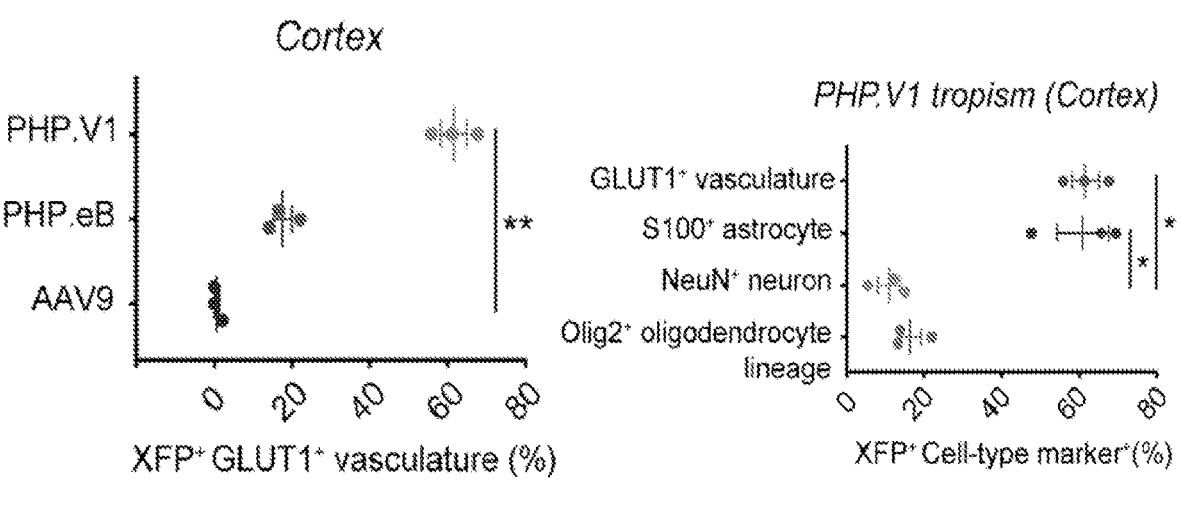
FIG. 16 shows percentage of vasculature stained with αGLUT1 that overlaps with mNeongreen (XFP) expression in cortex. One-way ANOVA non-parametric Kruskal-Wallis test (P-value 0.0036), and follow-up multiple comparisons using uncorrected Dunn's test (P-value of 0.0070 for AAV9 vs PHP.V1) are reported. **$P≤0.01$ is shown, P>0.05 is not shown; data is mean±S.E.M, n=3 mice per AAV variant, cells quantified from 2-4 images per mouse per cell-type.
FIG. 17 shows percentage of cells stained with each cell-type specific marker (αGLUT1, αS100 for astrocytes, αNeuN for neurons, αOlig2 for oligodendrocyte lineage cells) that overlaps with mNeongreen (XFP) expression in cortex. Kruskal-Wallis test (P-value of 0.0078), and uncorrected Dunn's test (P-value of 0.0235 for neuron vs vascular cells, and 0.0174 for neuron vs astrocyte, respectively) are reported. *P 0.05 is shown, and P>0.05 is not shown; data is mean±S.E.M, n=3 mice, cells quantified from 2-4 images per mouse per cell-type.
Figure 54:
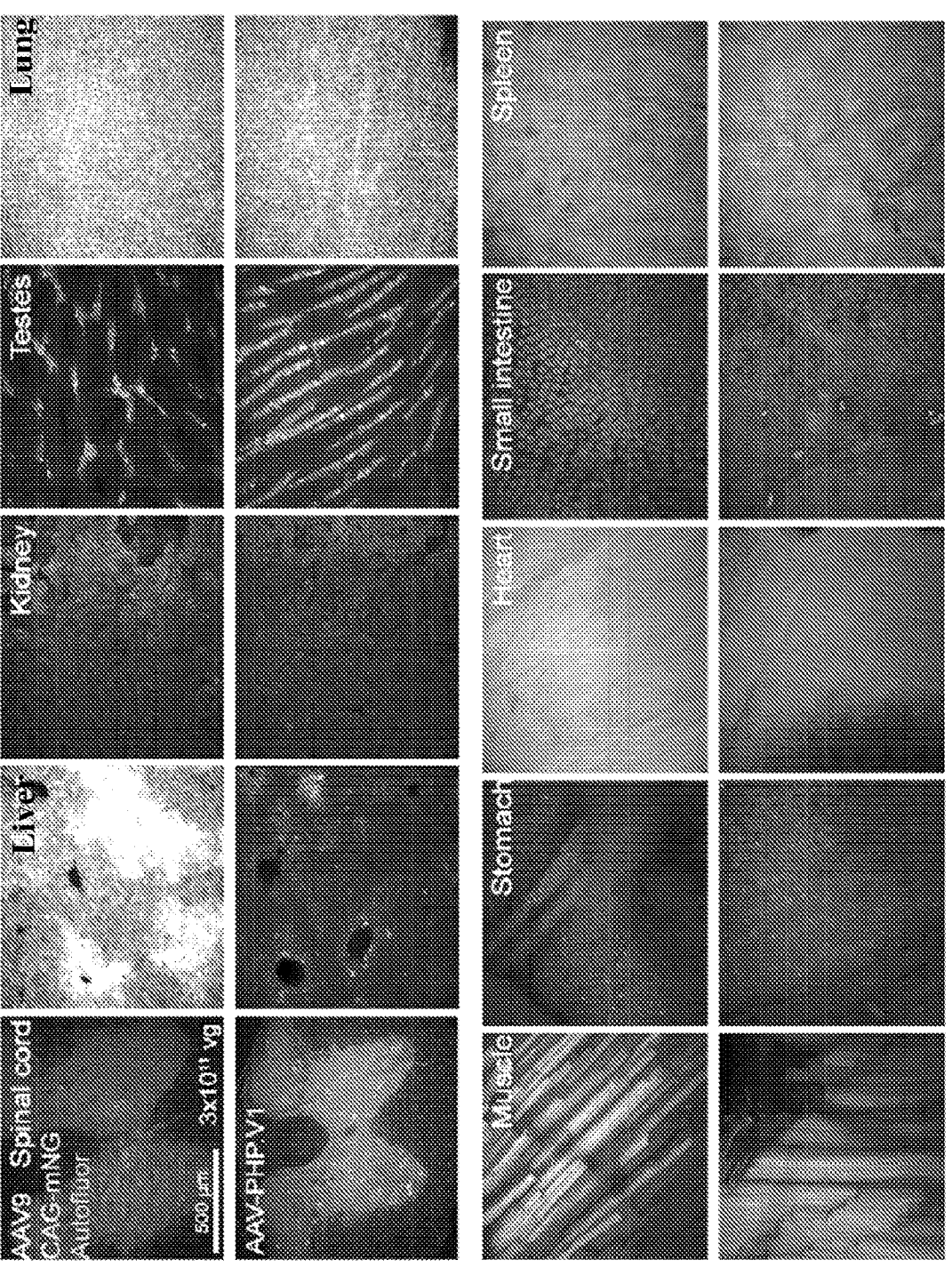
FIG. 54 shows expression of AAV9 (top row) and AAV-PHP.V1 (bottom row) packaging CAG promoter driving mNeonGreen across all organs (n=3, $3\times10^{11}$ vg dose per adult C57BL/6J mouse, 3 weeks of expression).
Figure 55:
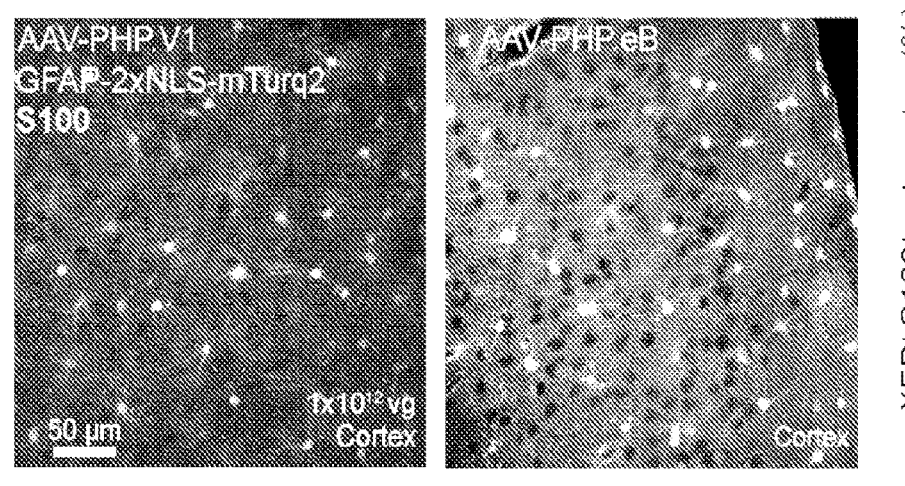
FIG. 55 shows expression in cortical astrocytes (S100+) after IV delivery of AAV-PHP.V1 (left) and AAV-PHP.eB (right) capsids carrying the GfABC1D promoter driving expression of nuclear-localized mTurquoise2 reporter ($1\times10^{12}$ vg dose per adult mouse, 4 weeks of expression). Percentage of cortical S100+ cells that overlapped with mTurquoise2 expression is quantified (n=2, each data point is mean from 3 images per mouse).

Example 6. Capsid Recovery from Round-2 Selection Yields a Pool of AAV9 Variants with Enhanced BBB Entry and CNS Ttransduction Given the dominance of the PHP.B-family in this particular selection, the most enriched member was tested: TALKPFL (FIGS. 12 and 13) henceforth referred to as AAV-PHP.V1. Somewhat surprisingly given its sequence similarity to AAV.PHP.B, the tropism of AAV-PHP.V1 is biased toward transducing brain vascular cells (FIGS. 14, 54). When delivered intravenously, AAV-PHP.V1 carrying a fluorescent reporter under the control of the ubiquitous CAG promoter transduces ~60% of GLUT1+ cortical brain vasculature compared to ~20% with AAV-PHP.eB and almost no transduction with AAV9 (FIGS. 14 and 16). In addition to the vasculature, AAV-PHP.V1 also transduced ~60% of cortical S100+ astrocytes (FIG. 17). However, AAV-PHP.V1 is not as efficient for astrocyte transduction as the previously reported AAV-PHP.eB (when packaged with an astrocyte specific GfABC1D promoter, FIG. 55).

Figure 15:
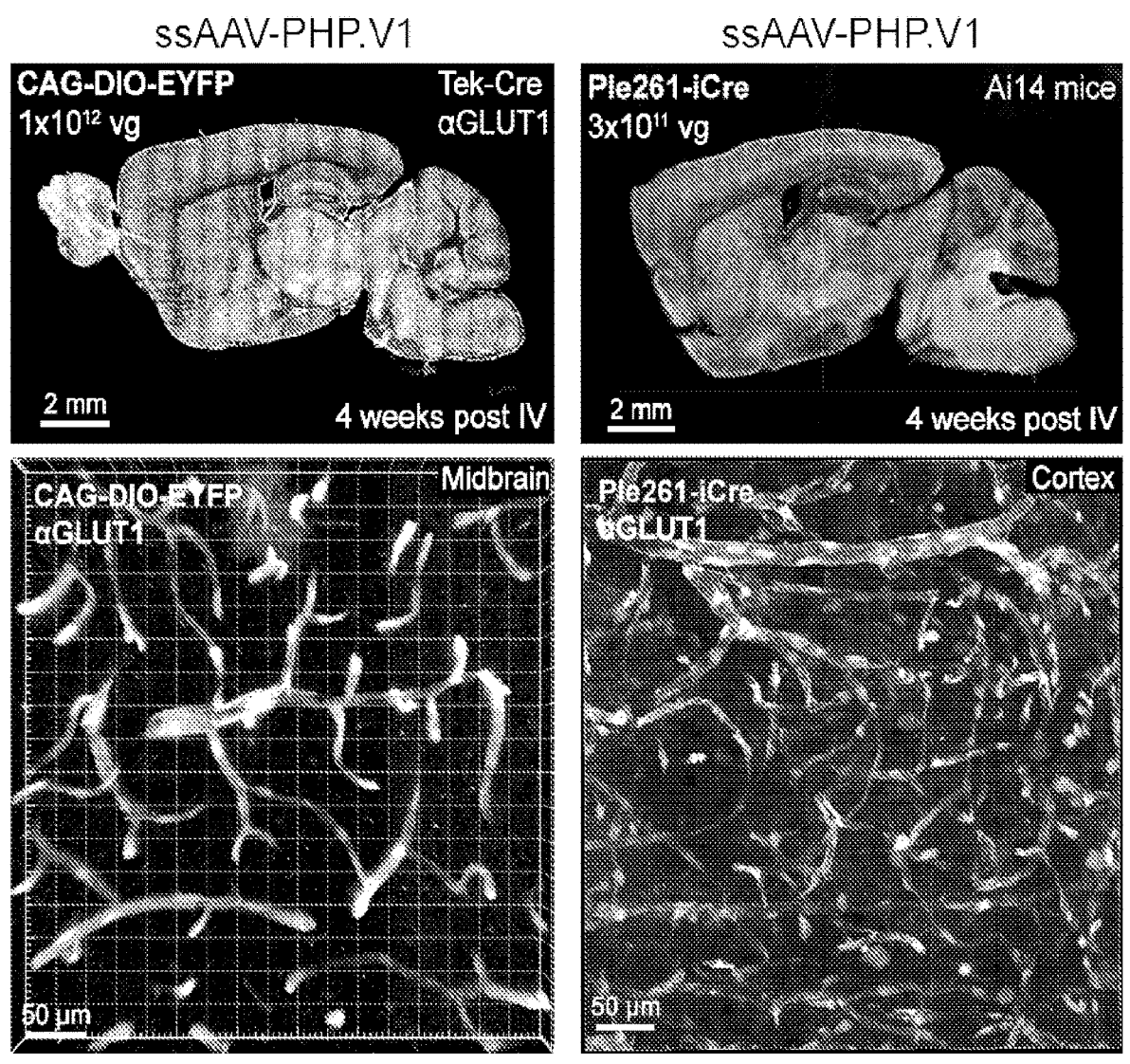
FIG. 15 shows vascular transduction by ssAAV-PHP.V1: CAG-DIO-EYFP in Tek-Cre adult mice (left) (n=2, 4 weeks of expression, $1×10^{12}$ vg IV dose/mouse), and by ssAAV-PHP.V1:Ple261-iCre in Ai14 reporter mice (right) (n=2, 3 weeks of expression, $3×10^{11}$ vg IV dose/mouse). Tissues are stained with αGLUT1.
Figures 18, 19:
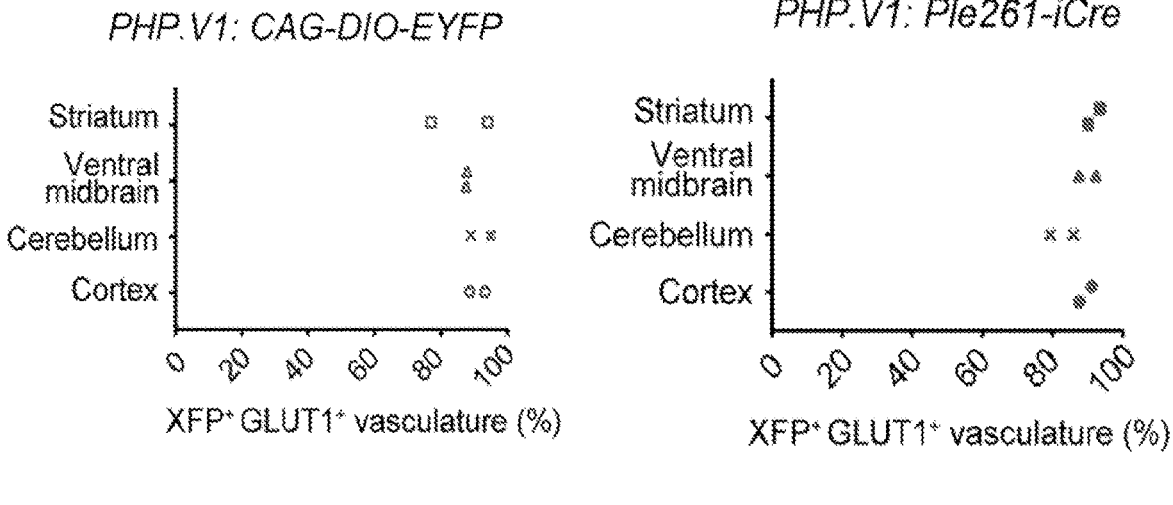
FIG. 18 shows efficiency of vascular transduction (as described in FIG. 16) in Tek-Cre mice (n=2, mean from 3 images per mouse per brain region).
FIG. 19 shows efficiency of vascular transduction in Ai14 mice (n=2, a mean from 4 images per mouse per brain region).
Figure 56:
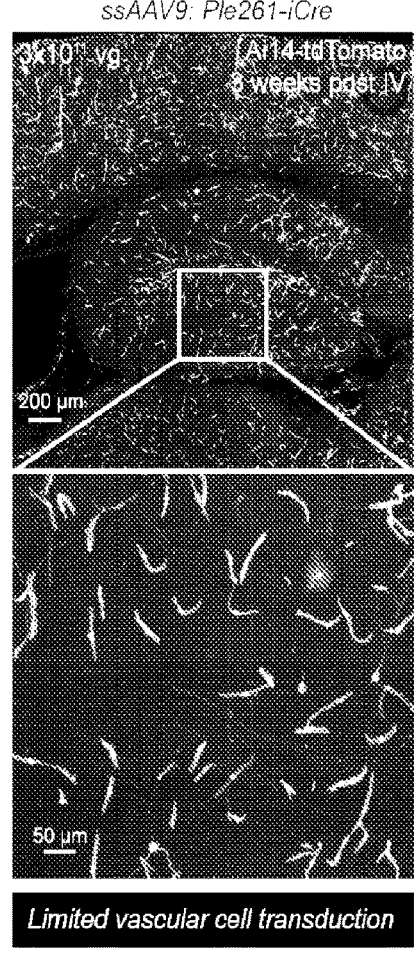
FIG. 56. shows expression of single-stranded (ss) AAV9, PHP.eB in Ai14-tdTomato reporter adult mouse (n=2-3 per group, $3\times10^{11}$ vg dose per adult mouse, 3 weeks of expression)
Figure 57:
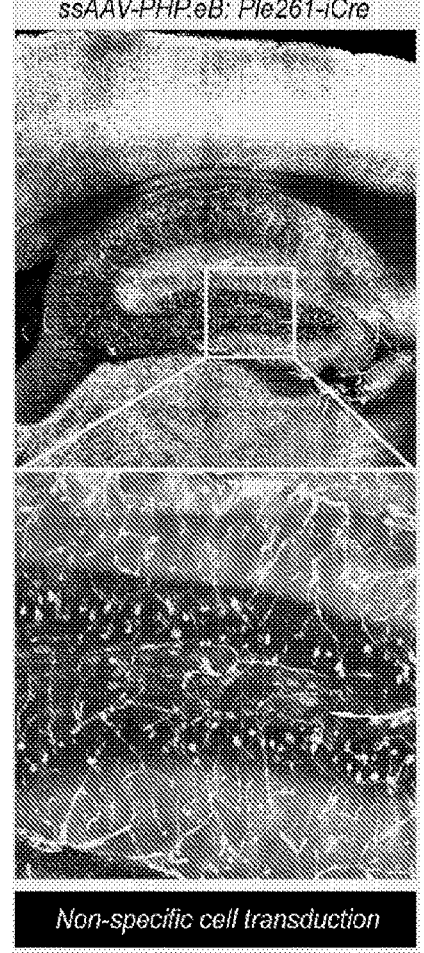
FIG. 57 shows expression of PHP.V1 in Ai14-tdTomato reporter adult mouse (n=2-3 per group, $3\times10^{11}$ vg dose per adult mouse, 3 weeks of expression)
Figure 58:
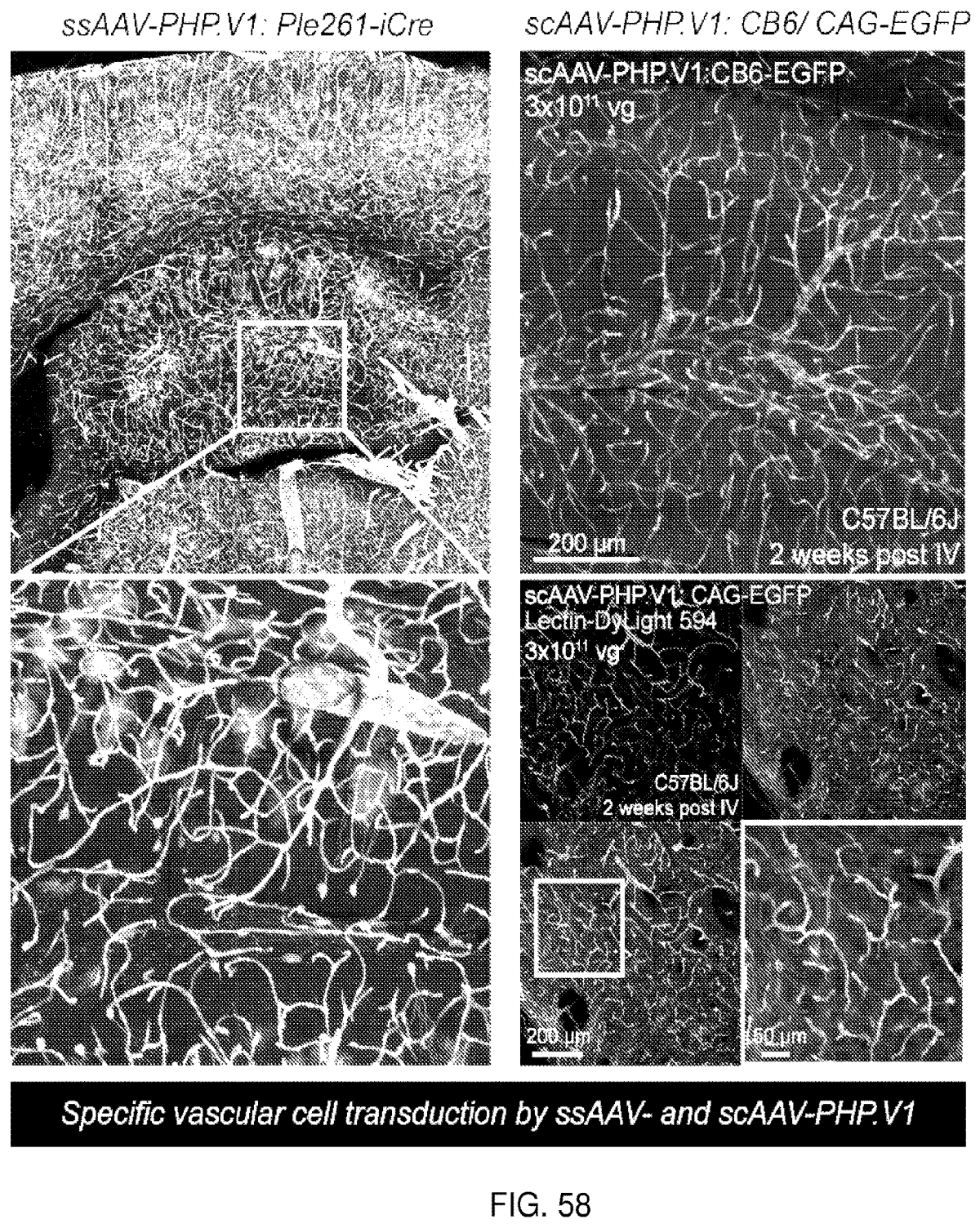

For applications requiring endothelial cell-restricted transduction via intravenous delivery, AAV-PHP.V1 vectors can be used in three different systems: (1) in endothelial cell-type specific Tek-Cre mice with a Cre-dependent expression vector (FIG. 15 (left) and FIG. 18), (2) in fluorescent reporter mice where Cre is delivered with an endothelial cell-type specific MiniPromoter (Ple261) (FIG. 15 (right) and FIGS. 19 and 56 through the left column of FIG. 58), and (3) in wild-type mice by packaging a self-complementary genome (scAAV) containing a ubiquitous promoter (Right column of FIG. 58). The mechanism of endothelial cell-specific transduction by AAV-PHP.V1 using scAAV genomes is unclear, but shifts in vector tropism when packaging scAAV genomes have been reported for another capsid.

Figure 59:
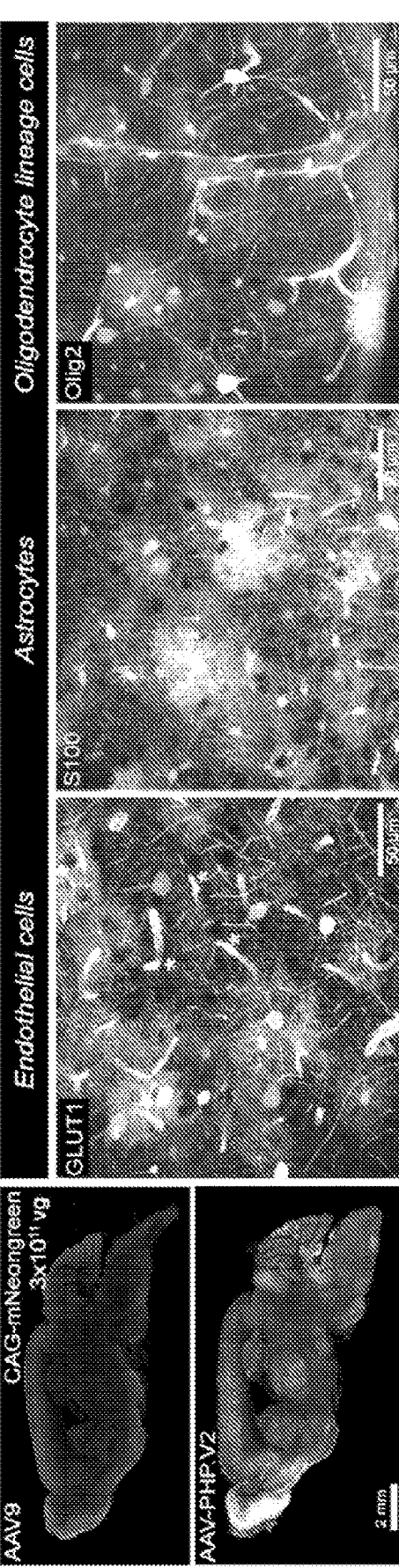
FIG. 59 shows transduction of mouse brain by the AAV-PHP.V2 variant and control AAV9, carrying the CAG promoter that drives the expression of mNeonGreen (n=3, $3\times10^{11}$ vg IV dose per C57BL/6J adult mouse, 3 weeks of expression). The sagittal brain images (left) were acquired using the same microscope settings to that of the sagittal brain images in FIG. 14. Higher magnification images of AAV-PHP.V2 transduced brain sections stained with αGLUT or αS100 or αOlig2 are shown.

Given the dramatic difference in tropism between AAV-PHP.V1 and AAV-PHP.B/eB, we tested several additional variants within the PHP.B-like family. One variant, AAV-PHP.V2—TTLKPFL, differed by only one AA from AAV-PHP.V1, has a similar tropism (FIGS. 59-61). AAV-PHP.V2 was found at high abundance in R1 selection across all brain libraries and was highly enriched in R2 (FIGS. 4, 11 (right panel), 12, 13, and 40). Given its sequence similarity, similar tropism was expected to that of AAV-PHP.V1. This was validated in vivo in C57BL/6J adult mice (ssAAV-PHP.V2: CAG-mNeongreen genome, $3\times10^{11}$ vg dose per adult mice, n=3, FIG. 59), in Tek-Cre mice (ssAAV-PHP.V2:CAG-DIO-EYFP genome, $1\times10^{12}$ vg dose per adult mouse, n=2, FIG. 60), and in GFAP-Cre mice (ssAAV-PHP.V2:CAG-DIO-EYFP, $1\times10^{12}$ vg dose per adult mouse, n=2, FIG. 61).

Three other variants with sequences of roughly equal deviation from both AAV.PHP.V1 and AAV.PHP.B, AAV-PHP.B4—TLQIPFK, AAV-PHP.B7—SIERPFK, and AAV-PHP.B8—TMQKPFI (FIGS. 12, 13, 20, and 21), have PHP.B-like tropism with biased transduction toward neurons and astrocytes (FIGS. 21 and 62-64). Similar variants among the spike-in library, AAV-PHP.B5—TLQLPFK and AAV-PHP.B6—TLQQPFK, also shared this tropism (FIGS. 13, 20, 21, and 62).

Figure 20:
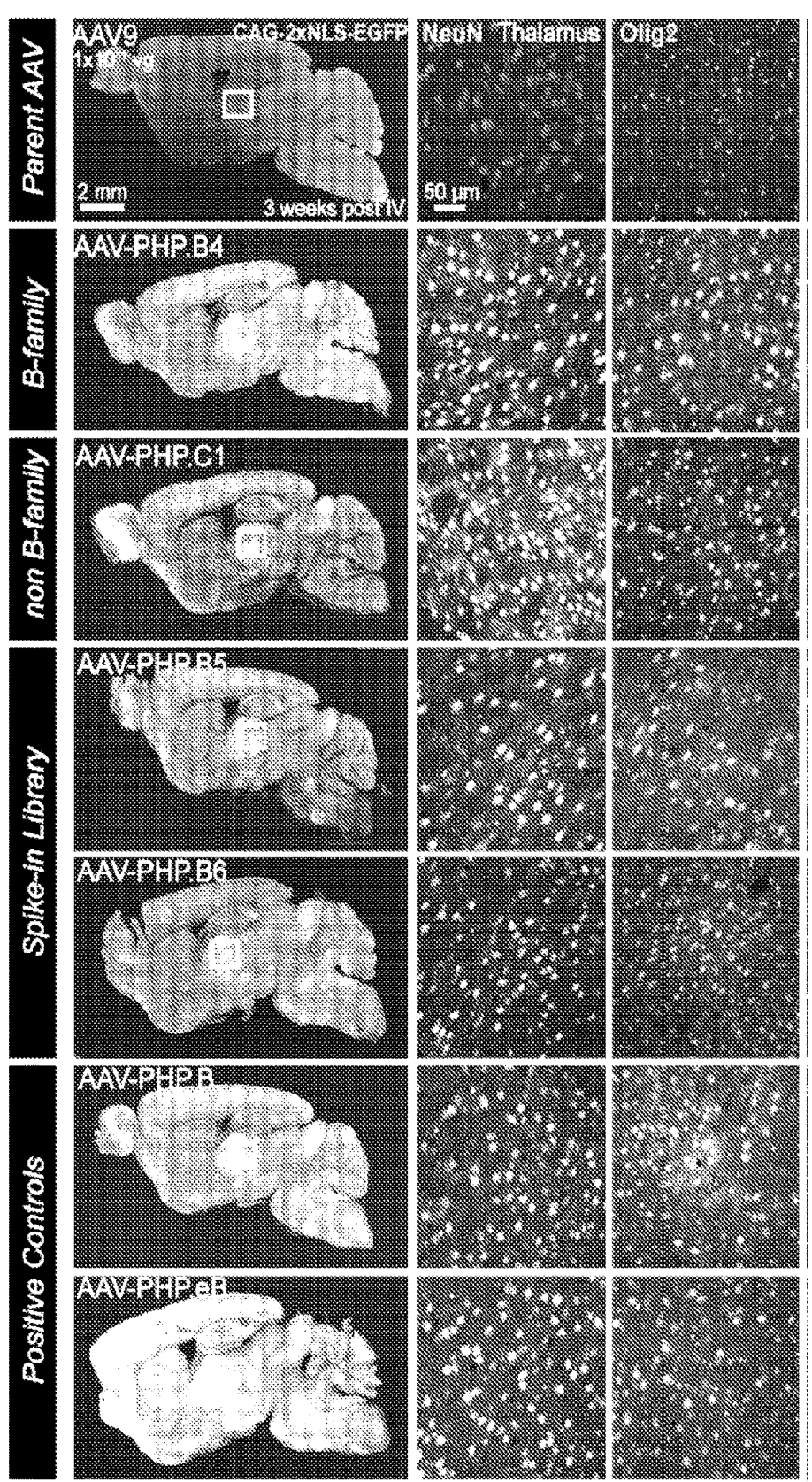
FIG. 20 shows transduction by AAV-PHP.B4-B6 and C1 variants, as well as B, eB, and AAV9 controls in sagittal brain and liver sections. Across each set of images (column-wise) acquired, microscope settings were matched with AAV-PHP.eB. The white box on the sagittal brain images marks the thalamus and not the precise region of the figures to the right. Vectors are packaged with ssAAV:CAG-2xNLS-EGFP genome (n=3 per group, $1×10^{11}$ vg IV dose/adult C57BL/6J mouse, 3 weeks of expression). Tissues are stained with cell-type specific markers: αNeuN for neurons, αS100 for astrocytes and αOlig2 for oligodendrocyte lineage cells. Liver tissues are stained with a DNA stain, DAPI.
Figure 20:
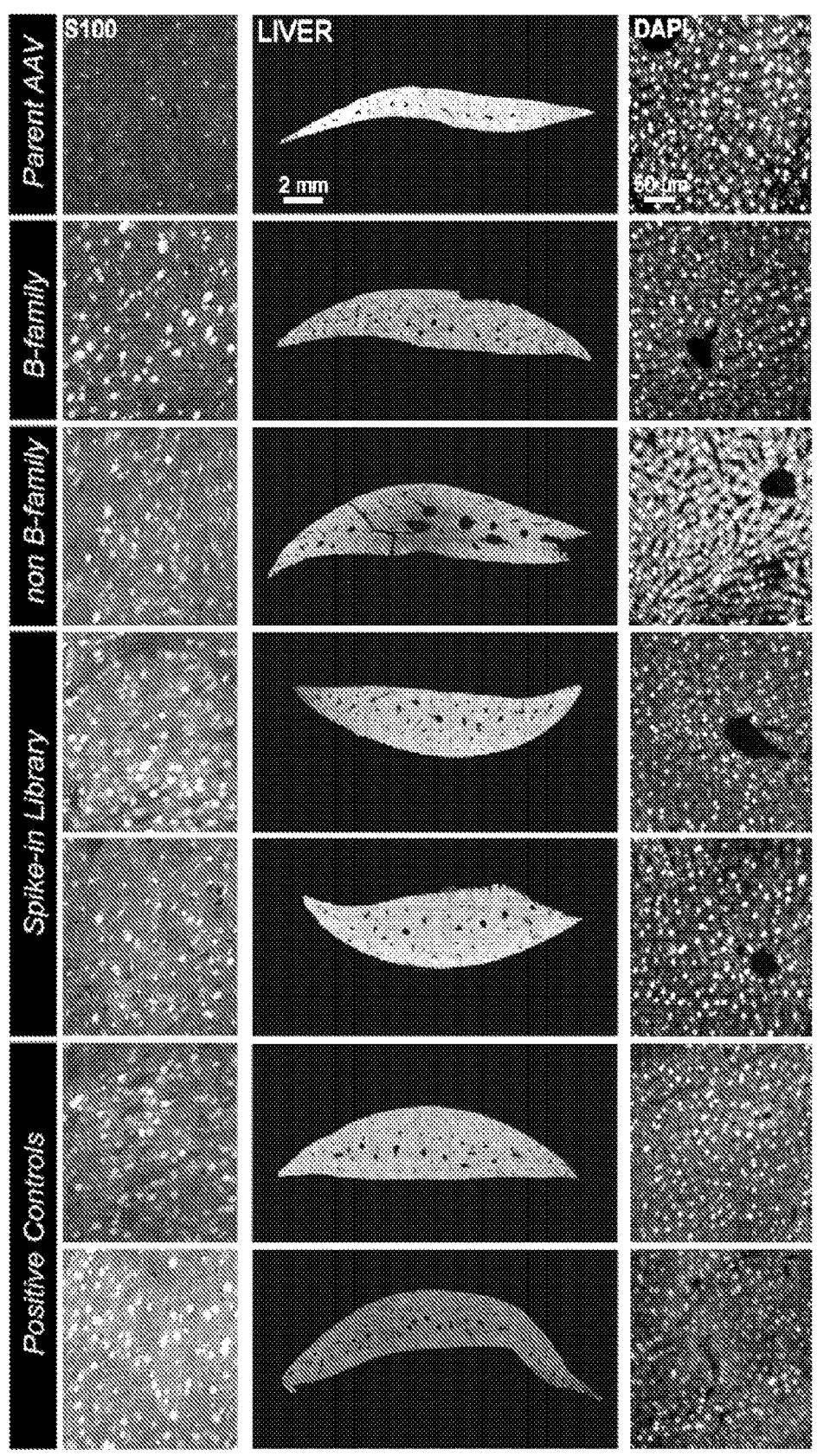
Figure 21:
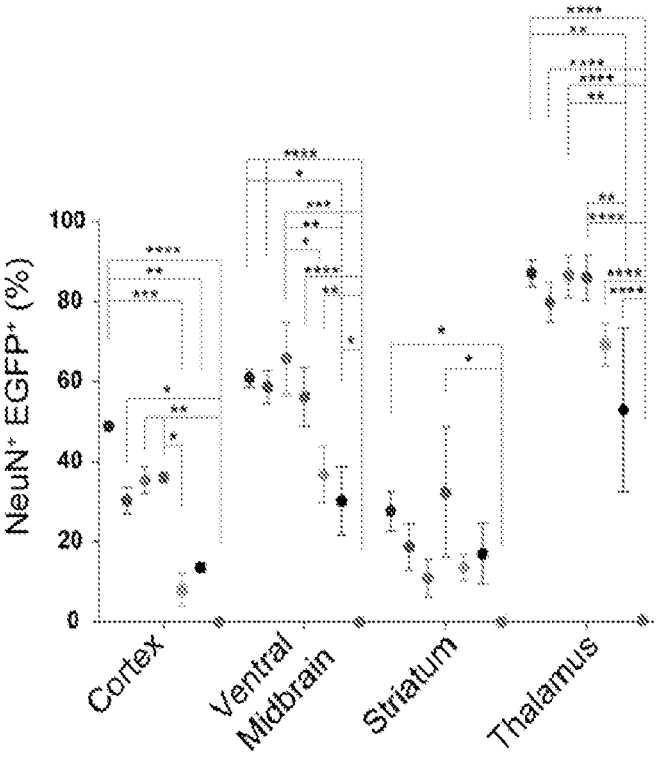
FIGS. 21-23 show the percentage of αNeuN+ (FIG. 21), αS100+ (FIG. 22), and αOlig2+(FIG. 23) cells with detectable nuclear-localized EGFP in the indicated brain regions (n=3 per group, $1×10^{11}$ vg dose). A two-way ANOVA with correction for multiple comparisons using Tukey's test is reported with adjusted P-values (**$P≤0.0001$, *$P≤0.001$, **$P≤0.01$, *$P≤0.05$, is shown, and P>0.05 is not shown on the plot; 95% CI, data is mean±S.E.M. The dataset comprises a mean of 2 images per region per cell-type marker per mouse).
Figure 22:
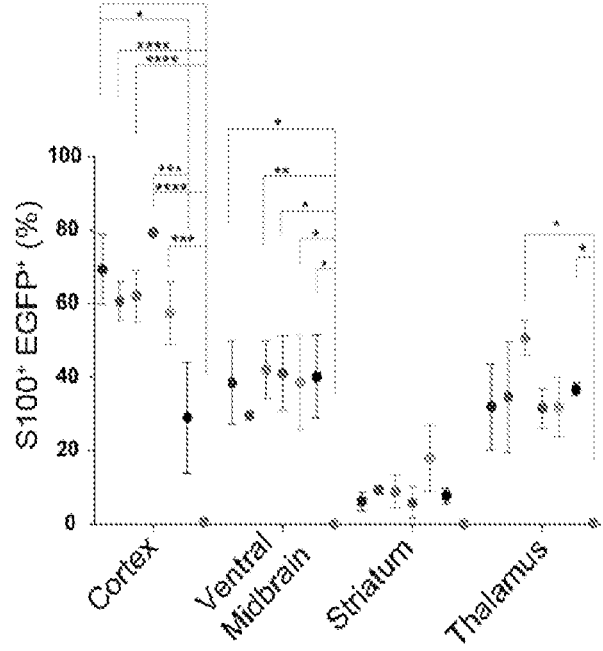

To evaluate the performance of the spike-in library, two highly enriched variants similarly placed in sequence space were chosen: AAV-PHP.B6—TLQLPFK and AAV-PHP.B7—TLQQPFK (FIG. 48 (middle panel), and 53) that were previously identified in the 3-mer-s PHP.B library but never validated in vivo. At a modest dose of $1\times10^{11}$ vg in C57BL/6J adult mice, these variants also display PHP.B-like tropism (FIGS. 20-21 and 62).

A series of variants selected to verify M-CREATE's predictive power outside this family were then investigated: (1) A highly enriched variant with a completely unrelated sequence, AAV-PHP.C1—RYQGDSV (FIGS. 12, 13, 20, and 21), transduced astrocytes at a similar efficiency and neurons at lower efficiency compared to other tested variants from B-family (FIG. 21). (2) Two variants found in high abundance in the R2 synthetic pool virus library and negatively enriched in brain (with both codon replicates in agreement), AAV-PHP.X1—ARQMDLS and AAV-PHP.X2—TNKVGNI (FIG. 46, right), poorly transduced the CNS (FIG. 63). (3) Two variants that were found in higher abundance in brain libraries from the PCR pool R2, AAV-PHP.X3—QNVTKGV and AAV-PHP.X4—LNAIKNI also failed to outperform AAV9 in the brain (FIG. 65).

Collectively, the characterization of these AAV variants demonstrates several key points. First, within a diverse sequence family, there is room for both functional redundancy and the emergence of novel tropisms. Second, highly enriched sequences outside the dominant family are also likely to possess enhanced function. Third, buoyed by codon replicate agreement in the synthetic pool, a variant's enrichment across tissues may be predictive. Fourth, while the synthetic pool R2 library contains a subset of the sequences that are in the PCR pool R2 and may thereby lack some enhanced variants, the excluded PCR pool population is enriched in false positives.

The ability to confidently predict in vivo transduction from a pool of 18,000 variants across mice is a significant advance in the selection process and demonstrates the power of M-CREATE for the evolution of individual vectors.

Figures 23, 24:
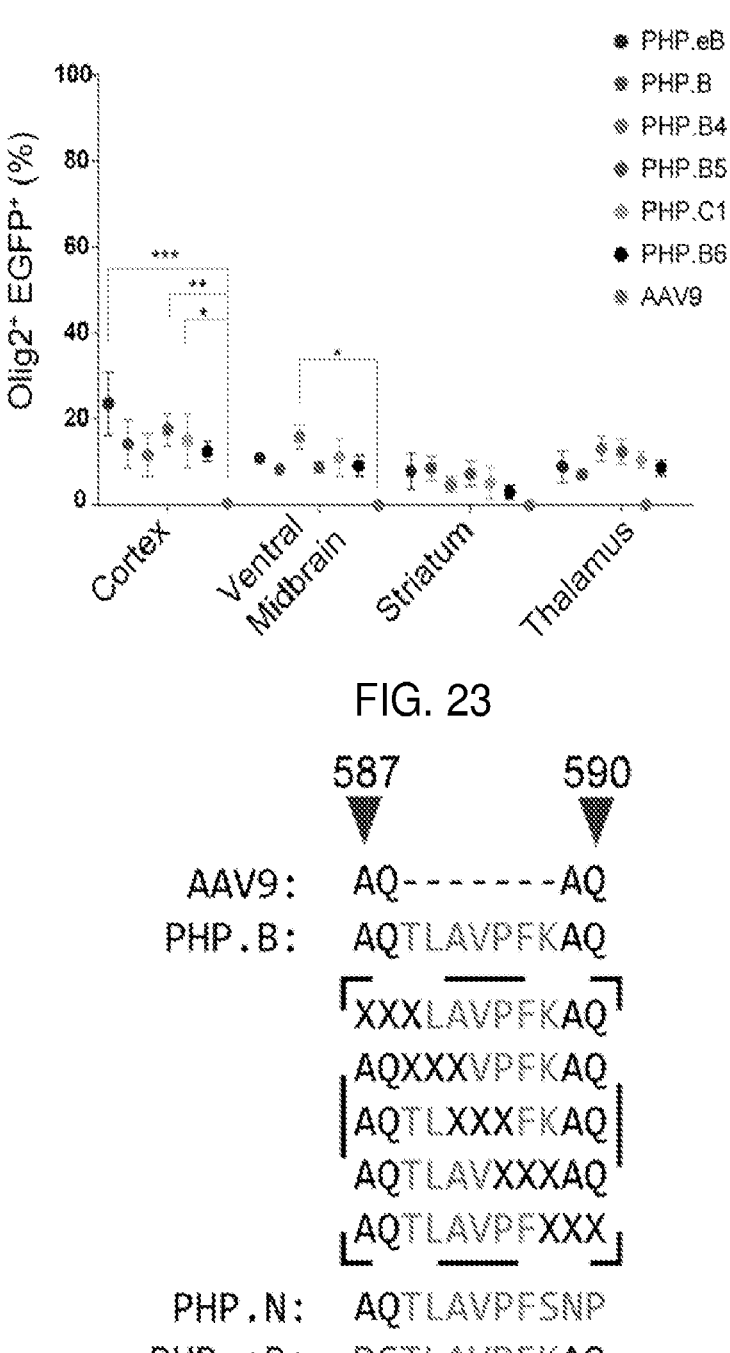
FIG. 24 shows the design of the 3-mer-s PHP.B library with combinations of three AA diversification between AA 587-597 of AAV-PHP.B (or corresponding AA 587-590 of AAV9). Shared AA identity with the parent AAV-PHP.B is shown along with unique motifs for AAV-PHP.N and AAV-PHP.eB.
Figure 25:
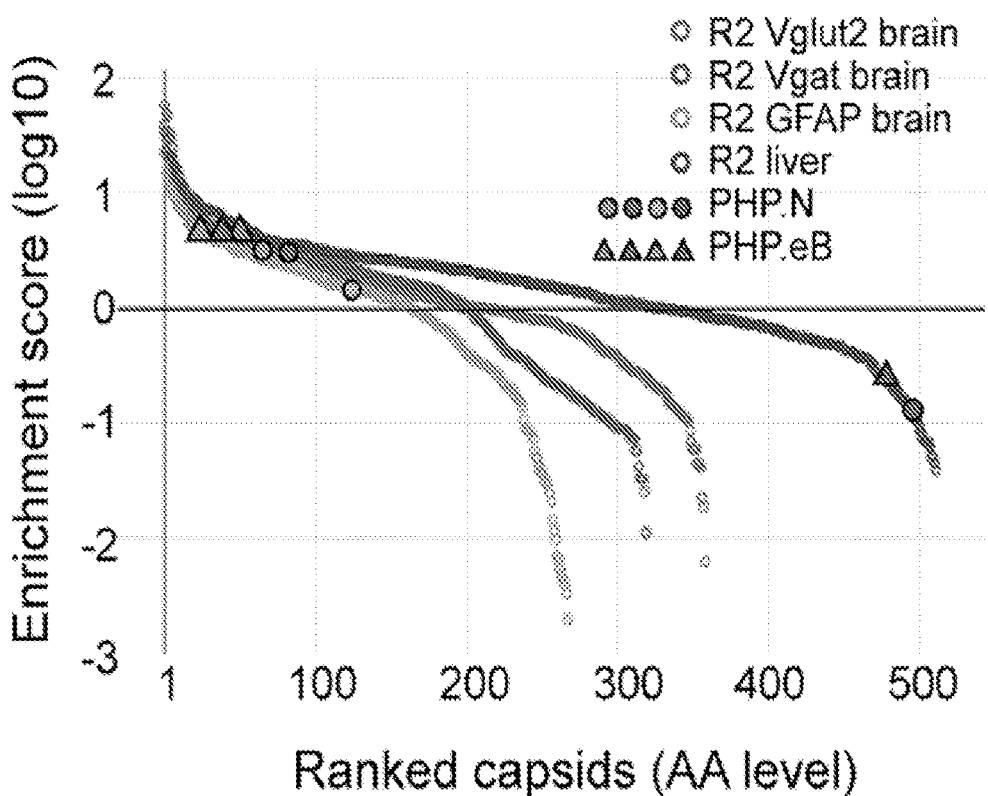
FIG. 25 shows distributions of R2 brain and liver libraries (at AA level) by enrichment score (normalized to R2 virus library, with variants sorted in decreasing order of enrichment score). The enrichment of AAV-PHP.eB and AAV-PHP.N across all libraries are mapped on the plot.
Figure 66:
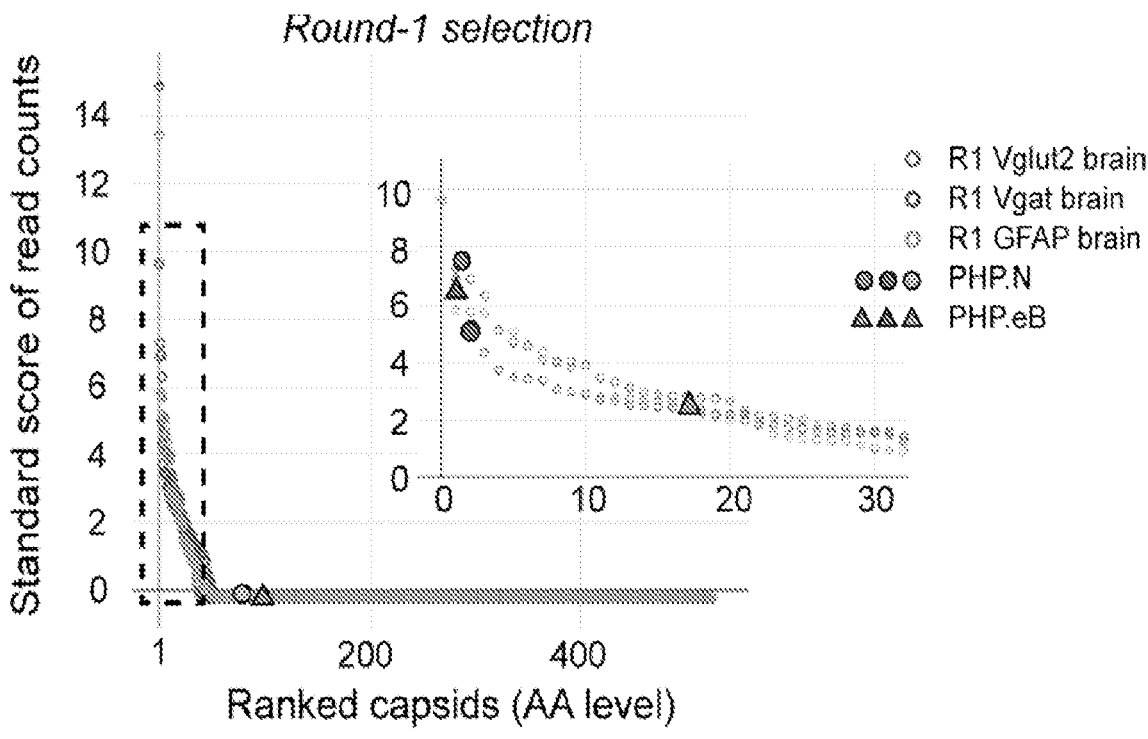
FIGS. 66-67 show distributions of R1 (FIG. 66) and R2 (FIG. 67) brain libraries (at AA level, standard score (SS) of RCs sorted in decreasing order of scores). The SS for AAV-PHP.N and AAV-PHP.eB across libraries are mapped on the zoomed-in view of this plot (dotted line box).
Figure 67:
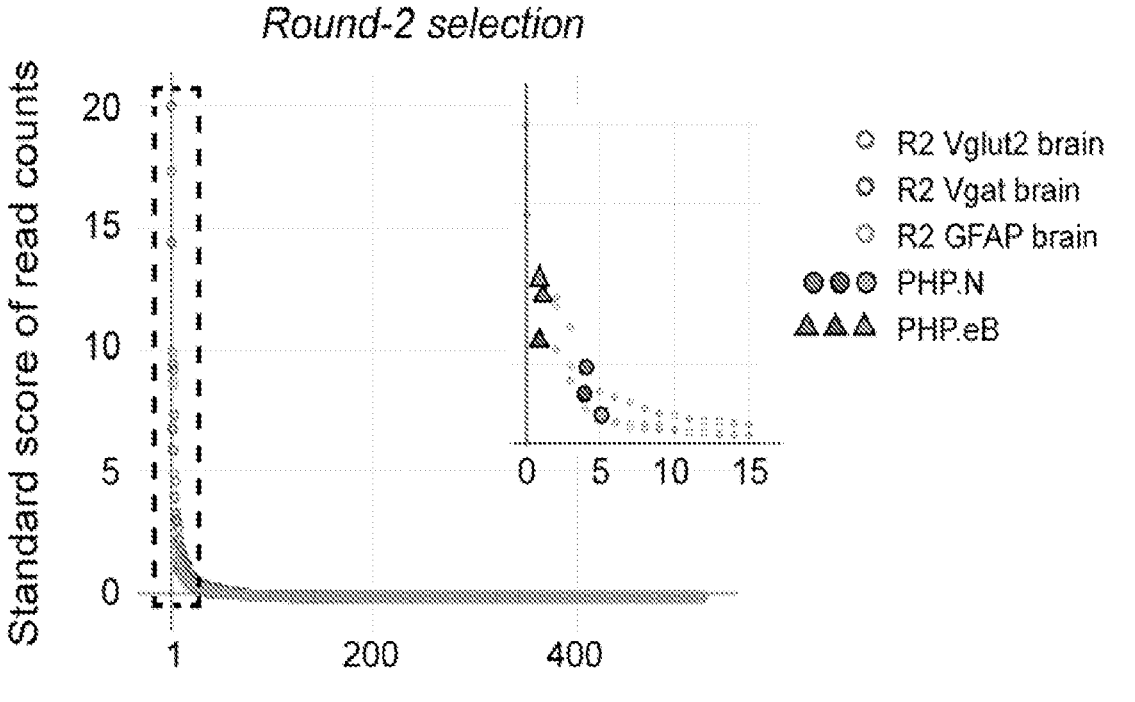

Example 7. Re-Investigation of Capsid Selection that Yielded AAV.PHP.eB Reveals Variant that Specifically Transduces Neurons Using NGS, a 3-mer-s (s-substitution) PHP.B library generated by the prior CREATE methodology that yielded AAV-PHP.eB[27] was reinvestigated (FIG. 24). The brain libraries were deep sequenced using Cre-dependent PCR and a R2 liver library from wild-type mice (processed via PCR for all capsid sequences regardless of Cre-mediated inversion) and identified 150-200 positively enriched capsids in brain tissue (FIGS. 25, 66, and 67). Briefly, the re-investigated 3-mer-s PHP.B library diversified positions 587-597 of the AAV-PHP.B capsid (equivalent of 587-590 AA on AAV9) in portions of three consecutive AAs, (40,000 total variants) (FIG. 24). Selections were performed in three Cre-transgenic lines: Vglut2-IRES-Cre for glutamatergic neurons, Vgat-IRES-Cre for GABAergic neurons, and GFAP-Cre for astrocytes.

Figure 26:
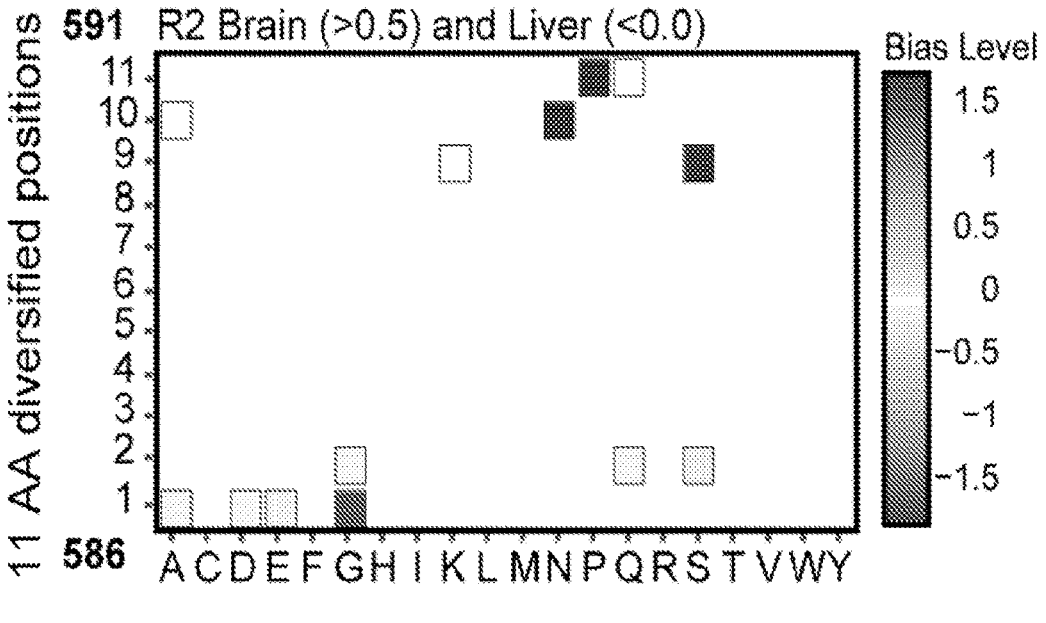
FIG. 26 shows heatmap represents the magnitude (log 2 fold change) of a given AA's relative enrichment or depletion at each position across the diversified region, only if statistical significance is reached on fold change (boxed if p-value≤0.0001, two-sided, two-proportion z-test, p-values corrected for multiple comparisons using Bonferroni correction). Plot includes variants that were highly enriched in brain (>0.5 mean enrichment score, where mean is drawn across Vglut2, Vgat and GFAP, n=1 library per mouse line (sample pooled from 2 mice per line)) and underrepresented in liver (<0.0) (32 AA sequences).
Figure 27:
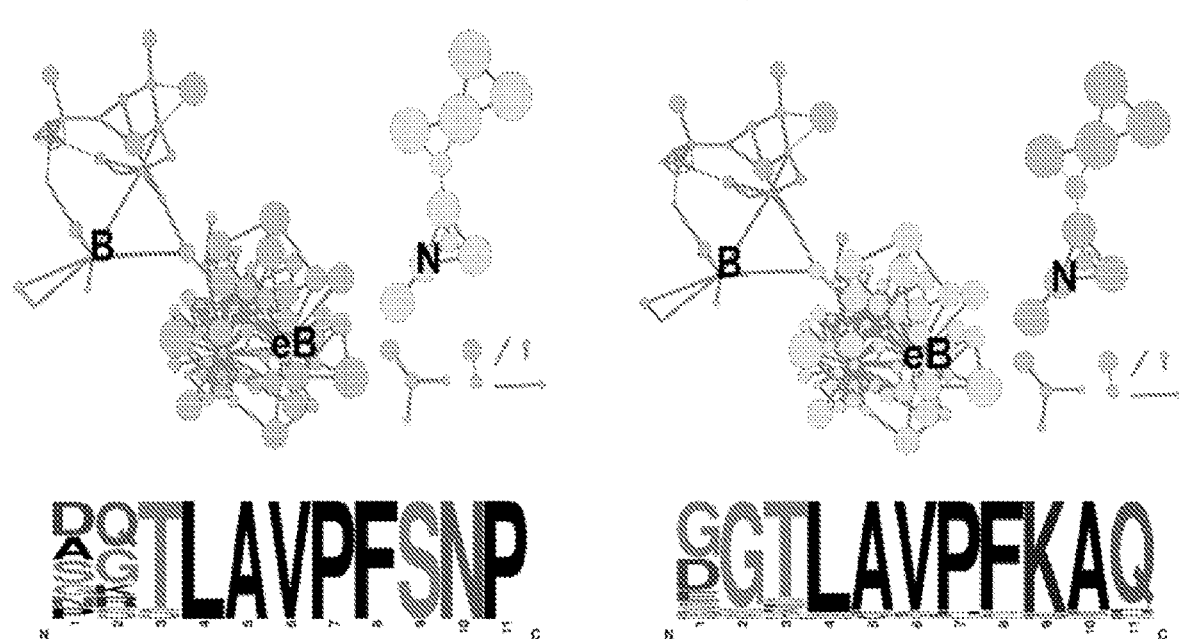
FIG. 27 shows clustering analysis of enriched variants from Vgat brain library with node size representing the degree of negative enrichment in liver and the thickness of edges (connecting lines) representing degree of relatedness between nodes. Two distinct families are highlighted in yellow and their corresponding AA frequency logos are shown below (AA size represents prevalence and color encodes AA properties).
Figure 28:
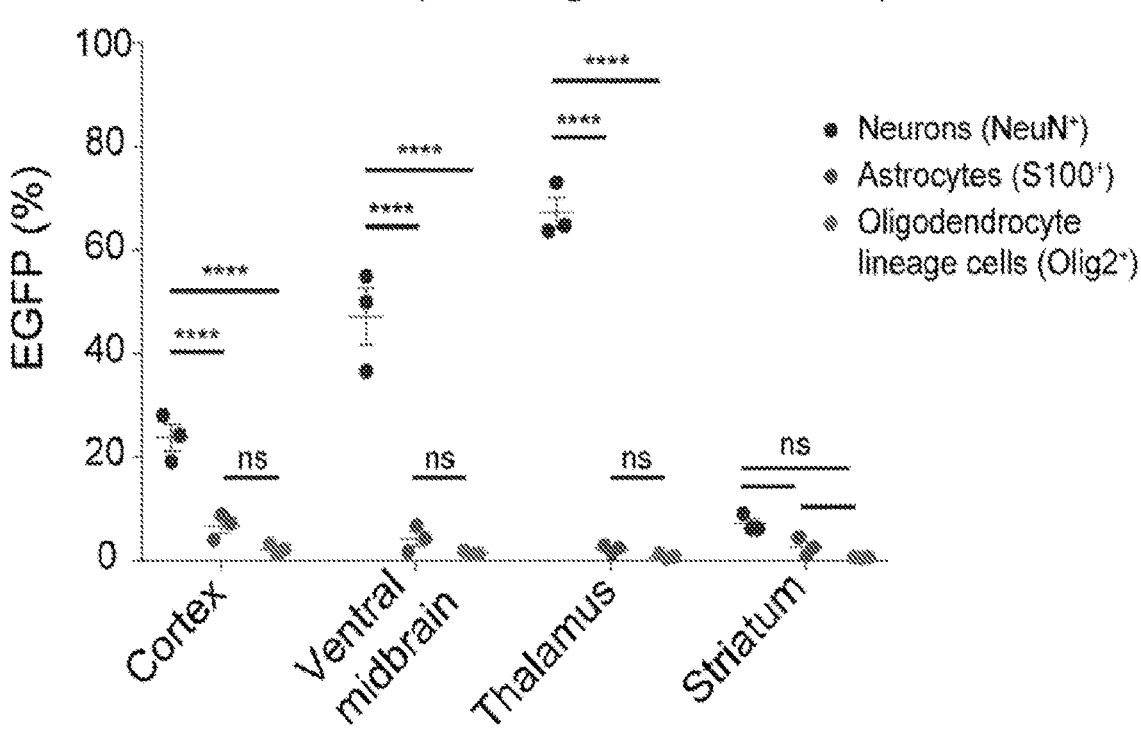
FIG. 28 shows the percentage of neurons, astrocytes and oligodendrocyte lineage cells with ssAAV-PHP.N:CAG-2xNLS-EGFP in the indicated brain regions (n=3, $1×10^{11}$ vg IV dose per adult C57BL/6J mouse, 3 weeks of expression, data is mean±S.E.M, 6-8 images for cortex, thalamus and striatum, and 2 images for ventral midbrain, per mouse per cell-type marker using 20×objective covering the entire regions). A two-way ANOVA with correction for multiple comparisons using Tukey's test gave adjusted P-values reported as ****$P≤0.0001$, ns for P>0.05, 95% CI.
Figure 29:
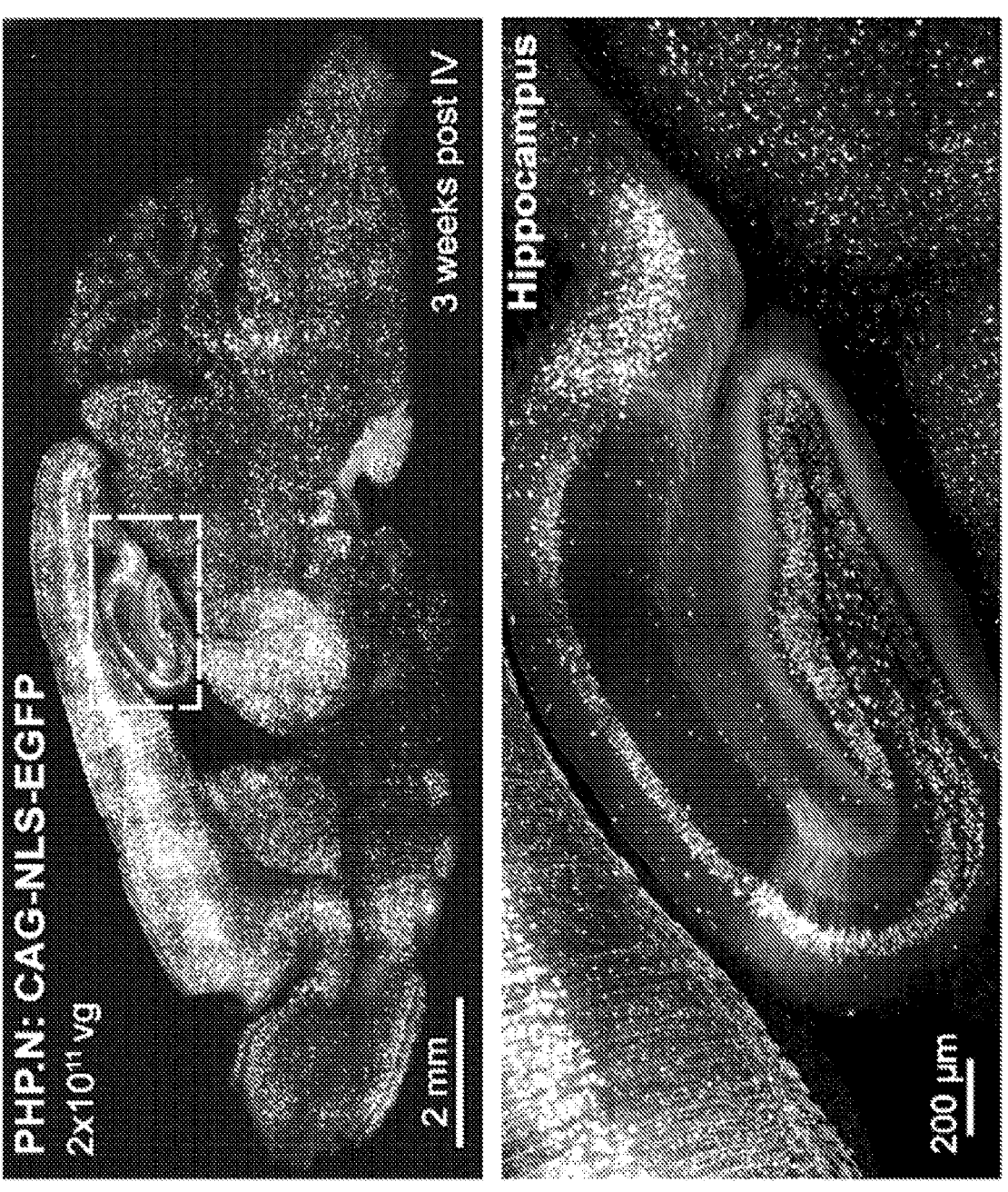
FIG. 29 shows transduction by ssAAV-PHP.N:CAG-NLS-EGFP (n=2, $2×10^{11}$ vg IV dose per adult C57BL/6J mouse, 3 weeks of expression) with NeuN staining (magenta) across three brain areas (cortex, SNc (substantia nigra pars compacta) and thalamus).
Figure 29:
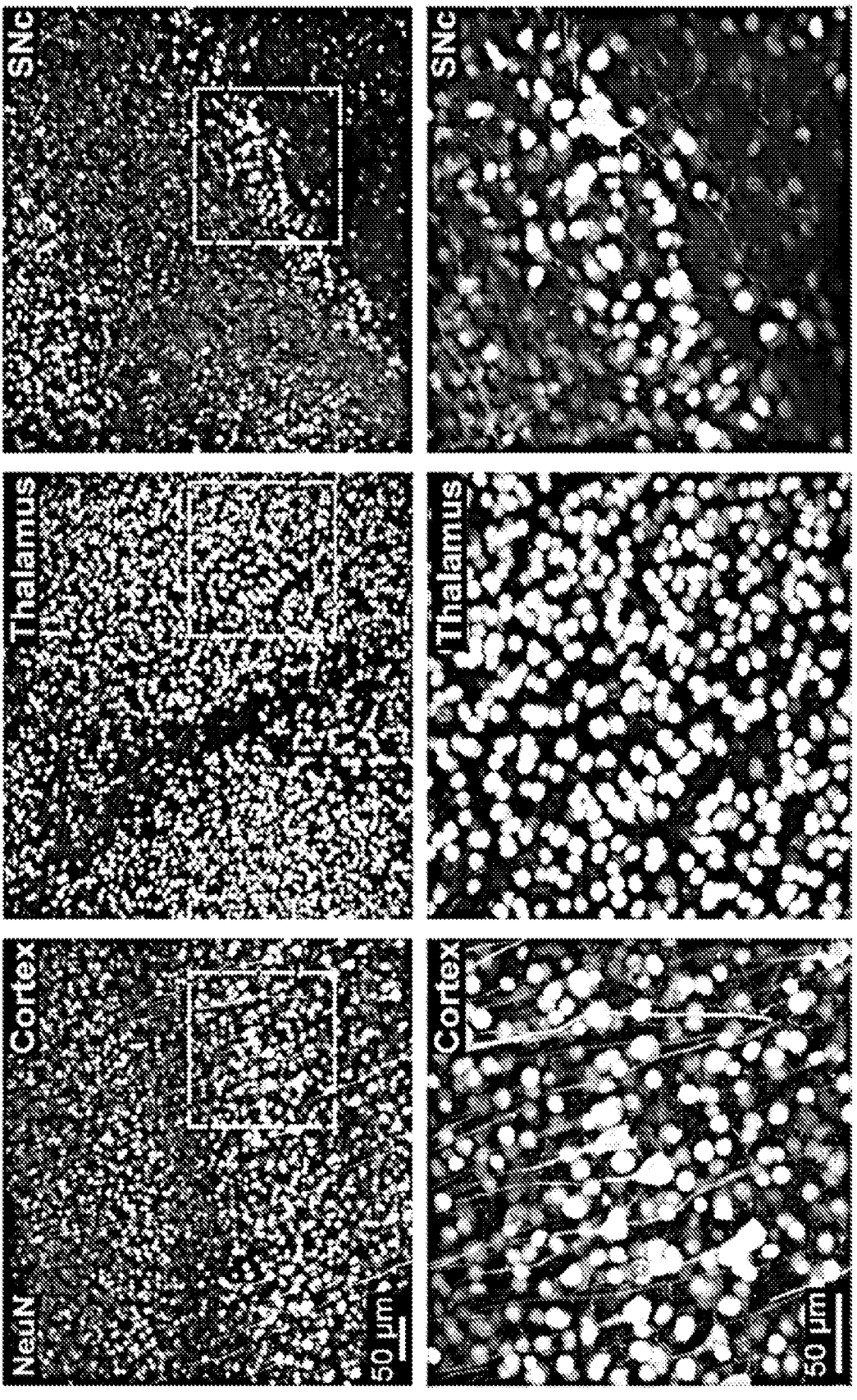
Figure 68:
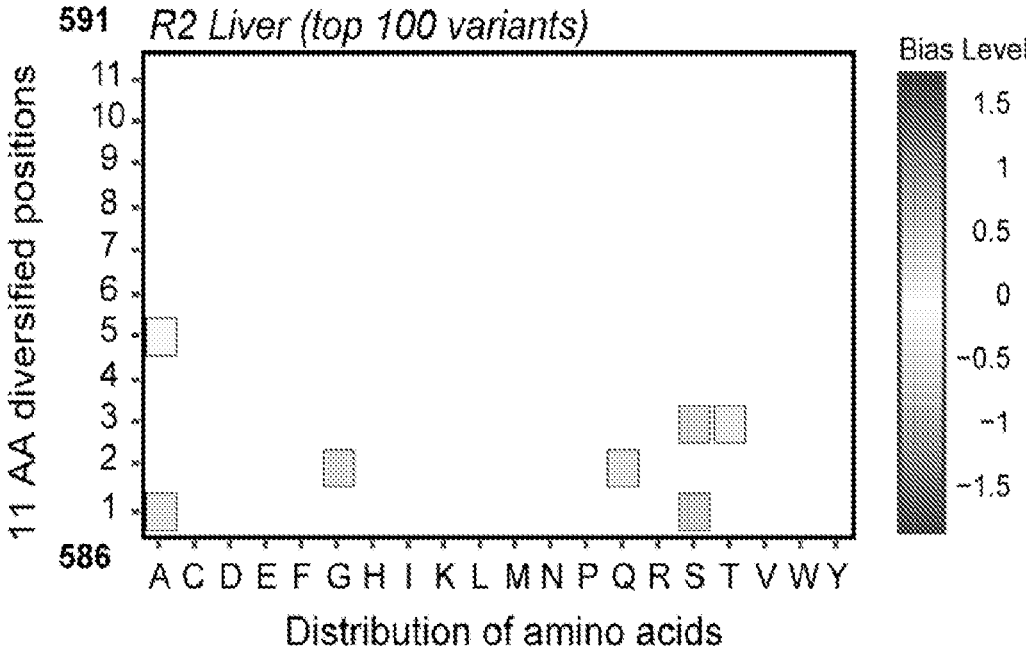
FIG. 68 shows a heatmap of AA distributions across the diversified region of the positively enriched variants from R2 liver library (top 100 sequences) normalized to the R2 virus (input library).
Figure 69:
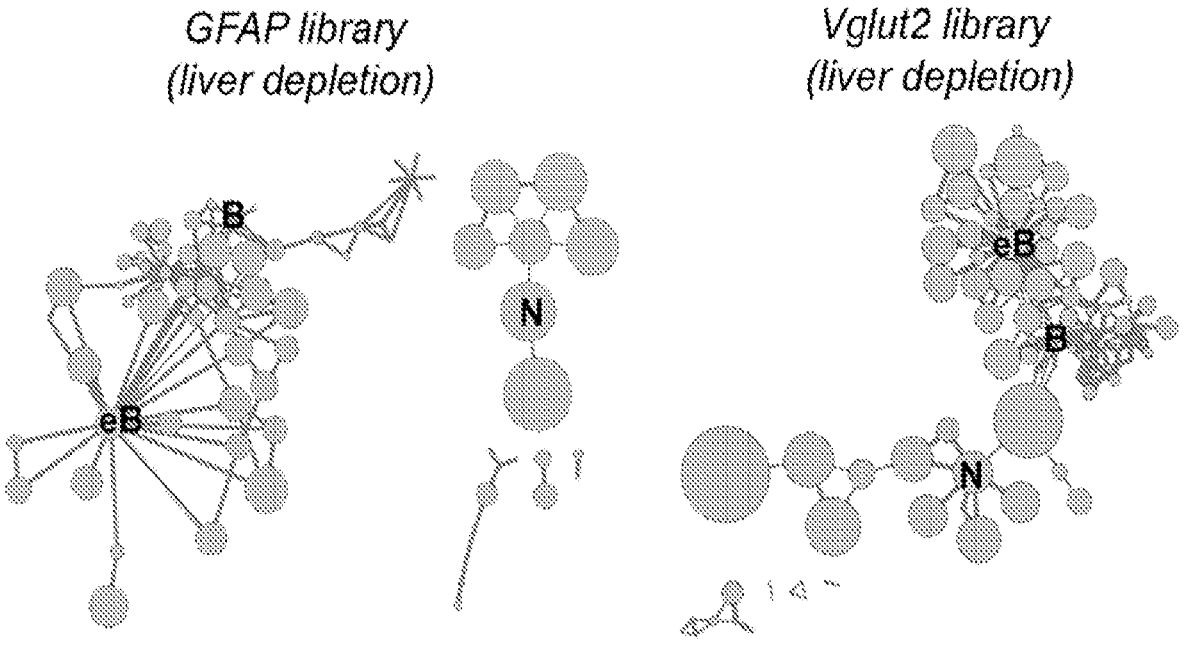
FIG. 69 shows clustering analysis of positively enriched variants from GFAP and Vglut2 brain libraries are shown with size of nodes representing their relative negative enrichment in liver, and the thickness of edges (connecting lines) representing their relative identity between nodes.
Figure 70:
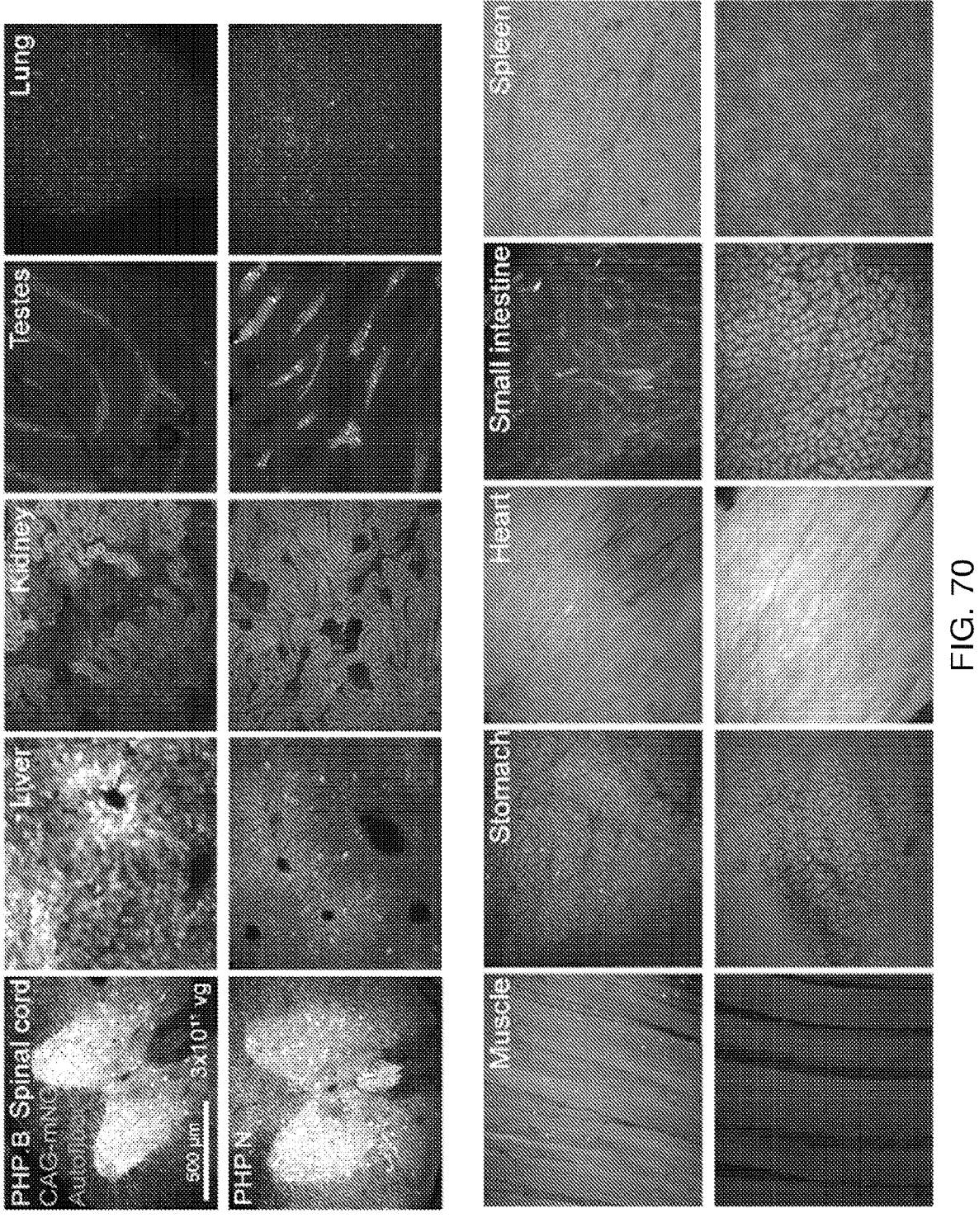
FIG. 70 shows expression of AAV-PHP.B (top row) and AAV-PHP.N (bottom row) packaged with ssAAV:CAG-mNeonGreen across all organs (n=3, $3\times10^{11}$ vg IV dose per adult C57BL/6J mouse, 3 weeks of expression).
Figure 71:
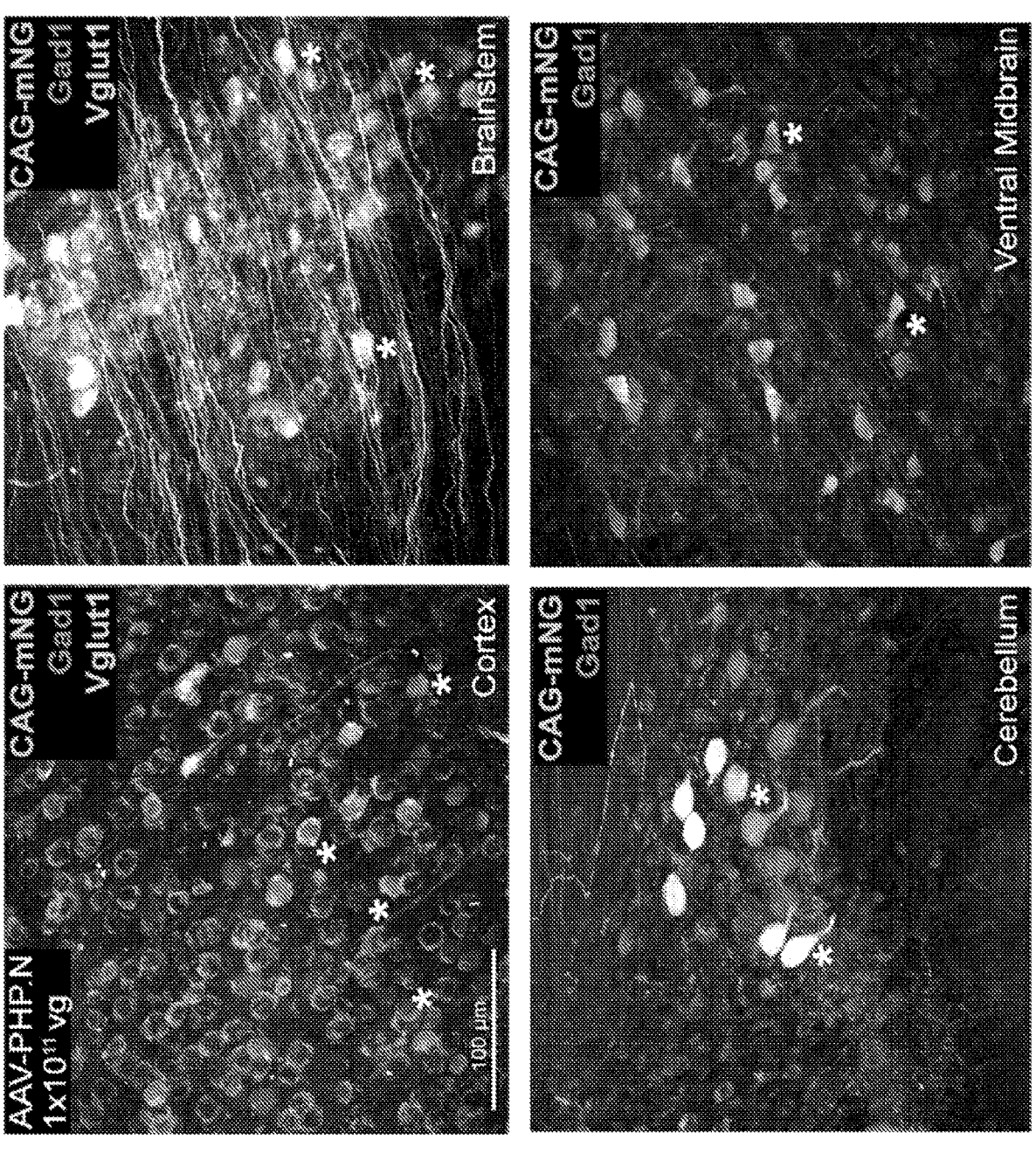
FIG. 71 shows transduction of mouse brain by the AAV-PHP.N variant, carrying the CAG promoter that drives the expression of mNeonGreen (n=3, $1\times10^{11}$ vg IV dose per C57BL/6J adult mouse, 3 weeks of expression). Fluorescence in situ hybridization chain reaction (FITC-HCR) was used to label excitatory neurons with Vglut1 and inhibitory neurons with Gad1. Few cells where EGFP expression co-localized with specific cell markers are highlighted by asterisks symbol.

Variants that were positively enriched in brain and negatively enriched in liver show a significant bias towards certain AAs: G, D, E at position 1; G, S at position 2 (which includes the AAV-PHP.eB motif, DG); and S, N, P at position 9, 10, 11 (FIGS. 26 and 68). Variants that were positively enriched in the brain were clustered according to their sequence similarities and ranked by their negative enrichment in liver (represented by node size in clusters). A distinct family referred to as N emerged with a common motif "SNP" at positions 9-11 on PHP.B backbone (FIGS. 27 and 69).

The core variant of the N-family cluster: AQTLAVPFSNP was found in high abundance in R1 and R2 selections, had higher enrichment score in Vglut2 and Vgat brain tissues compared to GFAP, and had negative enrichment in liver tissue (FIGS. 25 and 66-69). Unlike AAV-PHP.eB, this variant (AAV-PHP.N) specifically transduced NeuN[+] neurons even when packaged with a ubiquitous CAG promoter, although the transduction efficiency varied across brain regions (from ~10-70% in NeuN[+] neurons, including both VGLUT1[+] excitatory and GAD1[+] inhibitory neurons, FIGS. 28, 29, 70, and 71).

Thus, by re-examining the 3-mer-s library several novel variants were identified, including one with notable cell-type-specific tropism. While Vglut2-Cre and Vgat-Cre mice were used for in vivo selection, no variants stood out for neuronal subtype-specific transduction of excitatory and inhibitory populations from initial investigations on the NGS dataset. It is possible that a biological solution to this (stringent) selection was not present in the library.

Example 8. Investigation of Capsid Families Beyond C57BL/6J Mouse Strain

Figure 30:
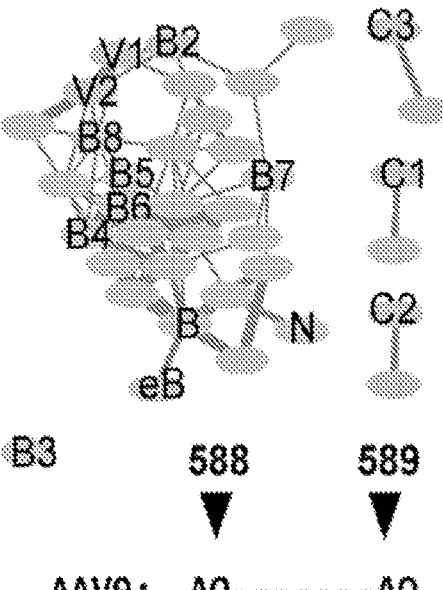
FIG. 30 shows clustering analysis showing the brain-enriched sequence families of all variants described herein, either identified in prior studies (PHP.B-B3, PHP.eB) or in the current study (PHP.B4-B8, PHP.V1-2, PHP.C1-3). The thickness of edges (connecting lines) representing degree of relatedness between nodes. The AA sequences inserted between 588-589 (of AAV9 capsid) for all the variants discussed are shown below.
Figure 31:
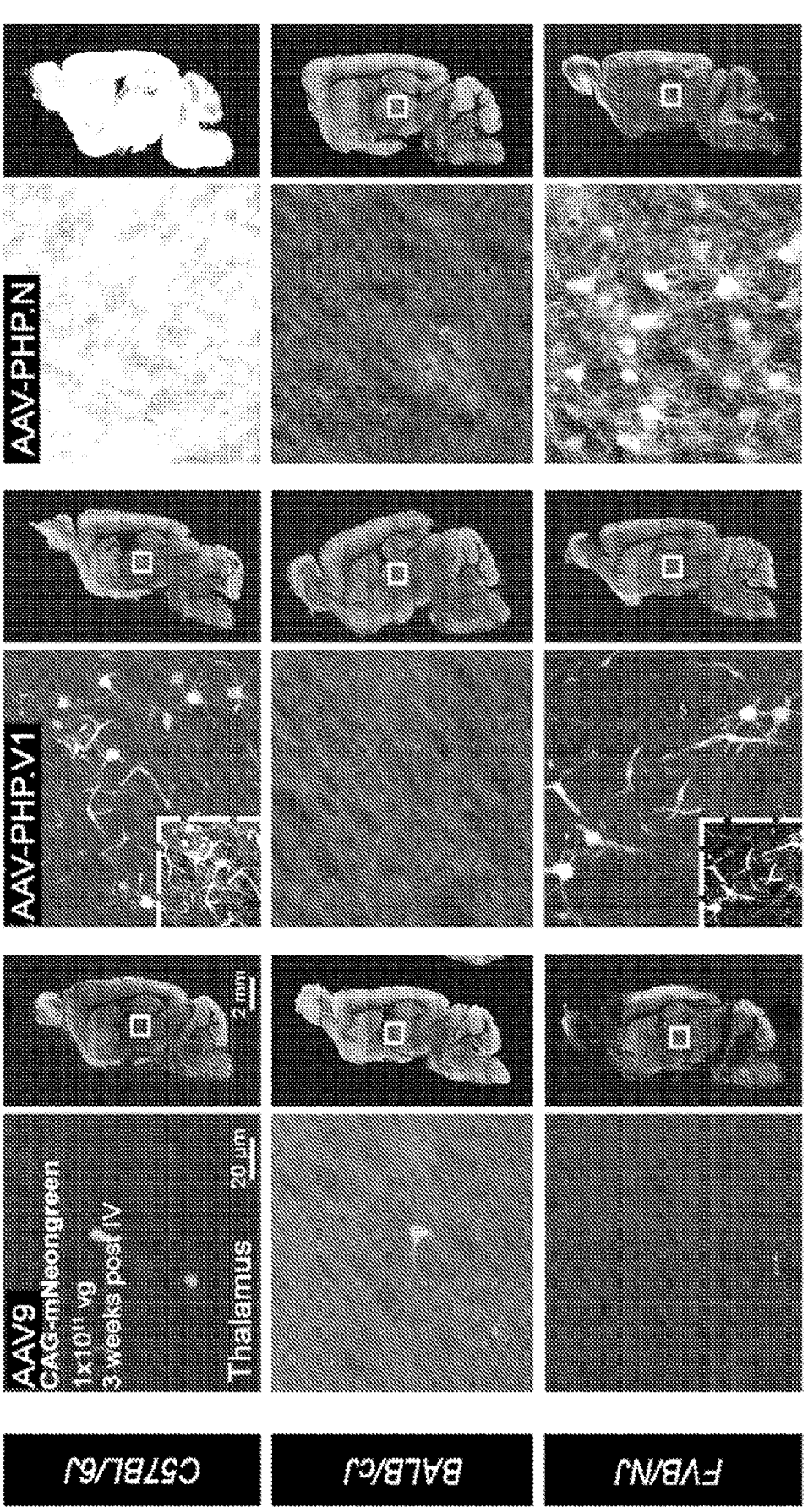
FIG. 31 shows transduction of AAV9, AAV-PHP.V1 and AAV-PHP.N across three different mouse strains: C57BL/6J, BALB/cJ and FVB/NJ in sagittal brain sections (right), along with a higher magnification image of the thalamus brain region (left).
Figure 72:
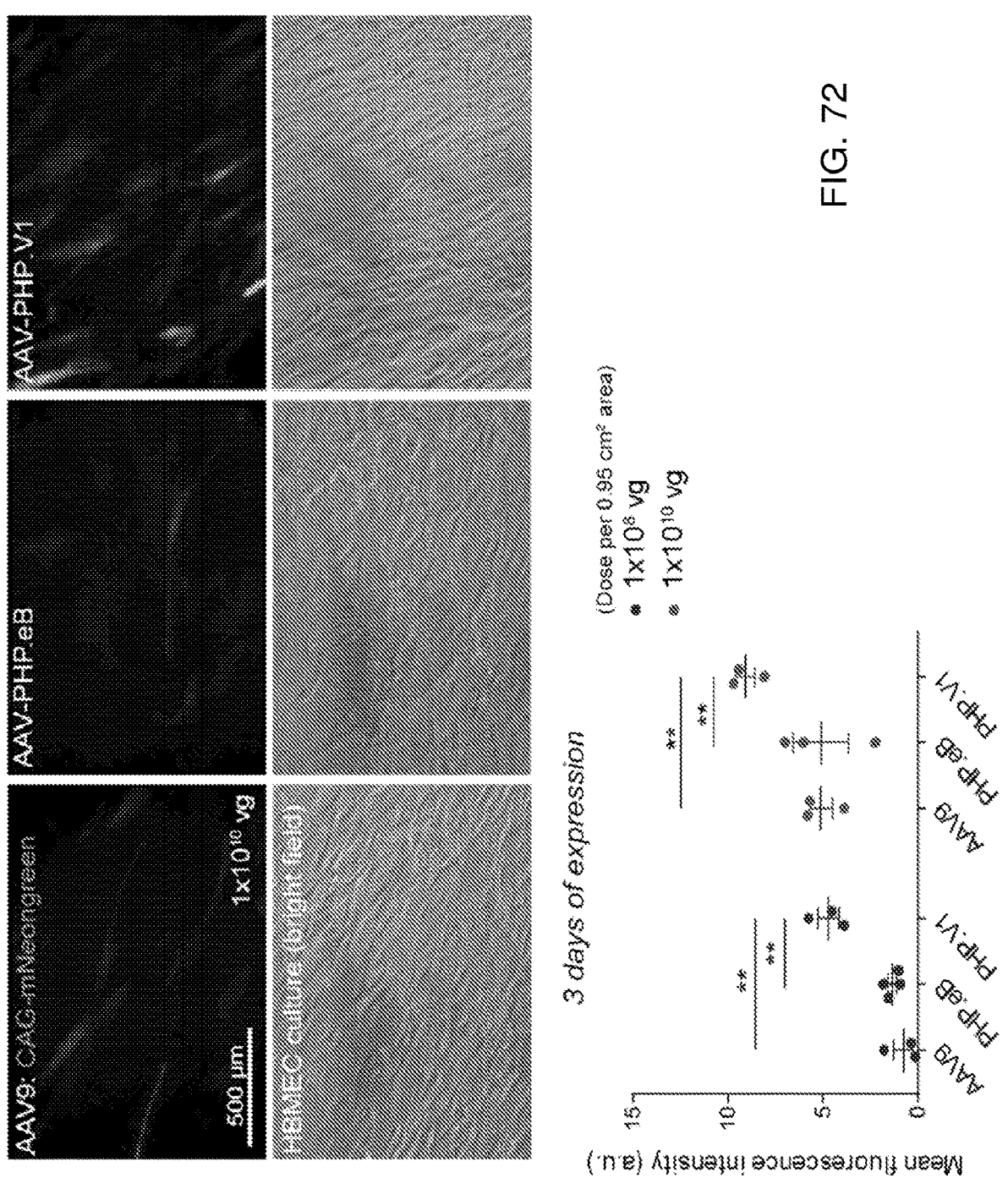
FIG. 72 shows transduction of AAV9, AAV-PHP.eB and AAV-PHP.V1 in human brain microvascular endothelial cell culture (HBMEC). The vectors were packaged with ssAAV:CAG-mNeongreen. The mean fluorescence intensity across the groups were quantified (n=3 tissue culture wells of 0.95 cm$^2$ surface area per group, 3 images per well per group per dose was imaged after three days of expression, doses $1\times10^8$ vg and $1\times10^{10}$ vg per 0.95 cm$^2$ surface area). A two-way ANOVA with correction for multiple comparisons using Tukey's test gave adjusted P-value of 0.0051 for AAV9 vs PHP.V1, 0.0096 for PHP.eB vs PHP.V1, 0.8222 for AAV9 vs PHP.eB for $1\times10^8$ vg, and 0.0052 for AAV9 vs PHP.V1, 0.0049 for PHP.eB vs PHP.V1, 0.9996 for AAV9 vs PHP.eB for $1\times10^{10}$ vg (**P≤0.01, is shown and P>0.05 is not shown on the plot; mean±S.E.M., 95% CI).

The enhanced CNS tropism of AAV-PHP.eB is absent in a subset of mouse strains. It is highly efficient in C57BL/6J, FVB/NCrl, DBA/2, and SJL/J, with intermediate enhancement in 129S1/SvimJ, and no enhancement in BALB/cJ and several additional strains. This pattern holds for the two newly identified variants from the PHP.B family, AAV-PHP.V1 and AAV-PHP.N (FIG. 30, Table 9), which did not transduce the CNS in BALB/cJ, yet transduced the FVB/NJ strain (FIG. 31). AAV-PHP.V1 transduced Human Brain Microvascular Endothelial Cell (HBMEC) culture, resulting in increased mean fluorescent intensity compared to AAV9 and AAV-PHP.eB (FIG. 72) however, suggesting the potential for mechanistic complexity.

TABLE 9

AAV-PHP vectors identified by CREATE and M-CREATE. The table provides a summary of the variants that have been identified so far using CREATE and M-CREATE, along with their tropism and the evolutionary steps from the parent capsid that was involved in their discovery.

| AAV Variants | Reference/ Selection method | Tropism | Production | Rounds of evolution from parent capsid |
|---|---|---|---|---|
| PHP.B, B2, B3 | Deverman et al, 2016/CREATE | Broad CNS transduction | Good | 1 round from AAV9 |
| PHP.A | Deverman et al, 2016/CREATE | Astrocyte transduction | Poor; prone to precipitate upon storage at 4° C. | 1 round from AAV9 |
| PHP.eB | Chan et al, 2017/CREATE | Enhanced Broad CNS transduction | Good | 2 rounds from AAV9 or 1 round from PHP.B |
| PHP.S | Chan et al, 2017/CREATE | Sensory neuron transduction | Good | 1 round from AAV9 |

TABLE 9-continued

AAV-PHP vectors identified by CREATE and M-CREATE. The table provides
a summary of the variants that have been identified so far using CREATE
and M-CREATE, along with their tropism and the evolutionary steps
from the parent capsid that was involved in their discovery.

| AAV Variants | Reference/ Selection method | Tropism | Production | Rounds of evolution from parent capsid |
|---|---|---|---|---|
| PHP.V1, V2 | Current study/ M-CREATE | BBB Vascular cells and astrocytes transduction | Good | 1 round from AAV9 |
| PHP.B4, B7, B8, | Current study/ M-CREATE | Broad CNS transduction | Good | 1 round from AAV9 |
| PHP.B5, B6 | Current study/ M-CREATE and CREATE | Broad CNS transduction | Good | 2 rounds from AAV9 or 1 round from PHP.B |
| PHP.C1, C2, C3 | Current study/ M-CREATE | Broad CNS transduction across mouse strains | Good; PHP.C1 prone to precipitate upon storage at 4° C. | 1 round from AAV9 |
| PHP.N | Current study/ M-CREATE and CREATE | Neuron transduction | Average | 2 rounds from AAV9 or 1 round from PHP.B |

Figure 32:
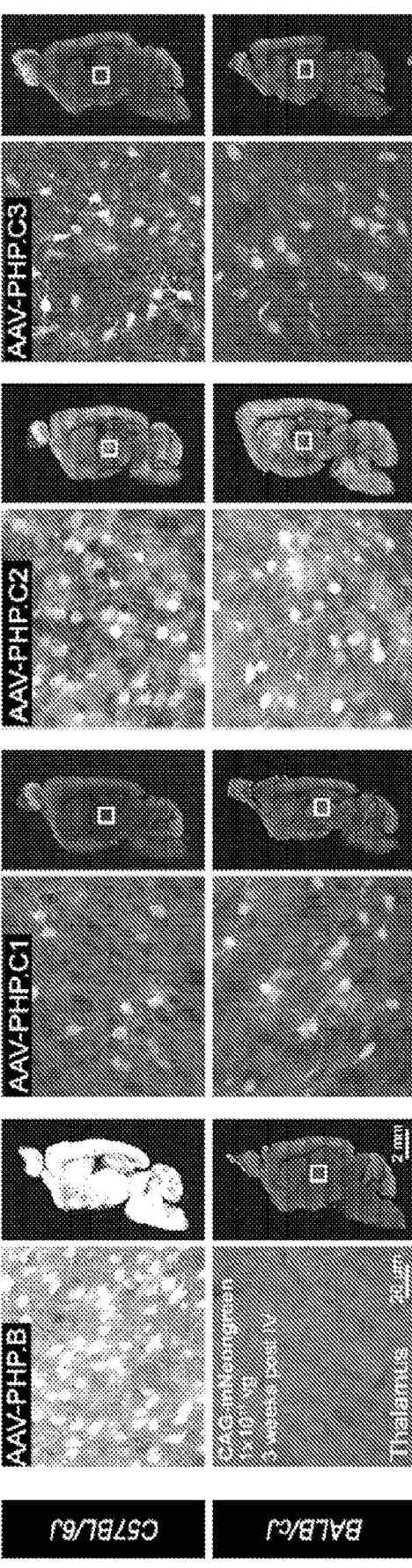
FIG. 32 shows transduction by AAV-PHP.B, AAV-PHP.C1-C3 in C57BL/6J and BALB/cJ mice in sagittal brain sections (right), along with a higher magnification image of the thalamus brain region (left).
Figure 73:
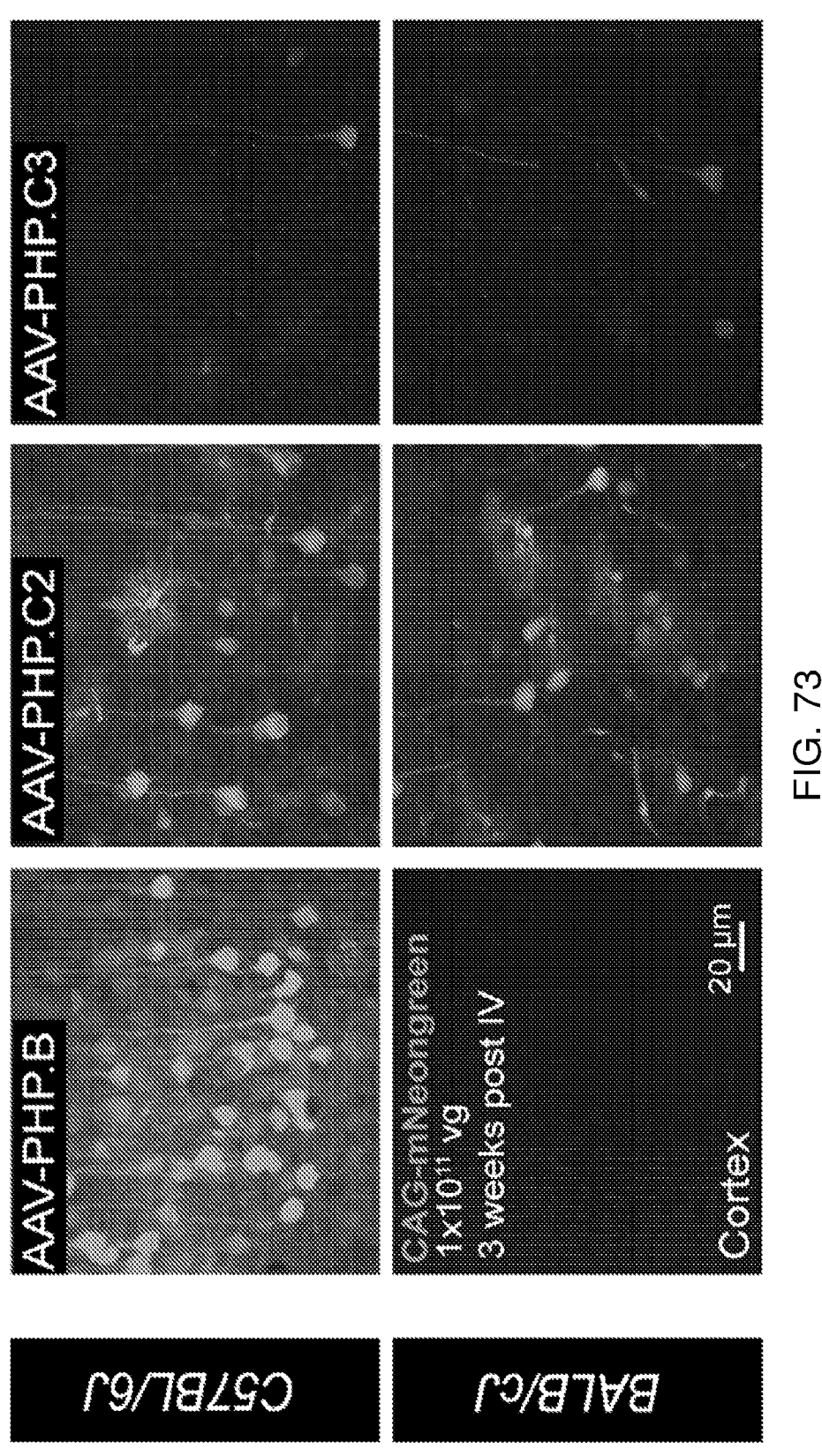
FIG. 73 shows the transduction of cortex brain region by AAV-PHP.B, AAV-PHP.C2 and AAV-PHP.C3 across two different mouse strains: C57BL/6J and BALB/cJ. The vectors were packaged with ssAAV:CAG-mNeongreen (n=2-3 per group, $1\times10^{11}$ vg IV dose/adult mouse, 3 weeks of expression). All images were acquired using the same microscope settings. The data reported in FIGS. 72 and 73 are from one independent trial where all viruses were freshly prepared and tittered in the same assay for dosage consistency, with additional validation for AAV-PHP.C2 and AAV-PHP.C3 in an independent trial for BALB/cJ.

Importantly, M-CREATE revealed many non-PHP.B-like sequence families that enriched through selection for transduction of cells in the CNS. We tested the previously mentioned AAV-PHP.C1: RYQGDSV, as well as AAV-PHP.C2: WSTNAGY, and AAV-PHP.C3: ERVGFAQ (FIG. 30). These showed enhanced BBB crossing irrespective of mouse strain, with roughly equal CNS transduction in BALB/cJ and C57BL/6J (FIGS. 32 and 73). Collectively, these preliminary studies suggest that M-CREATE is capable of finding capsid variants with diverse mechanisms of BBB entry that lack strain-specificity.

Example 8. Exemplary Insertion of Variant AAV Capsid Protein Sequence

Demonstration of 7 amino acid peptide insertion in AAV capsid: Peptide sequence "TLQIPFK" (SEQ ID: 435) is positioned between AA 588-589 of AAV capsid. The insertion sequence is underlined and bold.

MAADGYLPDWLEDNLSEGIREWWALKPGAPQPKANQQHQDNARGLVLPGY

KYLGPGNGLDKGEPVNAADAAALEHDKAYDQQLKAGDNPYLKYNHADAEF

QERLKEDTSFGGNLGRAVFQAKKRLLEPLGLVEEAAKTAPGKKRPVEQSP

QEPDSSAGIGKSGAQPAKKRLNFGQTGDTESVPDPQPIGEPPAAPSGVGS

LTMASGGGAPVADNNEGADGVGSSSGNWHCDSQWLGDRVITTSTRTWALP

TYNNHLYKQISNSTSGGSSNDNAYFGYSTPWGYFDFNRFHCHFSPRDWQR

LINNNWGFRPKRLNFKLFNIQVKEVTDNNGVKTIANNLTSTVQVFTDSDY

QLPYVLGSAHEGCLPPFPADVFMIPQYGYLTLNDGSQAVGRSSFYCLEYF

PSQMLRTGNNFQFSYEFENVPFHSSYAHSQSLDRLMNPLIDQYLYYLSRT

INGSGQNQQTLKFSVAGPSNMAVQGRNYIPGPSYRQQRVSTTVTQNNNSE

FAWPGASSWALNGRNSLMNPGPAMASHKEGEDRFFPLSGSLIFGKQGTGR

DNVDADKVMITNEEEIKTTNPVATESYGQVATNHQSAQTLQIPFKAQAQT

GWVQNQGILPGMVWQDRDVYLQGPIWAKIPHTDGNFHPSPLMGGFGMKHP

PPQILIKNTPVPADPPTAFNKDKLNSFITQYSTGQVSVEIEWELQKENSK

RWNPEIQYTSNYYKSNNVEFAVNTEGVYSEPRPIGTRYLTRNL

Demonstration of 11 amino acid peptide insertion in AAV capsid:

Peptide sequence "DGTTLKPFLAQ" (SEQ ID: 867) is positioned by replacing AA 587-590 of AAV capsid. The inserted sequence is underlined and highlighted.

MAADGYLPDWLEDNLSEGIREWWALKPGAPQPKANQQHQDNARGLVLPGY

KYLGPGNGLDKGEPVNAADAAALEHDKAYDQQLKAGDNPYLKYNHADAEF

QERLKEDTSFGGNLGRAVFQAKKRLLEPLGLVEEAAKTAPGKKRPVEQSP

QEPDSSAGIGKSGAQPAKKRLNFGQTGDTESVPDPQPIGEPPAAPSGVGS

LTMASGGGAPVADNNEGADGVGSSSGNWHCDSQWLGDRVITTSTRTWALP

TYNNHLYKQISNSTSGGSSNDNAYFGYSTPWGYFDFNRFHCHFSPRDWQR

LINNNWGFRPKRLNFKLFNIQVKEVTDNNGVKTIANNLTSTVQVFTDSDY

QLPYVLGSAHEGCLPPFPADVFMIPQYGYLTLNDGSQAVGRSSFYCLEYF

PSQMLRTGNNFQFSYEFENVPFHSSYAHSQSLDRLMNPLIDQYLYYLSRT

INGSGQNQQTLKFSVAGPSNMAVQGRNYIPGPSYRQQRVSTTVTQNNNSE

FAWPGASSWALNGRNSLMNPGPAMASHKEGEDRFFPLSGSLIFGKQGTGR

DNVDADKVMITNEEEIKTTNPVATESYGQVATNHQSDGTTLKPFLAQAQT

GWVQNQGILPGMVWQDRDVYLQGPIWAKIPHTDGNFHPSPLMGGFGMKHP

PPQILIKNTPVPADPPTAFNKDKLNSFITQYSTGQVSVEIEWELQKENSK

RWNPEIQYTSNYYKSNNVEFAVNTEGVYSEPRPIGTRYLTRNL.

Example 9. Treating Huntington's Disease (HD)

A subject having Huntington's disease is identified. The subject is then systemically administered a first amount of a viral vector that includes a polynucleotide that encodes for a Zinc finger protein (ZFP) engineered to represses the transcription of the Huntingtin (HTT) gene. The vector will be encapsidated by a modified AAV capsid protein with an amino acid sequence provided in FIG. 33 or provided in Tables 2-4, so as to allow proper targeting of the ZFP to the nervous system, among other organs. If needed, the subject is administered a second or third dose of the vector, until a therapeutically effective amount of the ZFP is expressed in the subject in the nervous system.

Example 10. Phase 1A Clinical Trial

A phase 1A clinical trial is performed to evaluate the safety, tolerability, pharmacokinetics, and pharmacodynamics of an one-time intravenous injection of test composition comprising viral vector encapsidated by a modified capsid protein with any of the amino acid sequences provided in FIG. 33 or Tables 2-4, in subjects with late Huntington's Disease (HD). Eligible subjects are men and women between 21 and 65 years of age.

Inclusion Criteria: Eligible subjects are men and women between 21 and 65 years of age. Subjects that (i) sign and date Sign and date International Classification of Functioning, Disability and Health (ICF); (2) male or female participant aged ≥21 and ≤65; (3) participants who submit medical report (PCR) attesting Huntington's disease with a number of CAG repeats on chromosome 4, greater than or equal to 40 and less than or equal to 50 (if the participant has not performed the examination and/or if he does not have the report available, a new exam should be done); (4) Score 5 points or more in motor assessment UHDRS scale (Unified Huntington's Disease Rating Scale) at the time of enrollment; (5) Score between 8 and 11 points in the functional capacity of the UHDRS scale at the time of enrollment.

Exclusion Criteria: (1) Any medical observation data (clinical and physical) that medical research judge as a risk for subject if enrollment at the study; (2) any laboratory exam data that medical research judge as a risk for subject if enrollment at the study; (4) history of epilepsy; (5) diagnostic of major cognitive impairment; (6) active decompensated psychiatric disease; (7) current or prior history of neoplasia; (8) current history of gastrointestinal, hepatic, renal, endocrine, pulmonary, hematologic, immune, metabolic pathology or severe and uncontrolled cardiovascular disease; (8) diagnostic of any active infection, be it viral, bacterial, fungal, or caused by another pathogen; (9) participants who have contraindication to undergo any of the tests performed in this study, for example, have pacemakers or surgical clip; (10) history of alcohol or illegal drugs abusers; (11) history of 1 or more episodes of suicide in the two years before Visit V-4; (12) active smoker or have stopped smoking less than six months prior to enrollment; (13) test positive in at least one of the serological tests: HIV 1 and 2 (Anti-HIV-1,2), HTLV I and II, HBV (HBsAg, anti-HBc), HCV (anti-HCV-Ab) and VDRL (Treponema pallidum); (14) history of drug allergy, including contrasts for imaging, or bovine products; (15) in use or expected use of immunosuppressive drugs or prohibited medicines for the first three months after the first administration of the investigational product; (16) any clinical changes that is interpreted by the medical researcher as a risk to participant's enrollment.

Experimental:

Placebo. One-time injection of placebo at Week 0.

Test High Dose. One-time injection of test composition $2\times10^{10}$ vg at Week 0.

Test Middle Dose. One-time injection of test composition $6\times10^{9}$ vg at Week 0.

Test Low Dose. One-time injection of test composition $2\times10^{9}$ vg at Week 0.

Test Lowest Dose. One-time injection of test composition $2\times10^{8}$ vg at Week 0.

Primary Outcome Measures: Safety of the test composition by periodic monitoring changes at adverse events, vital signs, laboratory tests, ECG and incidence of benign and malignant neoplasms [Time Frame: five years]. The safety of the investigational product will be evaluated in detail from periodic evaluations contemplating monitoring changes of: (1) adverse events including type, frequency, intensity, seriousness, severity, and action taken related to the investigational product study; (2) vital signs (BP, HR, axillary temperature), physical and medical examination (BMI, weight, height, medical condition—cardiovascular, pulmonary, digestive, musculoskeletal and peripheral, with emphasis on the neurological assessment and others); (2) laboratory tests included hematologic, biochemical, urologic and serological analysis; (3) electrocardiogram (ECG) of 12 derivations; (4) and incidence and classification of benign and malignant neoplasms in the following organs/systems: CNS, lung, liver, spleen, pancreas, prostate, testicle, urinary, hematological and skeletal system through the laboratory tests, magnetic resonance imaging, computerized tomography and ultrasonography.

Secondary Outcome Measures: Preliminary efficacy of Cellavita HD by global clinical response (CIBIS) and UHDRS improvement [Time Frame: five years] will be evaluated by statistical comparison of the results of each UHDRS scale component: motor, cognitive and behavior. The global clinical response will be assessed by statistical comparison between baseline score observed by the Investigator before and after Cellavita HD treatment. Preliminary efficacy of Cellavita HD by comparison of the inflammatory markers [Time Frame: one year] will be evaluated by statistical comparison of the inflammatory markers included IL-4, IL-6, IL-10 (interleukin IL) and TNF-alpha (tumoral necrosis factor alpha). Immunological Response of Cellavita HD [Time Frame: one year]. The immunological response induced by Cellavita HD will be evaluated by statistical comparison between baseline results of CD4+ and CD8+ proliferation and the other evaluated times. Preliminary efficacy of Cellavita HD by comparison of the CNS assessment [Time Frame: one year]. Will be evaluated by statistical comparison of the CNS assessment through magnetic resonance image at cortical thickness measurements, volumes of different brain structures, especially the basal ganglia, with special attention to caudate and metabolic changes identified in proton spectroscopy. Risk of suicidal ideation by Hamilton Depression Rating Scale (HDRS) [Time Frame: five years] will be evaluated by suicidal domain. The classificatory pontuation may correspond to mild depression (score: 8 to 13), moderate depression (score: 19-22) and severe depression (score: >23).

While preferred instances of the present examples have been shown and described herein, it will be obvious to those skilled in the art that such instances are provided by way of example only. Numerous variations, changes, and substitutions will now occur to those skilled in the art without departing from the disclosure. It should be understood that various alternatives to the instances of the disclosure described herein may be employed in practicing the disclosure. It is intended that the following claims define the scope of the disclosure and that methods and structures within the scope of these claims and their equivalents be covered thereby.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

---

SEQUENCE LISTING (15197 sequences)

SEQ ID NO: 1 - protein, 736 aa, Artificial Sequence
  Synthetic Construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 2 - protein, 743 aa, Artificial Sequence
  Synthetic Construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 3 - protein, 743 aa, Artificial Sequence
  Synthetic Construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQQAVRTSLAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4 - protein, 743 aa, Artificial Sequence
  Synthetic Construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 5 - protein, 743 aa, Artificial Sequence
  Synthetic Construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFSNPAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 6 - DNA, 2211 bp, Artificial Sequence
  Synthetic Construct
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 7 - DNA, 2230 bp, Artificial Sequence
  Synthetic Construct
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagcggtcaacgcagcagacgcggcggccctcgagcacgacaagcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 8 - DNA, 2232 bp, Artificial Sequence
  Synthetic Construct
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaacaggcggttaggacgtctttggcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 9 - DNA, 2232 bp, Artificial Sequence
  Synthetic Construct
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgatgggactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 10 - DNA, 21 bp, Artificial Sequence
  Synthetic Construct
acgttgcagattccttttaag

SEQ ID NO: 11 - DNA, 21 bp, Artificial Sequence
  Synthetic Construct
accgccctcaaacccttcctc

SEQ ID NO: 12 - DNA, 21 bp, Artificial Sequence
  Synthetic Construct
accaccctcaaacccttcctc

SEQ ID NO: 13 - DNA, 21 bp, Artificial Sequence
  Synthetic Construct
agcatcgaaagacccttcaaa

SEQ ID NO: 14 - DNA, 21 bp, Artificial Sequence
  Synthetic Construct
acccaaaacagacccttcctc

SEQ ID NO: 15 - DNA, 21 bp, Artificial Sequence
  Synthetic Construct
accatgcaaaaacccttcatc

SEQ ID NO: 16 - DNA, 21 bp, Artificial Sequence
  Synthetic Construct
actagtacgcggccgtttttg

SEQ ID NO: 17 - DNA, 21 bp, Artificial Sequence
  Synthetic Construct
ggcaccttcgtcccccccacc

SEQ ID NO: 18 - DNA, 21 bp, Artificial Sequence
  Synthetic Construct
tggtcgactaatgcgggttat

SEQ ID NO: 19 - DNA, 21 bp, Artificial Sequence
  Synthetic Construct
accctcgaaagacccttcacc

SEQ ID NO: 20 - DNA, 21 bp, Artificial Sequence
  Synthetic Construct
actgctgctaagccgtttctg

SEQ ID NO: 21 - DNA, 21 bp, Artificial Sequence
  Synthetic Construct
attaggattggttattcgcag

SEQ ID NO: 22 - DNA, 21 bp, Artificial Sequence
  Synthetic Construct
gagcgtgtgggttttgctcag

SEQ ID NO: 23 - DNA, 21 bp, Artificial Sequence
  Synthetic Construct
gccgacctcctcaactacaga

SEQ ID NO: 24 - DNA, 21 bp, Artificial Sequence
  Synthetic Construct
ctcgtcgccggcttcagccaa

SEQ ID NO: 25 - DNA, 21 bp, Artificial Sequence
  Synthetic Construct
tcgtctctgaagccttttctg

SEQ ID NO: 26 - DNA, 21 bp, Artificial Sequence
  Synthetic Construct
acgcattctaggccgtttatt

SEQ ID NO: 27 - DNA, 21 bp, Artificial Sequence
  Synthetic Construct
ccttttcctggttattctgcg

SEQ ID NO: 28 - DNA, 21 bp, Artificial Sequence
  Synthetic Construct
attattgttgggtatagtcag

SEQ ID NO: 29 - DNA, 21 bp, Artificial Sequence
  Synthetic Construct
aggtatcagggtgattctgtt

SEQ ID NO: 30 - DNA, 21 bp, Artificial Sequence
  Synthetic Construct
aggtatgctggggattctatt

SEQ ID NO: 31 - DNA, 21 bp, Artificial Sequence
  Synthetic Construct
aagacgattggggagcattgg

SEQ ID NO: 32 - DNA, 21 bp, Artificial Sequence
  Synthetic Construct
tggatgacgcatggttctgcg

SEQ ID NO: 33 - DNA, 21 bp, Artificial Sequence
  Synthetic Construct
gctgcttcgaggccgtttctt

SEQ ID NO: 34 - DNA, 21 bp, Artificial Sequence
  Synthetic Construct
actacttctaggccgtttctt

SEQ ID NO: 35 - DNA, 21 bp, Artificial Sequence
  Synthetic Construct
gctcgtgtgggtttggctcag

SEQ ID NO: 36 - DNA, 21 bp, Artificial Sequence
  Synthetic Construct
gggactagtccgaatcttgcg

SEQ ID NO: 37 - DNA, 21 bp, Artificial Sequence
  Synthetic Construct
gtgcgtacggggtatagttct

SEQ ID NO: 38 - DNA, 21 bp, Artificial Sequence
  Synthetic Construct
attcgggtggggtatagttct

SEQ ID NO: 39 - DNA, 21 bp, Artificial Sequence
  Synthetic Construct
actactttgcgtccgtttatt

SEQ ID NO: 40 - DNA, 21 bp, Artificial Sequence
  Synthetic Construct
ggtattacgtctctgtttaag

SEQ ID NO: 41 - DNA, 21 bp, Artificial Sequence
  Synthetic Construct
accacccaaacccccttcaga

SEQ ID NO: 42 - DNA, 21 bp, Artificial Sequence
  Synthetic Construct
actgtgtcgaggccgtttttg

SEQ ID NO: 43 - DNA, 21 bp, Artificial Sequence
  Synthetic Construct
tatgggacgaatccgtttcgt

SEQ ID NO: 44 - DNA, 21 bp, Artificial Sequence
  Synthetic Construct
cccaccatggtcgacagcagc

SEQ ID NO: 45 - DNA, 21 bp, Artificial Sequence
  Synthetic Construct
aataaggctagttctcagaat

SEQ ID NO: 46 - DNA, 21 bp, Artificial Sequence
  Synthetic Construct
acttttcgtagttcgaatgat

SEQ ID NO: 47 - DNA, 21 bp, Artificial Sequence
  Synthetic Construct
ctgccggatcgttatcctaat

SEQ ID NO: 48 - DNA, 21 bp, Artificial Sequence
  Synthetic Construct
cagaatgttacgaagggtgtt

SEQ ID NO: 49 - DNA, 21 bp, Artificial Sequence
  Synthetic Construct
gctcagtctccgattcttcgg

SEQ ID NO: 50 - DNA, 21 bp, Artificial Sequence
  Synthetic Construct
gtggctactggttattcttcg

SEQ ID NO: 51 - DNA, 21 bp, Artificial Sequence
  Synthetic Construct
ttgaattcgaatcggcctaat

SEQ ID NO: 52 - DNA, 21 bp, Artificial Sequence
  Synthetic Construct
acgattcgtaataatacgatt

SEQ ID NO: 53 - DNA, 21 bp, Artificial Sequence
  Synthetic Construct
gatcttagtcgtatttttaag

SEQ ID NO: 54 - DNA, 21 bp, Artificial Sequence
  Synthetic Construct
ctcagcaacagcgccagccaa

SEQ ID NO: 55 - DNA, 21 bp, Artificial Sequence
  Synthetic Construct
ctcgaaaacatggtcatgagc

SEQ ID NO: 56 - DNA, 21 bp, Artificial Sequence
  Synthetic Construct
ttgactcagcagacggatgtt

SEQ ID NO: 57 - DNA, 21 bp, Artificial Sequence
  Synthetic Construct
gccggcctcgcccacgccacc

SEQ ID NO: 58 - DNA, 21 bp, Artificial Sequence
  Synthetic Construct
aatgctcatactgcgctggat

SEQ ID NO: 59 - DNA, 21 bp, Artificial Sequence
  Synthetic Construct
tggccgattcttcgggctgat

SEQ ID NO: 60 - DNA, 21 bp, Artificial Sequence
  Synthetic Construct
gcgctggctggtctgtctctg

SEQ ID NO: 61 - DNA, 21 bp, Artificial Sequence
  Synthetic Construct
cgtattgatatgccttttaag

SEQ ID NO: 62 - DNA, 21 bp, Artificial Sequence
  Synthetic Construct
acgatgtcgttgagtagtagt

SEQ ID NO: 63 - DNA, 21 bp, Artificial Sequence
  Synthetic Construct
caaaacgtcgccaaaaacctc

SEQ ID NO: 64 - DNA, 21 bp, Artificial Sequence
  Synthetic Construct
ttcgacaaccccaacaacgtc

SEQ ID NO: 65 - DNA, 21 bp, Artificial Sequence
  Synthetic Construct
gtcctcatgagagaaagcctc

SEQ ID NO: 66 - DNA, 21 bp, Artificial Sequence
  Synthetic Construct
caccacgacaccggcagcgcc

SEQ ID NO: 67 - DNA, 21 bp, Artificial Sequence
  Synthetic Construct
gatgcgccgaatagtgtggat

SEQ ID NO: 68 - DNA, 21 bp, Artificial Sequence
  Synthetic Construct
actgcgagtagggatgctaag

SEQ ID NO: 69 - DNA, 21 bp, Artificial Sequence
  Synthetic Construct
actaattatacgaagcagatt

SEQ ID NO: 70 - DNA, 21 bp, Artificial Sequence
  Synthetic Construct
cctcataatgcttctgtgttg

SEQ ID NO: 71 - DNA, 21 bp, Artificial Sequence
  Synthetic Construct
accaacaacaccagaaacatc

SEQ ID NO: 72 - DNA, 21 bp, Artificial Sequence
  Synthetic Construct
atggttcctaatcattctggt

SEQ ID NO: 73 - DNA, 21 bp, Artificial Sequence
  Synthetic Construct
ccggtgccgcagtctgagcat

SEQ ID NO: 74 - DNA, 21 bp, Artificial Sequence
  Synthetic Construct
ctctaccacggcggcagcacc

SEQ ID NO: 75 - DNA, 21 bp, Artificial Sequence
  Synthetic Construct
atgattcatactagggagacg

SEQ ID NO: 76 - DNA, 21 bp, Artificial Sequence
  Synthetic Construct
actaataatacgaagcctctt

SEQ ID NO: 77 - DNA, 21 bp, Artificial Sequence
  Synthetic Construct
ctcaacaccaccagaaacacc

SEQ ID NO: 78 - DNA, 21 bp, Artificial Sequence
  Synthetic Construct
gctttgcataattctcagaat

SEQ ID NO: 79 - DNA, 21 bp, Artificial Sequence
  Synthetic Construct
gtgaatagtacgaggaatgtt

SEQ ID NO: 80 - DNA, 21 bp, Artificial Sequence
  Synthetic Construct
ggtgttggggttgttacgaag

SEQ ID NO: 81 - DNA, 21 bp, Artificial Sequence
  Synthetic Construct
gttttgtcgaagcagttggct

SEQ ID NO: 82 - DNA, 21 bp, Artificial Sequence
  Synthetic Construct
tctaagtctctgcagccgttg

SEQ ID NO: 83 - DNA, 21 bp, Artificial Sequence
  Synthetic Construct
tcgaattctacgcggttggtt

SEQ ID NO: 84 - DNA, 21 bp, Artificial Sequence
  Synthetic Construct
ctcaaccaaaccaaacaaatc

SEQ ID NO: 85 - DNA, 21 bp, Artificial Sequence
  Synthetic Construct
aacaacagcgtcagacaactc

SEQ ID NO: 86 - DNA, 21 bp, Artificial Sequence
  Synthetic Construct
atgtcggggtattcgcatact

SEQ ID NO: 87 - DNA, 21 bp, Artificial Sequence
  Synthetic Construct
gtcaaagtccccatcatcacc

SEQ ID NO: 88 - DNA, 21 bp, Artificial Sequence
  Synthetic Construct
gggaataatactcgggcggtg

SEQ ID NO: 89 - DNA, 21 bp, Artificial Sequence
  Synthetic Construct
cagaatcagattaagaatatt

SEQ ID NO: 90 - DNA, 21 bp, Artificial Sequence
  Synthetic Construct
accaacatgaccaaacccctc

SEQ ID NO: 91 - DNA, 21 bp, Artificial Sequence
  Synthetic Construct
aacaacagcaccagactcagc

SEQ ID NO: 92 - DNA, 21 bp, Artificial Sequence
  Synthetic Construct
agcatgctcaccagcatcgtc

SEQ ID NO: 93 - DNA, 21 bp, Artificial Sequence
  Synthetic Construct
ctcaacgccaccgccagcaga

SEQ ID NO: 94 - DNA, 21 bp, Artificial Sequence
  Synthetic Construct
aatactggggtgcaggttagg

SEQ ID NO: 95 - DNA, 21 bp, Artificial Sequence
  Synthetic Construct
accaacaccgtcagacccatc

SEQ ID NO: 96 - DNA, 21 bp, Artificial Sequence
  Synthetic Construct
cagtctacgccgggggctact

SEQ ID NO: 97 - DNA, 21 bp, Artificial Sequence
  Synthetic Construct
ggtcattctgagaattctcgt

SEQ ID NO: 98 - DNA, 21 bp, Artificial Sequence
  Synthetic Construct
ctccccacccaaaccctcaga

SEQ ID NO: 99 - DNA, 21 bp, Artificial Sequence
  Synthetic Construct
aagaatgctccgatgcctgat

SEQ ID NO: 100 - DNA, 21 bp, Artificial Sequence
  Synthetic Construct
agcaacagcaccaaacccacc

SEQ ID NO: 101 - DNA, 21 bp, Artificial Sequence
  Synthetic Construct
cctattattactatgcctgct

SEQ ID NO: 102 - DNA, 21 bp, Artificial Sequence
  Synthetic Construct
cccctcaaaggcatcggcagc

SEQ ID NO: 103 - DNA, 21 bp, Artificial Sequence
  Synthetic Construct
gtcctcagcgtcaaccacctc

SEQ ID NO: 104 - DNA, 21 bp, Artificial Sequence
  Synthetic Construct
agtgtggctgctgtgcatatg

SEQ ID NO: 105 - DNA, 21 bp, Artificial Sequence
  Synthetic Construct
agcaacagcatcagactcgtc

SEQ ID NO: 106 - DNA, 21 bp, Artificial Sequence
  Synthetic Construct
cataatgatactcgtcctctt

SEQ ID NO: 107 - DNA, 21 bp, Artificial Sequence
  Synthetic Construct
cctccggtgaggtctacggct

SEQ ID NO: 108 - DNA, 21 bp, Artificial Sequence
  Synthetic Construct
atgaacaccgtcagaaacctc

SEQ ID NO: 109 - DNA, 21 bp, Artificial Sequence
  Synthetic Construct
ttgacggatggtcatcggatt

SEQ ID NO: 110 - DNA, 21 bp, Artificial Sequence
  Synthetic Construct
acgaatgcggtgaagctgact

SEQ ID NO: 111 - DNA, 21 bp, Artificial Sequence
  Synthetic Construct
cgtgtggatgcggttttgagt

SEQ ID NO: 112 - DNA, 21 bp, Artificial Sequence
  Synthetic Construct
accaacgccgtcaaaagcacc

SEQ ID NO: 113 - DNA, 21 bp, Artificial Sequence
  Synthetic Construct
atgctcaacaccaccgccaga

SEQ ID NO: 114 - DNA, 21 bp, Artificial Sequence
  Synthetic Construct
ggcaacaacaccagacccacc

SEQ ID NO: 115 - DNA, 21 bp, Artificial Sequence
  Synthetic Construct
cagtctgggggtagtgcgttg

SEQ ID NO: 116 - DNA, 21 bp, Artificial Sequence
  Synthetic Construct
gtgattgctttgtctactatg

SEQ ID NO: 117 - DNA, 21 bp, Artificial Sequence
  Synthetic Construct
ctgaatacgattcggaatgtg

SEQ ID NO: 118 - DNA, 21 bp, Artificial Sequence
  Synthetic Construct
agcaacgccaccagaagcgtc

SEQ ID NO: 119 - DNA, 21 bp, Artificial Sequence
  Synthetic Construct
ggcaacggcaccaaattcatc

SEQ ID NO: 120 - DNA, 21 bp, Artificial Sequence
  Synthetic Construct
agcaacaccatcagacccgtc

SEQ ID NO: 121 - DNA, 21 bp, Artificial Sequence
  Synthetic Construct
agcaacagcaccagagccatc

SEQ ID NO: 122 - DNA, 21 bp, Artificial Sequence
  Synthetic Construct
tttcatttgactgataggggt

SEQ ID NO: 123 - DNA, 21 bp, Artificial Sequence
  Synthetic Construct
ccgattaggtcggatactgtg

SEQ ID NO: 124 - DNA, 21 bp, Artificial Sequence
  Synthetic Construct
gccaaccaaatccacaacacc

SEQ ID NO: 125 - DNA, 21 bp, Artificial Sequence
  Synthetic Construct
tcgaatacggttcggaatact

SEQ ID NO: 126 - DNA, 21 bp, Artificial Sequence
  Synthetic Construct
accagcctcggctacagcagc

SEQ ID NO: 127 - DNA, 21 bp, Artificial Sequence
  Synthetic Construct
atcagcggcgtccaaaccaga

SEQ ID NO: 128 - DNA, 21 bp, Artificial Sequence
  Synthetic Construct
tcgaatgctgttaggcagact

SEQ ID NO: 129 - DNA, 21 bp, Artificial Sequence
  Synthetic Construct
tctctttctgagcttaggatt

SEQ ID NO: 130 - DNA, 21 bp, Artificial Sequence
  Synthetic Construct
agtactgagaagagggatgag

SEQ ID NO: 131 - DNA, 21 bp, Artificial Sequence
  Synthetic Construct
aacctcgtcggcaccctcatc

SEQ ID NO: 132 - DNA, 21 bp, Artificial Sequence
  Synthetic Construct
ggcaacaacatcagactcacc

SEQ ID NO: 133 - DNA, 21 bp, Artificial Sequence
  Synthetic Construct
gccgtccccaccggcctcaga

SEQ ID NO: 134 - DNA, 21 bp, Artificial Sequence
  Synthetic Construct
ggtgataatagtctgactagg

SEQ ID NO: 135 - DNA, 21 bp, Artificial Sequence
  Synthetic Construct
cacgccgacaacagactcaaa

SEQ ID NO: 136 - DNA, 21 bp, Artificial Sequence
  Synthetic Construct
agcaacgccaccagaaacttc

SEQ ID NO: 137 - DNA, 21 bp, Artificial Sequence
  Synthetic Construct
gggaatacgactagggggctg

SEQ ID NO: 138 - DNA, 21 bp, Artificial Sequence
  Synthetic Construct
ctcaacctcaccgccaccaac

SEQ ID NO: 139 - DNA, 21 bp, Artificial Sequence
  Synthetic Construct
agcggcgtcagcaccaccgac

SEQ ID NO: 140 - DNA, 21 bp, Artificial Sequence
  Synthetic Construct
tatgctaagacgttggctatg

SEQ ID NO: 141 - DNA, 21 bp, Artificial Sequence
  Synthetic Construct
atgaaccacaccaaacccacc

SEQ ID NO: 142 - DNA, 21 bp, Artificial Sequence
  Synthetic Construct
gctaatgctacgaggaattct

SEQ ID NO: 143 - DNA, 21 bp, Artificial Sequence
  Synthetic Construct
caaaaccaaaccaaaatcacc

SEQ ID NO: 144 - DNA, 21 bp, Artificial Sequence
  Synthetic Construct
tctaatgctattaaggctacg

SEQ ID NO: 145 - DNA, 21 bp, Artificial Sequence
  Synthetic Construct
tatcctgataattatggtaag

SEQ ID NO: 146 - DNA, 21 bp, Artificial Sequence
  Synthetic Construct
ggcaacaccaccatcagaagc

SEQ ID NO: 147 - DNA, 21 bp, Artificial Sequence
  Synthetic Construct
ctgggtcttacgggtgcggtt

SEQ ID NO: 148 - DNA, 21 bp, Artificial Sequence
  Synthetic Construct
gcgaatagtacgcgtattctg

SEQ ID NO: 149 - DNA, 21 bp, Artificial Sequence
  Synthetic Construct
gataatgcgattcgtgcgcag

SEQ ID NO: 150 - DNA, 21 bp, Artificial Sequence
  Synthetic Construct
acgaattatactaagcttatg

SEQ ID NO: 151 - DNA, 21 bp, Artificial Sequence
  Synthetic Construct
cataatagtcctagtagttat

SEQ ID NO: 152 - DNA, 21 bp, Artificial Sequence
  Synthetic Construct
gagaatatggttcggtctgtg

SEQ ID NO: 153 - DNA, 21 bp, Artificial Sequence
  Synthetic Construct
accaacaacatcaaaagctac

SEQ ID NO: 154 - DNA, 21 bp, Artificial Sequence
  Synthetic Construct
actaattcgacgaggcctgtg

SEQ ID NO: 155 - DNA, 21 bp, Artificial Sequence
  Synthetic Construct
catacggctccgcctcatcct

SEQ ID NO: 156 - DNA, 21 bp, Artificial Sequence
  Synthetic Construct
gccctcagccaaaacaccagc

SEQ ID NO: 157 - DNA, 21 bp, Artificial Sequence
  Synthetic Construct
ccgaatgtgactaagaatgct

SEQ ID NO: 158 - DNA, 21 bp, Artificial Sequence
  Synthetic Construct
cttgatacgctgacgggttat

SEQ ID NO: 159 - DNA, 21 bp, Artificial Sequence
  Synthetic Construct
cctaatagtgtgcgttctgtt

SEQ ID NO: 160 - DNA, 21 bp, Artificial Sequence
  Synthetic Construct
accagcagccacctcccccac

SEQ ID NO: 161 - DNA, 21 bp, Artificial Sequence
  Synthetic Construct
gttcttcatggtggtaatgat

SEQ ID NO: 162 - DNA, 21 bp, Artificial Sequence
  Synthetic Construct
agcaactacgtcaaaagcgcc

SEQ ID NO: 163 - DNA, 21 bp, Artificial Sequence
  Synthetic Construct
gacaacaacagcaccagatgg

SEQ ID NO: 164 - DNA, 21 bp, Artificial Sequence
  Synthetic Construct
actgtgatgaagggttttact

SEQ ID NO: 165 - DNA, 21 bp, Artificial Sequence
  Synthetic Construct
agccacaccctcagcaccctc

SEQ ID NO: 166 - DNA, 21 bp, Artificial Sequence
  Synthetic Construct
cctggtcctcagcaggcgaag

SEQ ID NO: 167 - DNA, 21 bp, Artificial Sequence
  Synthetic Construct
acttttgggacgtctaagttg

SEQ ID NO: 168 - DNA, 21 bp, Artificial Sequence
  Synthetic Construct
agcaacgccgtcaccaacaga

SEQ ID NO: 169 - DNA, 21 bp, Artificial Sequence
  Synthetic Construct
ttgtctatgtcgacggtgcct

SEQ ID NO: 170 - DNA, 21 bp, Artificial Sequence
  Synthetic Construct
aggcgttatgatggtagggag

SEQ ID NO: 171 - DNA, 21 bp, Artificial Sequence
  Synthetic Construct
accaacagcaccaaaaacatc

SEQ ID NO: 172 - DNA, 21 bp, Artificial Sequence
  Synthetic Construct
attaatgctcagtggtctgcg

SEQ ID NO: 173 - DNA, 21 bp, Artificial Sequence
  Synthetic Construct
gcccaaaccagcaacgacccc

SEQ ID NO: 174 - DNA, 21 bp, Artificial Sequence
  Synthetic Construct
acgaatgagactaggatggtg

SEQ ID NO: 175 - DNA, 21 bp, Artificial Sequence
  Synthetic Construct
gccaacgccaccagaggcgtc

SEQ ID NO: 176 - DNA, 21 bp, Artificial Sequence
  Synthetic Construct
gcggatgtgaatgcttcgggt

SEQ ID NO: 177 - DNA, 21 bp, Artificial Sequence
  Synthetic Construct
cttagtgagcggaattatgtg

SEQ ID NO: 178 - DNA, 21 bp, Artificial Sequence
  Synthetic Construct
agtggtgagcttgcgcgggcg

SEQ ID NO: 179 - DNA, 21 bp, Artificial Sequence
  Synthetic Construct
gggaatactgctaagaatatt

SEQ ID NO: 180 - DNA, 21 bp, Artificial Sequence
  Synthetic Construct
gacaacgccgtcagacccctc

SEQ ID NO: 181 - DNA, 21 bp, Artificial Sequence
  Synthetic Construct
atgatgctcagcggcctcaac

SEQ ID NO: 182 - DNA, 21 bp, Artificial Sequence
  Synthetic Construct
cccaacaccatcagaaacgtc

SEQ ID NO: 183 - DNA, 21 bp, Artificial Sequence
  Synthetic Construct
gagaatttgacgcgtggggtg

SEQ ID NO: 184 - DNA, 21 bp, Artificial Sequence
  Synthetic Construct
tttagtgctcggagtacgggg

SEQ ID NO: 185 - DNA, 21 bp, Artificial Sequence
  Synthetic Construct
gaaaacgccaccagaacctac

SEQ ID NO: 186 - DNA, 21 bp, Artificial Sequence
  Synthetic Construct
ggcaacagcaccagaatgaac

SEQ ID NO: 187 - DNA, 21 bp, Artificial Sequence
  Synthetic Construct
gggaattctactaagtctcct

SEQ ID NO: 188 - DNA, 21 bp, Artificial Sequence
  Synthetic Construct
atgcaaaccaccctccacctc

SEQ ID NO: 189 - DNA, 21 bp, Artificial Sequence
  Synthetic Construct
aaccccaccctcatcaccctc

SEQ ID NO: 190 - DNA, 21 bp, Artificial Sequence
  Synthetic Construct
cttatttctggtcatgcgcag

SEQ ID NO: 191 - DNA, 21 bp, Artificial Sequence
  Synthetic Construct
ttcaaccaagtcagaagcctc

SEQ ID NO: 192 - DNA, 21 bp, Artificial Sequence
  Synthetic Construct
atgaacatcctcagagaagtc

SEQ ID NO: 193 - DNA, 21 bp, Artificial Sequence
  Synthetic Construct
agtgctatgatgcgtggtgtt

SEQ ID NO: 194 - DNA, 21 bp, Artificial Sequence
  Synthetic Construct
cccatgctcagcagccccagc

SEQ ID NO: 195 - DNA, 21 bp, Artificial Sequence
  Synthetic Construct
cagaataatacgcttaggtcg

SEQ ID NO: 196 - DNA, 21 bp, Artificial Sequence
  Synthetic Construct
aggcattcggatccggtggag

SEQ ID NO: 197 - DNA, 21 bp, Artificial Sequence
  Synthetic Construct
gtgaatacgacgttttctacg

SEQ ID NO: 198 - DNA, 21 bp, Artificial Sequence
  Synthetic Construct
atcaacagcaccagaggcatc

SEQ ID NO: 199 - DNA, 21 bp, Artificial Sequence
  Synthetic Construct
accaacgccgtcagagacctc

SEQ ID NO: 200 - DNA, 21 bp, Artificial Sequence
  Synthetic Construct
tctaatagtactaggctgtcg

SEQ ID NO: 201 - DNA, 21 bp, Artificial Sequence
  Synthetic Construct
acgtctattgctgggtcgttt

SEQ ID NO: 202 - DNA, 21 bp, Artificial Sequence
  Synthetic Construct
ctcggcagcacctaccccaga

SEQ ID NO: 203 - DNA, 21 bp, Artificial Sequence
  Synthetic Construct
gccaacgtcaccacccaaaga

SEQ ID NO: 204 - DNA, 21 bp, Artificial Sequence
  Synthetic Construct
agcaacagcgtcagactcagc

SEQ ID NO: 205 - DNA, 21 bp, Artificial Sequence
  Synthetic Construct
gctacgaatgagcctgatcgg

SEQ ID NO: 206 - DNA, 21 bp, Artificial Sequence
  Synthetic Construct
agaatgaaccccgaacaaagc

SEQ ID NO: 207 - DNA, 21 bp, Artificial Sequence
  Synthetic Construct
tcggttagtggttcggctaat

SEQ ID NO: 208 - DNA, 21 bp, Artificial Sequence
  Synthetic Construct
ccgagtaatagtactacgcgt

SEQ ID NO: 209 - DNA, 21 bp, Artificial Sequence
  Synthetic Construct
ctttttcatggtacgcatgag

SEQ ID NO: 210 - DNA, 21 bp, Artificial Sequence
  Synthetic Construct
ccccaactcggcagcaccaaa

SEQ ID NO: 211 - DNA, 21 bp, Artificial Sequence
  Synthetic Construct
cccatcagcgccaacagactc

SEQ ID NO: 212 - DNA, 21 bp, Artificial Sequence
  Synthetic Construct
aattcgggtaatctttctatg

SEQ ID NO: 213 - DNA, 21 bp, Artificial Sequence
  Synthetic Construct
aaggttgaggctattgggatg

SEQ ID NO: 214 - DNA, 21 bp, Artificial Sequence
  Synthetic Construct
aagactttgcttaatagtgtt

SEQ ID NO: 215 - DNA, 21 bp, Artificial Sequence
  Synthetic Construct
aatgctatggatcttaaggtg

SEQ ID NO: 216 - DNA, 21 bp, Artificial Sequence
  Synthetic Construct
atgatgggtaatgggtcttcg

SEQ ID NO: 217 - DNA, 21 bp, Artificial Sequence
  Synthetic Construct
agcaacagcaccaaagccctc

SEQ ID NO: 218 - DNA, 21 bp, Artificial Sequence
  Synthetic Construct
tctaatagtacgcggggtacg

SEQ ID NO: 219 - DNA, 21 bp, Artificial Sequence
  Synthetic Construct
agcctcagcagcctccacgtc

SEQ ID NO: 220 - DNA, 21 bp, Artificial Sequence
  Synthetic Construct
accctcagcggcgccctcacc

SEQ ID NO: 221 - DNA, 21 bp, Artificial Sequence
  Synthetic Construct
ccgaatacggtgaggaataat

SEQ ID NO: 222 - DNA, 21 bp, Artificial Sequence
  Synthetic Construct
aataataatgtgaagatgact

SEQ ID NO: 223 - DNA, 21 bp, Artificial Sequence
  Synthetic Construct
tctgttgctaagccttttatg

SEQ ID NO: 224 - DNA, 21 bp, Artificial Sequence
  Synthetic Construct
acgcagacgactcggctttcg

SEQ ID NO: 225 - DNA, 21 bp, Artificial Sequence
  Synthetic Construct
aataatgcgactcggggtggg

SEQ ID NO: 226 - DNA, 21 bp, Artificial Sequence
  Synthetic Construct
accaacaccaccgccagaatc

SEQ ID NO: 227 - DNA, 21 bp, Artificial Sequence
  Synthetic Construct
gagaatagtattcggactatt

SEQ ID NO: 228 - DNA, 21 bp, Artificial Sequence
  Synthetic Construct
attagggagacttctgggaag

SEQ ID NO: 229 - DNA, 21 bp, Artificial Sequence
  Synthetic Construct
agcatctactaccacaccgaa

SEQ ID NO: 230 - DNA, 21 bp, Artificial Sequence
  Synthetic Construct
gtcctcgacaacagcggccaa

SEQ ID NO: 231 - DNA, 21 bp, Artificial Sequence
  Synthetic Construct
agccacaacatgaccatcaga

SEQ ID NO: 232 - DNA, 21 bp, Artificial Sequence
  Synthetic Construct
accatccccagcgccggcaaa

SEQ ID NO: 233 - DNA, 21 bp, Artificial Sequence
  Synthetic Construct
cctaggcatactttgagtcag

SEQ ID NO: 234 - DNA, 21 bp, Artificial Sequence
  Synthetic Construct
tcgcttaatgtgcaggatgtg

SEQ ID NO: 235 - DNA, 21 bp, Artificial Sequence
  Synthetic Construct
tatcagtctctggctaatccg

SEQ ID NO: 236 - DNA, 21 bp, Artificial Sequence
  Synthetic Construct
attctgaatatgtctacggat

SEQ ID NO: 237 - DNA, 21 bp, Artificial Sequence
  Synthetic Construct
gtcctccacctcggccacagc

SEQ ID NO: 238 - DNA, 21 bp, Artificial Sequence
  Synthetic Construct
ggtgttactcagactccgcgt

SEQ ID NO: 239 - DNA, 21 bp, Artificial Sequence
  Synthetic Construct
accaacgacaccagaagaatc

SEQ ID NO: 240 - DNA, 21 bp, Artificial Sequence
  Synthetic Construct
caaaccgaccacaccagcaga

SEQ ID NO: 241 - DNA, 21 bp, Artificial Sequence
  Synthetic Construct
aagaatgagattaagaatgtg

SEQ ID NO: 242 - DNA, 21 bp, Artificial Sequence
  Synthetic Construct
tggactggtaatgagaggctt

SEQ ID NO: 243 - DNA, 21 bp, Artificial Sequence
  Synthetic Construct
ggtaagagtgatgctatgcgg

SEQ ID NO: 244 - DNA, 21 bp, Artificial Sequence
  Synthetic Construct
gggaatgcgactcgtacttat

SEQ ID NO: 245 - DNA, 21 bp, Artificial Sequence
  Synthetic Construct
gccagcaacctcggcctcccc

SEQ ID NO: 246 - DNA, 21 bp, Artificial Sequence
  Synthetic Construct
agcagcctcagcggcagcccc

SEQ ID NO: 247 - DNA, 21 bp, Artificial Sequence
  Synthetic Construct
gccgccgtcaaccaaggcgtc

SEQ ID NO: 248 - DNA, 21 bp, Artificial Sequence
  Synthetic Construct
gaccaaaaccaacccagagaa

SEQ ID NO: 249 - DNA, 21 bp, Artificial Sequence
  Synthetic Construct
ctcacccaagacaaacaagcc

SEQ ID NO: 250 - DNA, 21 bp, Artificial Sequence
  Synthetic Construct
ttcggcagcaacgaacacaac

SEQ ID NO: 251 - DNA, 21 bp, Artificial Sequence
  Synthetic Construct
ctgaatcagccgaatgtgcgg

SEQ ID NO: 252 - DNA, 21 bp, Artificial Sequence
  Synthetic Construct
atgaatactacgcgtaatctg

SEQ ID NO: 253 - DNA, 21 bp, Artificial Sequence
  Synthetic Construct
actaattctactaggacgagt

SEQ ID NO: 254 - DNA, 21 bp, Artificial Sequence
  Synthetic Construct
tttgagctttcgcatgtgcct

SEQ ID NO: 255 - DNA, 21 bp, Artificial Sequence
  Synthetic Construct
gaaggcctcggcaacgccgcc

SEQ ID NO: 256 - DNA, 21 bp, Artificial Sequence
  Synthetic Construct
ctcaccgtcaccctcaaccac

SEQ ID NO: 257 - DNA, 21 bp, Artificial Sequence
  Synthetic Construct
tttgggaatgcgattcagtct

SEQ ID NO: 258 - DNA, 21 bp, Artificial Sequence
  Synthetic Construct
ccgggtgggggtttgactccg

SEQ ID NO: 259 - DNA, 21 bp, Artificial Sequence
  Synthetic Construct
cccaacatgaccagaagcctc

SEQ ID NO: 260 - DNA, 21 bp, Artificial Sequence
  Synthetic Construct
agtcagctgcataggttgcag

SEQ ID NO: 261 - DNA, 21 bp, Artificial Sequence
  Synthetic Construct
aatgatcctgtgctgactgtg

SEQ ID NO: 262 - DNA, 21 bp, Artificial Sequence
  Synthetic Construct
gaaaacagcgtcagaaccacc

SEQ ID NO: 263 - DNA, 21 bp, Artificial Sequence
  Synthetic Construct
gatcgtgtgactaatccgaag

SEQ ID NO: 264 - DNA, 21 bp, Artificial Sequence
  Synthetic Construct
ctcaacaccggccaaatgaga

SEQ ID NO: 265 - DNA, 21 bp, Artificial Sequence
  Synthetic Construct
attagtccttctcaggtgaag

SEQ ID NO: 266 - DNA, 21 bp, Artificial Sequence
  Synthetic Construct
tacagcgccgacaaaaccacc

SEQ ID NO: 267 - DNA, 21 bp, Artificial Sequence
  Synthetic Construct
attgatagtgcggggatggcg

SEQ ID NO: 268 - DNA, 21 bp, Artificial Sequence
  Synthetic Construct
agcaacaacatcaaactcaac

SEQ ID NO: 269 - DNA, 21 bp, Artificial Sequence
  Synthetic Construct
cttgagacgcagcctaggact

SEQ ID NO: 270 - DNA, 21 bp, Artificial Sequence
  Synthetic Construct
aatttgcatagtaatgtgctg

SEQ ID NO: 271 - DNA, 21 bp, Artificial Sequence
  Synthetic Construct
atggtcaaagacacccaactc

SEQ ID NO: 272 - DNA, 21 bp, Artificial Sequence
  Synthetic Construct
ctcatgcacctcaccaacccc

SEQ ID NO: 273 - DNA, 21 bp, Artificial Sequence
  Synthetic Construct
gtcgccagccccgacaaaaga

SEQ ID NO: 274 - DNA, 21 bp, Artificial Sequence
  Synthetic Construct
gtcgtcgccgtcctcaccagc

SEQ ID NO: 275 - DNA, 21 bp, Artificial Sequence
  Synthetic Construct
aacatcatggtcaacgtcccc

SEQ ID NO: 276 - DNA, 21 bp, Artificial Sequence
  Synthetic Construct
ccgtatagtgggcagcggact

SEQ ID NO: 277 - DNA, 21 bp, Artificial Sequence
  Synthetic Construct
cctctgcttaagacgaatact

SEQ ID NO: 278 - DNA, 21 bp, Artificial Sequence
  Synthetic Construct
gggaatactacggtgcgtggg

SEQ ID NO: 279 - DNA, 21 bp, Artificial Sequence
  Synthetic Construct
accaacaaagtcagagacgac

SEQ ID NO: 280 - DNA, 21 bp, Artificial Sequence
  Synthetic Construct
cccagcaccgccctcctcgtc

SEQ ID NO: 281 - DNA, 21 bp, Artificial Sequence
  Synthetic Construct
atccaaagcatcaccctcaaa

SEQ ID NO: 282 - DNA, 21 bp, Artificial Sequence
  Synthetic Construct
cccctccacgccaacatgagc

SEQ ID NO: 283 - DNA, 21 bp, Artificial Sequence
  Synthetic Construct
accgcccacgccgaagccaga

SEQ ID NO: 284 - DNA, 21 bp, Artificial Sequence
  Synthetic Construct
acgaatacggattcgtatcgt

SEQ ID NO: 285 - DNA, 21 bp, Artificial Sequence
  Synthetic Construct
acccacgtcagcctcgacaga

SEQ ID NO: 286 - DNA, 21 bp, Artificial Sequence
  Synthetic Construct
tttagtacgaaggatcatgtt

SEQ ID NO: 287 - DNA, 21 bp, Artificial Sequence
  Synthetic Construct
gacaacacccaaaccgccccc

SEQ ID NO: 288 - DNA, 21 bp, Artificial Sequence
  Synthetic Construct
agcaacagaatcatcagcggc

SEQ ID NO: 289 - DNA, 21 bp, Artificial Sequence
  Synthetic Construct
actaattctgttaggaataat

SEQ ID NO: 290 - DNA, 21 bp, Artificial Sequence
  Synthetic Construct
agcaacgaagtcagaaacatg

SEQ ID NO: 291 - DNA, 21 bp, Artificial Sequence
  Synthetic Construct
gaactctacaaacccagcaga

SEQ ID NO: 292 - DNA, 21 bp, Artificial Sequence
  Synthetic Construct
tggattacggggggtgcgagt

SEQ ID NO: 293 - DNA, 21 bp, Artificial Sequence
  Synthetic Construct
aacaacagcgtcagacccacc

SEQ ID NO: 294 - DNA, 21 bp, Artificial Sequence
  Synthetic Construct
cacaccgccgtcctcagaacc

SEQ ID NO: 295 - DNA, 21 bp, Artificial Sequence
  Synthetic Construct
aatactttgtctcttgctcct

SEQ ID NO: 296 - DNA, 21 bp, Artificial Sequence
  Synthetic Construct
cccaacgccagcgtcaacagc

SEQ ID NO: 297 - DNA, 21 bp, Artificial Sequence
  Synthetic Construct
gttactggtgggaatacttat

SEQ ID NO: 298 - DNA, 21 bp, Artificial Sequence
  Synthetic Construct
gtcaacgaaaacctcatcgaa

SEQ ID NO: 299 - DNA, 21 bp, Artificial Sequence
  Synthetic Construct
gttttgacgactcattcgaat

SEQ ID NO: 300 - DNA, 21 bp, Artificial Sequence
  Synthetic Construct
cacacccaactccccctcacc

SEQ ID NO: 301 - DNA, 21 bp, Artificial Sequence
  Synthetic Construct
cggcagtctcttgaggcgttg

SEQ ID NO: 302 - DNA, 21 bp, Artificial Sequence
  Synthetic Construct
cccgacgtcaccgaaggcaga

SEQ ID NO: 303 - DNA, 21 bp, Artificial Sequence
  Synthetic Construct
ccgactaatattatgcttgat

SEQ ID NO: 304 - DNA, 21 bp, Artificial Sequence
  Synthetic Construct
cccaacatgagcgccatgatc

SEQ ID NO: 305 - DNA, 21 bp, Artificial Sequence
  Synthetic Construct
attatgaatggtcaggctctg

SEQ ID NO: 306 - DNA, 21 bp, Artificial Sequence
  Synthetic Construct
aataataattcgacgcgtttt

SEQ ID NO: 307 - DNA, 21 bp, Artificial Sequence
  Synthetic Construct
gccaacgtcaccagaagcacc

SEQ ID NO: 308 - DNA, 21 bp, Artificial Sequence
  Synthetic Construct
cagaatcttggtcttaatgtg

SEQ ID NO: 309 - DNA, 21 bp, Artificial Sequence
  Synthetic Construct
caagcccaaatgagcagcgcc

SEQ ID NO: 310 - DNA, 21 bp, Artificial Sequence
  Synthetic Construct
ctcaccatggccaccaacgtc

SEQ ID NO: 311 - DNA, 21 bp, Artificial Sequence
  Synthetic Construct
gatcgtgattctgtgcagaat

SEQ ID NO: 312 - DNA, 21 bp, Artificial Sequence
  Synthetic Construct
gtcaaccccaccaacaacctc

SEQ ID NO: 313 - DNA, 21 bp, Artificial Sequence
  Synthetic Construct
ccgtcttttacgactatgagt

SEQ ID NO: 314 - DNA, 21 bp, Artificial Sequence
  Synthetic Construct
agggagacgcctattcctaag

SEQ ID NO: 315 - DNA, 21 bp, Artificial Sequence
  Synthetic Construct
agcctcaacttcaccaccgcc

SEQ ID NO: 316 - DNA, 21 bp, Artificial Sequence
  Synthetic Construct
ggtatgagtggggttgctcag

SEQ ID NO: 317 - DNA, 21 bp, Artificial Sequence
  Synthetic Construct
aaggttgatgcggctcagagt

SEQ ID NO: 318 - DNA, 21 bp, Artificial Sequence
  Synthetic Construct
catattacgactaatgtgtct

SEQ ID NO: 319 - DNA, 21 bp, Artificial Sequence
  Synthetic Construct
gagcgggagtcggctcgtctt

SEQ ID NO: 320 - DNA, 21 bp, Artificial Sequence
  Synthetic Construct
gataataggactcagaggacg

SEQ ID NO: 321 - DNA, 21 bp, Artificial Sequence
  Synthetic Construct
tctgcgcctaatgtgactatt

SEQ ID NO: 322 - DNA, 21 bp, Artificial Sequence
  Synthetic Construct
gaaaacggcaccagaaacacc

SEQ ID NO: 323 - DNA, 21 bp, Artificial Sequence
  Synthetic Construct
ggcaccgccgtcttcaccgcc

SEQ ID NO: 324 - DNA, 21 bp, Artificial Sequence
  Synthetic Construct
gccaacaacatgagccaaacc

SEQ ID NO: 325 - DNA, 21 bp, Artificial Sequence
  Synthetic Construct
ggtaatcatacttataatctg

SEQ ID NO: 326 - DNA, 21 bp, Artificial Sequence
  Synthetic Construct
ctgagtccttcgaattctaat

SEQ ID NO: 327 - DNA, 21 bp, Artificial Sequence
  Synthetic Construct
atgggcgccgaccacagaacc

SEQ ID NO: 328 - DNA, 21 bp, Artificial Sequence
  Synthetic Construct
agtaattcgacgcgtggttct

SEQ ID NO: 329 - DNA, 21 bp, Artificial Sequence
  Synthetic Construct
aatacttctggtgtgcctaag

SEQ ID NO: 330 - DNA, 21 bp, Artificial Sequence
  Synthetic Construct
atcaacaccgccgtcgtcagc

SEQ ID NO: 331 - DNA, 21 bp, Artificial Sequence
  Synthetic Construct
atgggggttcaggcttatgtg

SEQ ID NO: 332 - DNA, 21 bp, Artificial Sequence
  Synthetic Construct
gggaattttgttaagccgaat

SEQ ID NO: 333 - DNA, 21 bp, Artificial Sequence
  Synthetic Construct
gtgaattcggtgaggatgatt

SEQ ID NO: 334 - DNA, 21 bp, Artificial Sequence
  Synthetic Construct
cacgacagcgccaacagcaga

SEQ ID NO: 335 - DNA, 21 bp, Artificial Sequence
  Synthetic Construct
ctcggcgtcagagacgacagc

SEQ ID NO: 336 - DNA, 21 bp, Artificial Sequence
  Synthetic Construct
agcaacgccgtcagagccaac

SEQ ID NO: 337 - DNA, 21 bp, Artificial Sequence
  Synthetic Construct
cccgtcctcgccgccaccatg

SEQ ID NO: 338 - DNA, 21 bp, Artificial Sequence
  Synthetic Construct
aataagcctgtgtctggtaat

SEQ ID NO: 339 - DNA, 21 bp, Artificial Sequence
  Synthetic Construct
gtcggcctcgccagccacacc

SEQ ID NO: 340 - DNA, 21 bp, Artificial Sequence
  Synthetic Construct
ggcagcaacaccaacatgaaa

SEQ ID NO: 341 - DNA, 21 bp, Artificial Sequence
  Synthetic Construct
gttgctactactgtgcataat

SEQ ID NO: 342 - DNA, 21 bp, Artificial Sequence
  Synthetic Construct
aacaccctcgacagcagagtc

SEQ ID NO: 343 - DNA, 21 bp, Artificial Sequence
  Synthetic Construct
agggaggctaatttgcaggcg

SEQ ID NO: 344 - DNA, 21 bp, Artificial Sequence
  Synthetic Construct
gtcgacgccctcagccacatg

SEQ ID NO: 345 - DNA, 21 bp, Artificial Sequence
  Synthetic Construct
cttcgtcttgctggtcttgct

SEQ ID NO: 346 - DNA, 21 bp, Artificial Sequence
  Synthetic Construct
attacggtgactaattattcg

SEQ ID NO: 347 - DNA, 21 bp, Artificial Sequence
  Synthetic Construct
tgggacagcggcagcggcgaa

SEQ ID NO: 348 - DNA, 21 bp, Artificial Sequence
  Synthetic Construct
ttcgccagcgaaaccgtcgcc

SEQ ID NO: 349 - DNA, 21 bp, Artificial Sequence
  Synthetic Construct
cagaatgttacggggacgagg

SEQ ID NO: 350 - DNA, 21 bp, Artificial Sequence
  Synthetic Construct
cttaatgggttgaatgtgtct

SEQ ID NO: 351 - DNA, 21 bp, Artificial Sequence
  Synthetic Construct
aatatgcttaagcagagtgag

SEQ ID NO: 352 - DNA, 21 bp, Artificial Sequence
  Synthetic Construct
tttaatgaggttccgaaggcg

SEQ ID NO: 353 - DNA, 21 bp, Artificial Sequence
  Synthetic Construct
ctcggcgacatcaccggcttc

SEQ ID NO: 354 - DNA, 21 bp, Artificial Sequence
  Synthetic Construct
atttcggcttctcattctcgt

SEQ ID NO: 355 - DNA, 21 bp, Artificial Sequence
  Synthetic Construct
agtcagacgcagattgctctt

SEQ ID NO: 356 - DNA, 21 bp, Artificial Sequence
  Synthetic Construct
aatatggctactcagatgaag

SEQ ID NO: 357 - DNA, 21 bp, Artificial Sequence
  Synthetic Construct
gtcaaccacaacatcagactc

SEQ ID NO: 358 - DNA, 21 bp, Artificial Sequence
  Synthetic Construct
aacgccctccaagtccccgtc

SEQ ID NO: 359 - DNA, 21 bp, Artificial Sequence
  Synthetic Construct
aattcgacgggtattgatacg

SEQ ID NO: 360 - DNA, 21 bp, Artificial Sequence
  Synthetic Construct
gttgttgctgggcatcttaat

SEQ ID NO: 361 - DNA, 21 bp, Artificial Sequence
  Synthetic Construct
cggaatgatgcgattctgaat

SEQ ID NO: 362 - DNA, 21 bp, Artificial Sequence
  Synthetic Construct
aatcgggttgattcgcgggct

SEQ ID NO: 363 - DNA, 21 bp, Artificial Sequence
  Synthetic Construct
tcgacgcattctacttatgtg

SEQ ID NO: 364 - DNA, 21 bp, Artificial Sequence
  Synthetic Construct
agtgggcatgggactctgcgg

SEQ ID NO: 365 - DNA, 21 bp, Artificial Sequence
  Synthetic Construct
cccaacagcaccaccctcagc

SEQ ID NO: 366 - DNA, 21 bp, Artificial Sequence
  Synthetic Construct
gacaccaaacccaccaacacc

SEQ ID NO: 367 - DNA, 21 bp, Artificial Sequence
  Synthetic Construct
aacagagacaccatcaacaac

SEQ ID NO: 368 - DNA, 21 bp, Artificial Sequence
  Synthetic Construct
cccagaaccctcagcgacggc

SEQ ID NO: 369 - DNA, 21 bp, Artificial Sequence
  Synthetic Construct
accaaagacgtcaccaccagc

SEQ ID NO: 370 - DNA, 21 bp, Artificial Sequence
  Synthetic Construct
ctgggtaatcctacgccttct

SEQ ID NO: 371 - DNA, 21 bp, Artificial Sequence
  Synthetic Construct
tatcaggcgatgtatagggat

SEQ ID NO: 372 - DNA, 21 bp, Artificial Sequence
  Synthetic Construct
agcggcgtccaagaattcgac

SEQ ID NO: 373 - DNA, 21 bp, Artificial Sequence
  Synthetic Construct
tctaatcatctgtcgacggtt

SEQ ID NO: 374 - DNA, 21 bp, Artificial Sequence
  Synthetic Construct
cacgacgaaagagccaacatg

SEQ ID NO: 375 - DNA, 21 bp, Artificial Sequence
  Synthetic Construct
acgaatagtactcggtcgcct

SEQ ID NO: 376 - DNA, 21 bp, Artificial Sequence
  Synthetic Construct
ccgacggataagtcttatccg

SEQ ID NO: 377 - DNA, 21 bp, Artificial Sequence
  Synthetic Construct
atgaccgaacaaagaaccgcc

SEQ ID NO: 378 - DNA, 21 bp, Artificial Sequence
  Synthetic Construct
accaacgccacccacagcaaa

SEQ ID NO: 379 - DNA, 21 bp, Artificial Sequence
  Synthetic Construct
aatcggggtacttttagtgcg

SEQ ID NO: 380 - DNA, 21 bp, Artificial Sequence
  Synthetic Construct
aacaccaccaaattcaacacc

SEQ ID NO: 381 - DNA, 21 bp, Artificial Sequence
  Synthetic Construct
gggattccgcctttgactaag

SEQ ID NO: 382 - DNA, 21 bp, Artificial Sequence
  Synthetic Construct
accgccaacagcacccaaaga

SEQ ID NO: 383 - DNA, 21 bp, Artificial Sequence
  Synthetic Construct
actcagggtccgggtccgaag

SEQ ID NO: 384 - DNA, 21 bp, Artificial Sequence
  Synthetic Construct
atgaatactacgcggaattat

SEQ ID NO: 385 - DNA, 21 bp, Artificial Sequence
  Synthetic Construct
ctcagagaaggcaccttcatg

SEQ ID NO: 386 - DNA, 21 bp, Artificial Sequence
  Synthetic Construct
aacatcagcagcaccgacaga

SEQ ID NO: 387 - DNA, 21 bp, Artificial Sequence
  Synthetic Construct
tcggttagtcggccgtttcag

SEQ ID NO: 388 - DNA, 21 bp, Artificial Sequence
  Synthetic Construct
cctatgtctgctaatgggaag

SEQ ID NO: 389 - DNA, 21 bp, Artificial Sequence
  Synthetic Construct
gaagtcagaggcaacaccttc

SEQ ID NO: 390 - DNA, 21 bp, Artificial Sequence
  Synthetic Construct
tcgcagaagggtctgtctgtg

SEQ ID NO: 391 - DNA, 21 bp, Artificial Sequence
  Synthetic Construct
attgctgagaatctgagtgct

SEQ ID NO: 392 - DNA, 21 bp, Artificial Sequence
  Synthetic Construct
ttcagcaacatgaacctcaaa

SEQ ID NO: 393 - DNA, 21 bp, Artificial Sequence
  Synthetic Construct
cctcgtgagcggacttatact

SEQ ID NO: 394 - DNA, 21 bp, Artificial Sequence
  Synthetic Construct
tggtcgcataatccggattct

SEQ ID NO: 395 - DNA, 21 bp, Artificial Sequence
  Synthetic Construct
ggtcttcagactctgattacg

SEQ ID NO: 396 - DNA, 21 bp, Artificial Sequence
  Synthetic Construct
agcaacagaaccaaagacatc

SEQ ID NO: 397 - DNA, 21 bp, Artificial Sequence
  Synthetic Construct
gtgactgagacgattcttaag

SEQ ID NO: 398 - DNA, 21 bp, Artificial Sequence
  Synthetic Construct
tatgttacgcgtagtggtctg

SEQ ID NO: 399 - DNA, 21 bp, Artificial Sequence
  Synthetic Construct
atgaacgccaacatcctcgtc

SEQ ID NO: 400 - DNA, 21 bp, Artificial Sequence
  Synthetic Construct
actacgaatcgggtgggtacg

SEQ ID NO: 401 - DNA, 21 bp, Artificial Sequence
  Synthetic Construct
gtcctcaaaagccacctccaa

SEQ ID NO: 402 - DNA, 21 bp, Artificial Sequence
  Synthetic Construct
agcgacggcctcagaacccaa

SEQ ID NO: 403 - DNA, 21 bp, Artificial Sequence
  Synthetic Construct
ctcaacagcgtcaaacccaac

SEQ ID NO: 404 - DNA, 21 bp, Artificial Sequence
  Synthetic Construct
agccaagccatcgcccccaaa

SEQ ID NO: 405 - DNA, 21 bp, Artificial Sequence
  Synthetic Construct
tctaataatgttcgtgctccg

SEQ ID NO: 406 - DNA, 21 bp, Artificial Sequence
  Synthetic Construct
atcagccacctcagcgaaagc

SEQ ID NO: 407 - DNA, 21 bp, Artificial Sequence
  Synthetic Construct
ctcctccccggcatgagattc

SEQ ID NO: 408 - DNA, 21 bp, Artificial Sequence
  Synthetic Construct
cttcttgcgtcggctacgaag

SEQ ID NO: 409 - DNA, 21 bp, Artificial Sequence
  Synthetic Construct
aaccacaacggcatggtcagc

SEQ ID NO: 410 - DNA, 21 bp, Artificial Sequence
  Synthetic Construct
cacagcggcgaactcaacaac

SEQ ID NO: 411 - DNA, 21 bp, Artificial Sequence
  Synthetic Construct
ctttctgcgcctaaggatact

SEQ ID NO: 412 - DNA, 21 bp, Artificial Sequence
  Synthetic Construct
attgggactcatgtggggacg

SEQ ID NO: 413 - DNA, 21 bp, Artificial Sequence
  Synthetic Construct
gccgtcgccctcgccagcgcc

SEQ ID NO: 414 - DNA, 21 bp, Artificial Sequence
  Synthetic Construct
attactcttcagtctaatgct

SEQ ID NO: 415 - DNA, 21 bp, Artificial Sequence
  Synthetic Construct
gtcgaccacagcctcaccagc

SEQ ID NO: 416 - DNA, 21 bp, Artificial Sequence
  Synthetic Construct
ggcaacgaagccaccagcctc

SEQ ID NO: 417 - DNA, 21 bp, Artificial Sequence
  Synthetic Construct
cccgtcagcagcaccaccctc

SEQ ID NO: 418 - DNA, 21 bp, Artificial Sequence
  Synthetic Construct
ccctaccaaaccagcagcgcc

SEQ ID NO: 419 - DNA, 21 bp, Artificial Sequence
  Synthetic Construct
accagcgtcgtcagcgccttc

SEQ ID NO: 420 - DNA, 21 bp, Artificial Sequence
  Synthetic Construct
aacggcgtccccgacaacaac

SEQ ID NO: 421 - DNA, 21 bp, Artificial Sequence
  Synthetic Construct
agcacccaaaccatcggcttc

SEQ ID NO: 422 - DNA, 21 bp, Artificial Sequence
  Synthetic Construct
attcggagttctgatcttgcg

SEQ ID NO: 423 - DNA, 21 bp, Artificial Sequence
  Synthetic Construct
aacacccaaagcgccaaatac

SEQ ID NO: 424 - DNA, 21 bp, Artificial Sequence
  Synthetic Construct
agtcttgagtcgtctaggcag

SEQ ID NO: 425 - DNA, 21 bp, Artificial Sequence
  Synthetic Construct
ctcaacctcgccagcggcaga

SEQ ID NO: 426 - DNA, 21 bp, Artificial Sequence
  Synthetic Construct
atgcaggagcgtcgggagtat

SEQ ID NO: 427 - DNA, 21 bp, Artificial Sequence
  Synthetic Construct
tggctcctcaaagacggctac

SEQ ID NO: 428 - DNA, 21 bp, Artificial Sequence
  Synthetic Construct
ggcagataccaaaccaccagc

SEQ ID NO: 429 - DNA, 21 bp, Artificial Sequence
  Synthetic Construct
aatacgacgaagtttccgttt

SEQ ID NO: 430 - DNA, 21 bp, Artificial Sequence
  Synthetic Construct
atgagcaacggcatcagcaga

SEQ ID NO: 431 - DNA, 21 bp, Artificial Sequence
  Synthetic Construct
ccgattcgggatccggagaag

SEQ ID NO: 432 - DNA, 21 bp, Artificial Sequence
  Synthetic Construct
agtacgctgagtccgcatgtt

SEQ ID NO: 433 - DNA, 21 bp, Artificial Sequence
  Synthetic Construct
ttcatgcccatcagcagcgcc

SEQ ID NO: 434 - DNA, 21 bp, Artificial Sequence
  Synthetic Construct
agaagcgacacccaaagcagc

SEQ ID NO: 435 - protein, 7 aa, Artificial Sequence
  Synthetic Construct
TLQIPFK

SEQ ID NO: 436 - protein, 7 aa, Artificial Sequence
  Synthetic Construct
TALKPFL

SEQ ID NO: 437 - protein, 7 aa, Artificial Sequence
  Synthetic Construct
TTLKPFL

SEQ ID NO: 438 - protein, 7 aa, Artificial Sequence
  Synthetic Construct
SIERPFK

SEQ ID NO: 439 - protein, 7 aa, Artificial Sequence
  Synthetic Construct
TQNRPFL

SEQ ID NO: 440 - protein, 7 aa, Artificial Sequence
  Synthetic Construct
TMQKPFI

SEQ ID NO: 441 - protein, 7 aa, Artificial Sequence
  Synthetic Construct
TSTRPFL

SEQ ID NO: 442 - protein, 7 aa, Artificial Sequence
  Synthetic Construct
GTFVPPT

SEQ ID NO: 443 - protein, 7 aa, Artificial Sequence
  Synthetic Construct
WSTNAGY

SEQ ID NO: 444 - protein, 7 aa, Artificial Sequence
  Synthetic Construct
TLERPFT

SEQ ID NO: 445 - protein, 7 aa, Artificial Sequence
  Synthetic Construct
TAAKPFL

SEQ ID NO: 446 - protein, 7 aa, Artificial Sequence
  Synthetic Construct
IRIGYSQ

SEQ ID NO: 447 - protein, 7 aa, Artificial Sequence
  Synthetic Construct
ERVGFAQ

SEQ ID NO: 448 - protein, 7 aa, Artificial Sequence
  Synthetic Construct
ADLLNYR

SEQ ID NO: 449 - protein, 7 aa, Artificial Sequence
  Synthetic Construct
LVAGFSQ

SEQ ID NO: 450 - protein, 7 aa, Artificial Sequence
  Synthetic Construct
SSLKPFL

SEQ ID NO: 451 - protein, 7 aa, Artificial Sequence
  Synthetic Construct
THSRPFI

SEQ ID NO: 452 - protein, 7 aa, Artificial Sequence
  Synthetic Construct
PFPGYSA

SEQ ID NO: 453 - protein, 7 aa, Artificial Sequence
  Synthetic Construct
IIVGYSQ

SEQ ID NO: 454 - protein, 7 aa, Artificial Sequence
  Synthetic Construct
RYQGDSV

SEQ ID NO: 455 - protein, 7 aa, Artificial Sequence
  Synthetic Construct
RYAGDSI

SEQ ID NO: 456 - protein, 7 aa, Artificial Sequence
  Synthetic Construct
KTIGEHW

SEQ ID NO: 457 - protein, 7 aa, Artificial Sequence
  Synthetic Construct
WMTHGSA

SEQ ID NO: 458 - protein, 7 aa, Artificial Sequence
  Synthetic Construct
AASRPFL

SEQ ID NO: 459 - protein, 7 aa, Artificial Sequence
  Synthetic Construct
TTSRPFL

SEQ ID NO: 460 - protein, 7 aa, Artificial Sequence
  Synthetic Construct
ARVGLAQ

SEQ ID NO: 461 - protein, 7 aa, Artificial Sequence
  Synthetic Construct
GTSPNLA

SEQ ID NO: 462 - protein, 7 aa, Artificial Sequence
  Synthetic Construct
VRTGYSS

SEQ ID NO: 463 - protein, 7 aa, Artificial Sequence
  Synthetic Construct
IRVGYSS

SEQ ID NO: 464 - protein, 7 aa, Artificial Sequence
  Synthetic Construct
TTLRPFI

SEQ ID NO: 465 - protein, 7 aa, Artificial Sequence
  Synthetic Construct
GITSLFK

SEQ ID NO: 466 - protein, 7 aa, Artificial Sequence
  Synthetic Construct
TTQTPFR

SEQ ID NO: 467 - protein, 7 aa, Artificial Sequence
  Synthetic Construct
TVSRPFL

SEQ ID NO: 468 - protein, 7 aa, Artificial Sequence
  Synthetic Construct
YGTNPFR

SEQ ID NO: 469 - protein, 7 aa, Artificial Sequence
  Synthetic Construct
PTMVDSS

SEQ ID NO: 470 - protein, 7 aa, Artificial Sequence
  Synthetic Construct
NKASSQN

SEQ ID NO: 471 - protein, 7 aa, Artificial Sequence
  Synthetic Construct
TFRSSND

SEQ ID NO: 472 - protein, 7 aa, Artificial Sequence
  Synthetic Construct
LPDRYPN

SEQ ID NO: 473 - protein, 7 aa, Artificial Sequence
  Synthetic Construct
QNVTKGV

SEQ ID NO: 474 - protein, 7 aa, Artificial Sequence
  Synthetic Construct
AQSPILR

SEQ ID NO: 475 - protein, 7 aa, Artificial Sequence
  Synthetic Construct
VATGYSS

SEQ ID NO: 476 - protein, 7 aa, Artificial Sequence
  Synthetic Construct
LNSNRPN

SEQ ID NO: 477 - protein, 7 aa, Artificial Sequence
  Synthetic Construct
TIRNNTI

SEQ ID NO: 478 - protein, 7 aa, Artificial Sequence
  Synthetic Construct
DLSRIFK

SEQ ID NO: 479 - protein, 7 aa, Artificial Sequence
  Synthetic Construct
LSNSASQ

SEQ ID NO: 480 - protein, 7 aa, Artificial Sequence
  Synthetic Construct
LENMVMS

SEQ ID NO: 481 - protein, 7 aa, Artificial Sequence
  Synthetic Construct
LTQQTDV

SEQ ID NO: 482 - protein, 7 aa, Artificial Sequence
  Synthetic Construct
AGLAHAT

SEQ ID NO: 483 - protein, 7 aa, Artificial Sequence
  Synthetic Construct
NAHTALD

SEQ ID NO: 484 - protein, 7 aa, Artificial Sequence
  Synthetic Construct
WPILRAD

SEQ ID NO: 485 - protein, 7 aa, Artificial Sequence
  Synthetic Construct
ALAGLSL

SEQ ID NO: 486 - protein, 7 aa, Artificial Sequence
  Synthetic Construct
RIDMPFK

SEQ ID NO: 487 - protein, 7 aa, Artificial Sequence
  Synthetic Construct
TMSLSSS

SEQ ID NO: 488 - protein, 7 aa, Artificial Sequence
  Synthetic Construct
QNVAKNL

SEQ ID NO: 489 - protein, 7 aa, Artificial Sequence
  Synthetic Construct
FDNPNNV

SEQ ID NO: 490 - protein, 7 aa, Artificial Sequence
  Synthetic Construct
VLMRESL

SEQ ID NO: 491 - protein, 7 aa, Artificial Sequence
  Synthetic Construct
HHDTGSA

SEQ ID NO: 492 - protein, 7 aa, Artificial Sequence
  Synthetic Construct
DAPNSVD

SEQ ID NO: 493 - protein, 7 aa, Artificial Sequence
  Synthetic Construct
TASRDAK

SEQ ID NO: 494 - protein, 7 aa, Artificial Sequence
  Synthetic Construct
TNYTKQI

SEQ ID NO: 495 - protein, 7 aa, Artificial Sequence
  Synthetic Construct
PHNASVL

SEQ ID NO: 496 - protein, 7 aa, Artificial Sequence
  Synthetic Construct
TNNTRNI

SEQ ID NO: 497 - protein, 7 aa, Artificial Sequence
  Synthetic Construct
MVPNHSG

SEQ ID NO: 498 - protein, 7 aa, Artificial Sequence
  Synthetic Construct
PVPQSEH

SEQ ID NO: 499 - protein, 7 aa, Artificial Sequence
  Synthetic Construct
LYHGGST

SEQ ID NO: 500 - protein, 7 aa, Artificial Sequence
  Synthetic Construct
MIHTRET

SEQ ID NO: 501 - protein, 7 aa, Artificial Sequence
  Synthetic Construct
TNNTKPL

SEQ ID NO: 502 - protein, 7 aa, Artificial Sequence
  Synthetic Construct
LNTTRNT

SEQ ID NO: 503 - protein, 7 aa, Artificial Sequence
  Synthetic Construct
ALHNSQN

SEQ ID NO: 504 - protein, 7 aa, Artificial Sequence
  Synthetic Construct
VNSTRNV

SEQ ID NO: 505 - protein, 7 aa, Artificial Sequence
  Synthetic Construct
GVGVVTK

SEQ ID NO: 506 - protein, 7 aa, Artificial Sequence
  Synthetic Construct
VLSKQLA

SEQ ID NO: 507 - protein, 7 aa, Artificial Sequence
  Synthetic Construct
SKSLQPL

SEQ ID NO: 508 - protein, 7 aa, Artificial Sequence
  Synthetic Construct
SNSTRLV

SEQ ID NO: 509 - protein, 7 aa, Artificial Sequence
  Synthetic Construct
LNQTKQI

SEQ ID NO: 510 - protein, 7 aa, Artificial Sequence
  Synthetic Construct
NNSVRQL

SEQ ID NO: 511 - protein, 7 aa, Artificial Sequence
  Synthetic Construct
MSGYSHT

SEQ ID NO: 512 - protein, 7 aa, Artificial Sequence
  Synthetic Construct
VKVPIIT

SEQ ID NO: 513 - protein, 7 aa, Artificial Sequence
  Synthetic Construct
GNNTRAV

SEQ ID NO: 514 - protein, 7 aa, Artificial Sequence
  Synthetic Construct
QNQIKNI

SEQ ID NO: 515 - protein, 7 aa, Artificial Sequence
  Synthetic Construct
TNMTKPL

SEQ ID NO: 516 - protein, 7 aa, Artificial Sequence
  Synthetic Construct
NNSTRLS

SEQ ID NO: 517 - protein, 7 aa, Artificial Sequence
  Synthetic Construct
SMLTSIV

SEQ ID NO: 518 - protein, 7 aa, Artificial Sequence
  Synthetic Construct
LNATASR

SEQ ID NO: 519 - protein, 7 aa, Artificial Sequence
  Synthetic Construct
NTGVQVR

SEQ ID NO: 520 - protein, 7 aa, Artificial Sequence
  Synthetic Construct
TNTVRPI

SEQ ID NO: 521 - protein, 7 aa, Artificial Sequence
  Synthetic Construct
QSTPGAT

SEQ ID NO: 522 - protein, 7 aa, Artificial Sequence
  Synthetic Construct
GHSENSR

SEQ ID NO: 523 - protein, 7 aa, Artificial Sequence
  Synthetic Construct
LPTQTLR

SEQ ID NO: 524 - protein, 7 aa, Artificial Sequence
  Synthetic Construct
KNAPMPD

SEQ ID NO: 525 - protein, 7 aa, Artificial Sequence
  Synthetic Construct
SNSTKPT

SEQ ID NO: 526 - protein, 7 aa, Artificial Sequence
  Synthetic Construct
PIITMPA

SEQ ID NO: 527 - protein, 7 aa, Artificial Sequence
  Synthetic Construct
PLKGIGS

SEQ ID NO: 528 - protein, 7 aa, Artificial Sequence
  Synthetic Construct
VLSVNHL

SEQ ID NO: 529 - protein, 7 aa, Artificial Sequence
  Synthetic Construct
SVAAVHM

SEQ ID NO: 530 - protein, 7 aa, Artificial Sequence
  Synthetic Construct
SNSIRLV

SEQ ID NO: 531 - protein, 7 aa, Artificial Sequence
  Synthetic Construct
HNDTRPL

SEQ ID NO: 532 - protein, 7 aa, Artificial Sequence
  Synthetic Construct
PPVRSTA

SEQ ID NO: 533 - protein, 7 aa, Artificial Sequence
  Synthetic Construct
MNTVRNL

SEQ ID NO: 534 - protein, 7 aa, Artificial Sequence
  Synthetic Construct
LTDGHRI

SEQ ID NO: 535 - protein, 7 aa, Artificial Sequence
  Synthetic Construct
TNAVKLT

SEQ ID NO: 536 - protein, 7 aa, Artificial Sequence
  Synthetic Construct
RVDAVLS

SEQ ID NO: 537 - protein, 7 aa, Artificial Sequence
  Synthetic Construct
TNAVKST

SEQ ID NO: 538 - protein, 7 aa, Artificial Sequence
  Synthetic Construct
MLNTTAR

SEQ ID NO: 539 - protein, 7 aa, Artificial Sequence
  Synthetic Construct
GNNTRPT

SEQ ID NO: 540 - protein, 7 aa, Artificial Sequence
  Synthetic Construct
QSGGSAL

SEQ ID NO: 541 - protein, 7 aa, Artificial Sequence
  Synthetic Construct
VIALSTM

SEQ ID NO: 542 - protein, 7 aa, Artificial Sequence
  Synthetic Construct
LNTIRNV

SEQ ID NO: 543 - protein, 7 aa, Artificial Sequence
  Synthetic Construct
SNATRSV

SEQ ID NO: 544 - protein, 7 aa, Artificial Sequence
  Synthetic Construct
GNGTKFI

SEQ ID NO: 545 - protein, 7 aa, Artificial Sequence
  Synthetic Construct
SNTIRPV

SEQ ID NO: 546 - protein, 7 aa, Artificial Sequence
  Synthetic Construct
SNSTRAI

SEQ ID NO: 547 - protein, 7 aa, Artificial Sequence
  Synthetic Construct
FHLTDRG

SEQ ID NO: 548 - protein, 7 aa, Artificial Sequence
  Synthetic Construct
PIRSDTV

SEQ ID NO: 549 - protein, 7 aa, Artificial Sequence
  Synthetic Construct
ANQIHNT

SEQ ID NO: 550 - protein, 7 aa, Artificial Sequence
  Synthetic Construct
SNTVRNT

SEQ ID NO: 551 - protein, 7 aa, Artificial Sequence
  Synthetic Construct
TSLGYSS

SEQ ID NO: 552 - protein, 7 aa, Artificial Sequence
  Synthetic Construct
ISGVQTR

SEQ ID NO: 553 - protein, 7 aa, Artificial Sequence
  Synthetic Construct
SNAVRQT

SEQ ID NO: 554 - protein, 7 aa, Artificial Sequence
  Synthetic Construct
SLSELRI

SEQ ID NO: 555 - protein, 7 aa, Artificial Sequence
  Synthetic Construct
STEKRDE

SEQ ID NO: 556 - protein, 7 aa, Artificial Sequence
  Synthetic Construct
NLVGTLI

SEQ ID NO: 557 - protein, 7 aa, Artificial Sequence
  Synthetic Construct
GNNIRLT

SEQ ID NO: 558 - protein, 7 aa, Artificial Sequence
  Synthetic Construct
AVPTGLR

SEQ ID NO: 559 - protein, 7 aa, Artificial Sequence
  Synthetic Construct
GDNSLTR

SEQ ID NO: 560 - protein, 7 aa, Artificial Sequence
  Synthetic Construct
HADNRLK

SEQ ID NO: 561 - protein, 7 aa, Artificial Sequence
  Synthetic Construct
SNATRNF

SEQ ID NO: 562 - protein, 7 aa, Artificial Sequence
  Synthetic Construct
GNTTRGL

SEQ ID NO: 563 - protein, 7 aa, Artificial Sequence
  Synthetic Construct
LNLTATN

SEQ ID NO: 564 - protein, 7 aa, Artificial Sequence
  Synthetic Construct
SGVSTTD

SEQ ID NO: 565 - protein, 7 aa, Artificial Sequence
  Synthetic Construct
YAKTLAM

SEQ ID NO: 566 - protein, 7 aa, Artificial Sequence
  Synthetic Construct
MNHTKPT

SEQ ID NO: 567 - protein, 7 aa, Artificial Sequence
  Synthetic Construct
ANATRNS

SEQ ID NO: 568 - protein, 7 aa, Artificial Sequence
  Synthetic Construct
QNQTKIT

SEQ ID NO: 569 - protein, 7 aa, Artificial Sequence
  Synthetic Construct
SNAIKAT

SEQ ID NO: 570 - protein, 7 aa, Artificial Sequence
  Synthetic Construct
YPDNYGK

SEQ ID NO: 571 - protein, 7 aa, Artificial Sequence
  Synthetic Construct
GNTTIRS

SEQ ID NO: 572 - protein, 7 aa, Artificial Sequence
  Synthetic Construct
LGLTGAV

SEQ ID NO: 573 - protein, 7 aa, Artificial Sequence
  Synthetic Construct
ANSTRIL

SEQ ID NO: 574 - protein, 7 aa, Artificial Sequence
  Synthetic Construct
DNAIRAQ

SEQ ID NO: 575 - protein, 7 aa, Artificial Sequence
  Synthetic Construct
TNYTKLM

SEQ ID NO: 576 - protein, 7 aa, Artificial Sequence
  Synthetic Construct
HNSPSSY

SEQ ID NO: 577 - protein, 7 aa, Artificial Sequence
  Synthetic Construct
ENMVRSV

SEQ ID NO: 578 - protein, 7 aa, Artificial Sequence
  Synthetic Construct
TNNIKSY

SEQ ID NO: 579 - protein, 7 aa, Artificial Sequence
  Synthetic Construct
TNSTRPV

SEQ ID NO: 580 - protein, 7 aa, Artificial Sequence
  Synthetic Construct
HTAPPHP

SEQ ID NO: 581 - protein, 7 aa, Artificial Sequence
  Synthetic Construct
ALSQNTS

SEQ ID NO: 582 - protein, 7 aa, Artificial Sequence
  Synthetic Construct
PNVTKNA

SEQ ID NO: 583 - protein, 7 aa, Artificial Sequence
  Synthetic Construct
LDTLTGY

SEQ ID NO: 584 - protein, 7 aa, Artificial Sequence
  Synthetic Construct
PNSVRSV

SEQ ID NO: 585 - protein, 7 aa, Artificial Sequence
  Synthetic Construct
TSSHLPH

SEQ ID NO: 586 - protein, 7 aa, Artificial Sequence
  Synthetic Construct
VLHGGND

SEQ ID NO: 587 - protein, 7 aa, Artificial Sequence
  Synthetic Construct
SNYVKSA

SEQ ID NO: 588 - protein, 7 aa, Artificial Sequence
  Synthetic Construct
DNNSTRW

SEQ ID NO: 589 - protein, 7 aa, Artificial Sequence
  Synthetic Construct
TVMKGFT

SEQ ID NO: 590 - protein, 7 aa, Artificial Sequence
  Synthetic Construct
SHTLSTL

SEQ ID NO: 591 - protein, 7 aa, Artificial Sequence
  Synthetic Construct
PGPQQAK

SEQ ID NO: 592 - protein, 7 aa, Artificial Sequence
  Synthetic Construct
TFGTSKL

SEQ ID NO: 593 - protein, 7 aa, Artificial Sequence
  Synthetic Construct
SNAVTNR

SEQ ID NO: 594 - protein, 7 aa, Artificial Sequence
  Synthetic Construct
LSMSTVP

SEQ ID NO: 595 - protein, 7 aa, Artificial Sequence
  Synthetic Construct
RRYDGRE

SEQ ID NO: 596 - protein, 7 aa, Artificial Sequence
  Synthetic Construct
TNSTKNI

SEQ ID NO: 597 - protein, 7 aa, Artificial Sequence
  Synthetic Construct
INAQWSA

SEQ ID NO: 598 - protein, 7 aa, Artificial Sequence
  Synthetic Construct
AQTSNDP

SEQ ID NO: 599 - protein, 7 aa, Artificial Sequence
  Synthetic Construct
TNETRMV

SEQ ID NO: 600 - protein, 7 aa, Artificial Sequence
  Synthetic Construct
ANATRGV

SEQ ID NO: 601 - protein, 7 aa, Artificial Sequence
  Synthetic Construct
ADVNASG

SEQ ID NO: 602 - protein, 7 aa, Artificial Sequence
  Synthetic Construct
LSERNYV

SEQ ID NO: 603 - protein, 7 aa, Artificial Sequence
  Synthetic Construct
SGELARA

SEQ ID NO: 604 - protein, 7 aa, Artificial Sequence
  Synthetic Construct
GNTAKNI

SEQ ID NO: 605 - protein, 7 aa, Artificial Sequence
  Synthetic Construct
DNAVRPL

SEQ ID NO: 606 - protein, 7 aa, Artificial Sequence
  Synthetic Construct
MMLSGLN

SEQ ID NO: 607 - protein, 7 aa, Artificial Sequence
  Synthetic Construct
PNTIRNV

SEQ ID NO: 608 - protein, 7 aa, Artificial Sequence
  Synthetic Construct
ENLTRGV

SEQ ID NO: 609 - protein, 7 aa, Artificial Sequence
  Synthetic Construct
FSARSTG

SEQ ID NO: 610 - protein, 7 aa, Artificial Sequence
  Synthetic Construct
ENATRTY

SEQ ID NO: 611 - protein, 7 aa, Artificial Sequence
  Synthetic Construct
GNSTRMN

SEQ ID NO: 612 - protein, 7 aa, Artificial Sequence
  Synthetic Construct
GNSTKSP

SEQ ID NO: 613 - protein, 7 aa, Artificial Sequence
  Synthetic Construct
MQTTLHL

SEQ ID NO: 614 - protein, 7 aa, Artificial Sequence
  Synthetic Construct
NPTLITL

SEQ ID NO: 615 - protein, 7 aa, Artificial Sequence
  Synthetic Construct
LISGHAQ

SEQ ID NO: 616 - protein, 7 aa, Artificial Sequence
  Synthetic Construct
FNQVRSL

SEQ ID NO: 617 - protein, 7 aa, Artificial Sequence
  Synthetic Construct
MNILREV

SEQ ID NO: 618 - protein, 7 aa, Artificial Sequence
  Synthetic Construct
SAMMRGV

SEQ ID NO: 619 - protein, 7 aa, Artificial Sequence
  Synthetic Construct
PMLSSPS

SEQ ID NO: 620 - protein, 7 aa, Artificial Sequence
  Synthetic Construct
QNNTLRS

SEQ ID NO: 621 - protein, 7 aa, Artificial Sequence
  Synthetic Construct
RHSDPVE

SEQ ID NO: 622 - protein, 7 aa, Artificial Sequence
  Synthetic Construct
VNTTFST

SEQ ID NO: 623 - protein, 7 aa, Artificial Sequence
  Synthetic Construct
INSTRGI

SEQ ID NO: 624 - protein, 7 aa, Artificial Sequence
  Synthetic Construct
TNAVRDL

SEQ ID NO: 625 - protein, 7 aa, Artificial Sequence
  Synthetic Construct
SNSTRLS

SEQ ID NO: 626 - protein, 7 aa, Artificial Sequence
  Synthetic Construct
TSIAGSF

SEQ ID NO: 627 - protein, 7 aa, Artificial Sequence
  Synthetic Construct
LGSTYPR

SEQ ID NO: 628 - protein, 7 aa, Artificial Sequence
  Synthetic Construct
ANVTTQR

SEQ ID NO: 629 - protein, 7 aa, Artificial Sequence
  Synthetic Construct
SNSVRLS

SEQ ID NO: 630 - protein, 7 aa, Artificial Sequence
  Synthetic Construct
ATNEPDR

SEQ ID NO: 631 - protein, 7 aa, Artificial Sequence
  Synthetic Construct
RMNPEQS

SEQ ID NO: 632 - protein, 7 aa, Artificial Sequence
  Synthetic Construct
SVSGSAN

SEQ ID NO: 633 - protein, 7 aa, Artificial Sequence
  Synthetic Construct
PSNSTTR

SEQ ID NO: 634 - protein, 7 aa, Artificial Sequence
  Synthetic Construct
LFHGTHE

SEQ ID NO: 635 - protein, 7 aa, Artificial Sequence
  Synthetic Construct
PQLGSTK

SEQ ID NO: 636 - protein, 7 aa, Artificial Sequence
  Synthetic Construct
PISANRL

SEQ ID NO: 637 - protein, 7 aa, Artificial Sequence
  Synthetic Construct
NSGNLSM

SEQ ID NO: 638 - protein, 7 aa, Artificial Sequence
  Synthetic Construct
KVEAIGM

SEQ ID NO: 639 - protein, 7 aa, Artificial Sequence
  Synthetic Construct
KTLLNSV

SEQ ID NO: 640 - protein, 7 aa, Artificial Sequence
  Synthetic Construct
NAMDLKV

SEQ ID NO: 641 - protein, 7 aa, Artificial Sequence
  Synthetic Construct
MMGNGSS

SEQ ID NO: 642 - protein, 7 aa, Artificial Sequence
  Synthetic Construct
SNSTKAL

SEQ ID NO: 643 - protein, 7 aa, Artificial Sequence
  Synthetic Construct
SNSTRGT

SEQ ID NO: 644 - protein, 7 aa, Artificial Sequence
  Synthetic Construct
SLSSLHV

SEQ ID NO: 645 - protein, 7 aa, Artificial Sequence
  Synthetic Construct
TLSGALT

SEQ ID NO: 646 - protein, 7 aa, Artificial Sequence
  Synthetic Construct
PNTVRNN

SEQ ID NO: 647 - protein, 7 aa, Artificial Sequence
  Synthetic Construct
NNNVKMT

SEQ ID NO: 648 - protein, 7 aa, Artificial Sequence
  Synthetic Construct
SVAKPFM

SEQ ID NO: 649 - protein, 7 aa, Artificial Sequence
  Synthetic Construct
TQTTRLS

SEQ ID NO: 650 - protein, 7 aa, Artificial Sequence
  Synthetic Construct
NNATRGG

SEQ ID NO: 651 - protein, 7 aa, Artificial Sequence
  Synthetic Construct
TNTTARI

SEQ ID NO: 652 - protein, 7 aa, Artificial Sequence
  Synthetic Construct
ENSIRTI

SEQ ID NO: 653 - protein, 7 aa, Artificial Sequence
  Synthetic Construct
IRETSGK

SEQ ID NO: 654 - protein, 7 aa, Artificial Sequence
  Synthetic Construct
SIYYHTE

SEQ ID NO: 655 - protein, 7 aa, Artificial Sequence
  Synthetic Construct
VLDNSGQ

SEQ ID NO: 656 - protein, 7 aa, Artificial Sequence
  Synthetic Construct
SHNMTIR

SEQ ID NO: 657 - protein, 7 aa, Artificial Sequence
  Synthetic Construct
TIPSAGK

SEQ ID NO: 658 - protein, 7 aa, Artificial Sequence
  Synthetic Construct
PRHTLSQ

SEQ ID NO: 659 - protein, 7 aa, Artificial Sequence
  Synthetic Construct
SLNVQDV

SEQ ID NO: 660 - protein, 7 aa, Artificial Sequence
  Synthetic Construct
YQSLANP

SEQ ID NO: 661 - protein, 7 aa, Artificial Sequence
  Synthetic Construct
ILNMSTD

SEQ ID NO: 662 - protein, 7 aa, Artificial Sequence
  Synthetic Construct
VLHLGHS

SEQ ID NO: 663 - protein, 7 aa, Artificial Sequence
  Synthetic Construct
GVTQTPR

SEQ ID NO: 664 - protein, 7 aa, Artificial Sequence
  Synthetic Construct
TNDTRRI

SEQ ID NO: 665 - protein, 7 aa, Artificial Sequence
  Synthetic Construct
QTDHTSR

SEQ ID NO: 666 - protein, 7 aa, Artificial Sequence
  Synthetic Construct
KNEIKNV

SEQ ID NO: 667 - protein, 7 aa, Artificial Sequence
  Synthetic Construct
WTGNERL

SEQ ID NO: 668 - protein, 7 aa, Artificial Sequence
  Synthetic Construct
GKSDAMR

SEQ ID NO: 669 - protein, 7 aa, Artificial Sequence
  Synthetic Construct
GNATRTY

SEQ ID NO: 670 - protein, 7 aa, Artificial Sequence
  Synthetic Construct
ASNLGLP

SEQ ID NO: 671 - protein, 7 aa, Artificial Sequence
  Synthetic Construct
SSLSGSP

SEQ ID NO: 672 - protein, 7 aa, Artificial Sequence
  Synthetic Construct
AAVNQGV

SEQ ID NO: 673 - protein, 7 aa, Artificial Sequence
  Synthetic Construct
DQNQPRE

SEQ ID NO: 674 - protein, 7 aa, Artificial Sequence
  Synthetic Construct
LTQDKQA

SEQ ID NO: 675 - protein, 7 aa, Artificial Sequence
  Synthetic Construct
FGSNEHN

SEQ ID NO: 676 - protein, 7 aa, Artificial Sequence
  Synthetic Construct
LNQPNVR

SEQ ID NO: 677 - protein, 7 aa, Artificial Sequence
  Synthetic Construct
MNTTRNL

SEQ ID NO: 678 - protein, 7 aa, Artificial Sequence
  Synthetic Construct
TNSTRTS

SEQ ID NO: 679 - protein, 7 aa, Artificial Sequence
  Synthetic Construct
FELSHVP

SEQ ID NO: 680 - protein, 7 aa, Artificial Sequence
  Synthetic Construct
EGLGNAA

SEQ ID NO: 681 - protein, 7 aa, Artificial Sequence
  Synthetic Construct
LTVTLNH

SEQ ID NO: 682 - protein, 7 aa, Artificial Sequence
  Synthetic Construct
FGNAIQS

SEQ ID NO: 683 - protein, 7 aa, Artificial Sequence
  Synthetic Construct
PGGGLTP

SEQ ID NO: 684 - protein, 7 aa, Artificial Sequence
  Synthetic Construct
PNMTRSL

SEQ ID NO: 685 - protein, 7 aa, Artificial Sequence
  Synthetic Construct
SQLHRLQ

SEQ ID NO: 686 - protein, 7 aa, Artificial Sequence
  Synthetic Construct
NDPVLTV

SEQ ID NO: 687 - protein, 7 aa, Artificial Sequence
  Synthetic Construct
ENSVRTT

SEQ ID NO: 688 - protein, 7 aa, Artificial Sequence
  Synthetic Construct
DRVTNPK

SEQ ID NO: 689 - protein, 7 aa, Artificial Sequence
  Synthetic Construct
LNTGQMR

SEQ ID NO: 690 - protein, 7 aa, Artificial Sequence
  Synthetic Construct
ISPSQVK

SEQ ID NO: 691 - protein, 7 aa, Artificial Sequence
  Synthetic Construct
YSADKTT

SEQ ID NO: 692 - protein, 7 aa, Artificial Sequence
  Synthetic Construct
IDSAGMA

SEQ ID NO: 693 - protein, 7 aa, Artificial Sequence
  Synthetic Construct
SNNIKLN

SEQ ID NO: 694 - protein, 7 aa, Artificial Sequence
  Synthetic Construct
LETQPRT

SEQ ID NO: 695 - protein, 7 aa, Artificial Sequence
  Synthetic Construct
NLHSNVL

SEQ ID NO: 696 - protein, 7 aa, Artificial Sequence
  Synthetic Construct
MVKDTQL

SEQ ID NO: 697 - protein, 7 aa, Artificial Sequence
  Synthetic Construct
LMHLTNP

SEQ ID NO: 698 - protein, 7 aa, Artificial Sequence
  Synthetic Construct
VASPDKR

SEQ ID NO: 699 - protein, 7 aa, Artificial Sequence
  Synthetic Construct
VVAVLTS

SEQ ID NO: 700 - protein, 7 aa, Artificial Sequence
  Synthetic Construct
NIMVNVP

SEQ ID NO: 701 - protein, 7 aa, Artificial Sequence
  Synthetic Construct
PYSGQRT

SEQ ID NO: 702 - protein, 7 aa, Artificial Sequence
  Synthetic Construct
PLLKTNT

SEQ ID NO: 703 - protein, 7 aa, Artificial Sequence
  Synthetic Construct
GNTTVRG

SEQ ID NO: 704 - protein, 7 aa, Artificial Sequence
  Synthetic Construct
TNKVRDD

SEQ ID NO: 705 - protein, 7 aa, Artificial Sequence
  Synthetic Construct
PSTALLV

SEQ ID NO: 706 - protein, 7 aa, Artificial Sequence
  Synthetic Construct
IQSITLK

SEQ ID NO: 707 - protein, 7 aa, Artificial Sequence
  Synthetic Construct
PLHANMS

SEQ ID NO: 708 - protein, 7 aa, Artificial Sequence
  Synthetic Construct
TAHAEAR

SEQ ID NO: 709 - protein, 7 aa, Artificial Sequence
  Synthetic Construct
TNTDSYR

SEQ ID NO: 710 - protein, 7 aa, Artificial Sequence
  Synthetic Construct
THVSLDR

SEQ ID NO: 711 - protein, 7 aa, Artificial Sequence
  Synthetic Construct
FSTKDHV

SEQ ID NO: 712 - protein, 7 aa, Artificial Sequence
  Synthetic Construct
DNTQTAP

SEQ ID NO: 713 - protein, 7 aa, Artificial Sequence
  Synthetic Construct
SNRIISG

SEQ ID NO: 714 - protein, 7 aa, Artificial Sequence
  Synthetic Construct
TNSVRNN

SEQ ID NO: 715 - protein, 7 aa, Artificial Sequence
  Synthetic Construct
SNEVRNM

SEQ ID NO: 716 - protein, 7 aa, Artificial Sequence
  Synthetic Construct
ELYKPSR

SEQ ID NO: 717 - protein, 7 aa, Artificial Sequence
  Synthetic Construct
WITGGAS

SEQ ID NO: 718 - protein, 7 aa, Artificial Sequence
  Synthetic Construct
NNSVRPT

SEQ ID NO: 719 - protein, 7 aa, Artificial Sequence
  Synthetic Construct
HTAVLRT

SEQ ID NO: 720 - protein, 7 aa, Artificial Sequence
  Synthetic Construct
NTLSLAP

SEQ ID NO: 721 - protein, 7 aa, Artificial Sequence
  Synthetic Construct
PNASVNS

SEQ ID NO: 722 - protein, 7 aa, Artificial Sequence
  Synthetic Construct
VTGGNTY

SEQ ID NO: 723 - protein, 7 aa, Artificial Sequence
  Synthetic Construct
VNENLIE

SEQ ID NO: 724 - protein, 7 aa, Artificial Sequence
  Synthetic Construct
VLTTHSN

SEQ ID NO: 725 - protein, 7 aa, Artificial Sequence
  Synthetic Construct
HTQLPLT

SEQ ID NO: 726 - protein, 7 aa, Artificial Sequence
  Synthetic Construct
RQSLEAL

SEQ ID NO: 727 - protein, 7 aa, Artificial Sequence
  Synthetic Construct
PDVTEGR

SEQ ID NO: 728 - protein, 7 aa, Artificial Sequence
  Synthetic Construct
PTNIMLD

SEQ ID NO: 729 - protein, 7 aa, Artificial Sequence
  Synthetic Construct
PNMSAMI

SEQ ID NO: 730 - protein, 7 aa, Artificial Sequence
  Synthetic Construct
IMNGQAL

SEQ ID NO: 731 - protein, 7 aa, Artificial Sequence
  Synthetic Construct
NNNSTRF

SEQ ID NO: 732 - protein, 7 aa, Artificial Sequence
  Synthetic Construct
ANVTRST

SEQ ID NO: 733 - protein, 7 aa, Artificial Sequence
  Synthetic Construct
QNLGLNV

SEQ ID NO: 734 - protein, 7 aa, Artificial Sequence
  Synthetic Construct
QAQMSSA

SEQ ID NO: 735 - protein, 7 aa, Artificial Sequence
  Synthetic Construct
LTMATNV

SEQ ID NO: 736 - protein, 7 aa, Artificial Sequence
  Synthetic Construct
DRDSVQN

SEQ ID NO: 737 - protein, 7 aa, Artificial Sequence
  Synthetic Construct
VNPTNNL

SEQ ID NO: 738 - protein, 7 aa, Artificial Sequence
  Synthetic Construct
PSFTTMS

SEQ ID NO: 739 - protein, 7 aa, Artificial Sequence
  Synthetic Construct
RETPIPK

SEQ ID NO: 740 - protein, 7 aa, Artificial Sequence
  Synthetic Construct
SLNFTTA

SEQ ID NO: 741 - protein, 7 aa, Artificial Sequence
  Synthetic Construct
GMSGVAQ

SEQ ID NO: 742 - protein, 7 aa, Artificial Sequence
  Synthetic Construct
KVDAAQS

SEQ ID NO: 743 - protein, 7 aa, Artificial Sequence
  Synthetic Construct
HITTNVS

SEQ ID NO: 744 - protein, 7 aa, Artificial Sequence
  Synthetic Construct
ERESARL

SEQ ID NO: 745 - protein, 7 aa, Artificial Sequence
  Synthetic Construct
DNRTQRT

SEQ ID NO: 746 - protein, 7 aa, Artificial Sequence
  Synthetic Construct
SAPNVTI

SEQ ID NO: 747 - protein, 7 aa, Artificial Sequence
  Synthetic Construct
ENGTRNT

SEQ ID NO: 748 - protein, 7 aa, Artificial Sequence
  Synthetic Construct
GTAVFTA

SEQ ID NO: 749 - protein, 7 aa, Artificial Sequence
  Synthetic Construct
ANNMSQT

SEQ ID NO: 750 - protein, 7 aa, Artificial Sequence
  Synthetic Construct
GNHTYNL

SEQ ID NO: 751 - protein, 7 aa, Artificial Sequence
  Synthetic Construct
LSPSNSN

SEQ ID NO: 752 - protein, 7 aa, Artificial Sequence
  Synthetic Construct
MGADHRT

SEQ ID NO: 753 - protein, 7 aa, Artificial Sequence
  Synthetic Construct
SNSTRGS

SEQ ID NO: 754 - protein, 7 aa, Artificial Sequence
  Synthetic Construct
NTSGVPK

SEQ ID NO: 755 - protein, 7 aa, Artificial Sequence
  Synthetic Construct
INTAVVS

SEQ ID NO: 756 - protein, 7 aa, Artificial Sequence
  Synthetic Construct
MGVQAYV

SEQ ID NO: 757 - protein, 7 aa, Artificial Sequence
  Synthetic Construct
GNFVKPN

SEQ ID NO: 758 - protein, 7 aa, Artificial Sequence
  Synthetic Construct
VNSVRMI

SEQ ID NO: 759 - protein, 7 aa, Artificial Sequence
  Synthetic Construct
HDSANSR

SEQ ID NO: 760 - protein, 7 aa, Artificial Sequence
  Synthetic Construct
LGVRDDS

SEQ ID NO: 761 - protein, 7 aa, Artificial Sequence
  Synthetic Construct
SNAVRAN

SEQ ID NO: 762 - protein, 7 aa, Artificial Sequence
  Synthetic Construct
PVLAATM

SEQ ID NO: 763 - protein, 7 aa, Artificial Sequence
  Synthetic Construct
NKPVSGN

SEQ ID NO: 764 - protein, 7 aa, Artificial Sequence
  Synthetic Construct
VGLASHT

SEQ ID NO: 765 - protein, 7 aa, Artificial Sequence
  Synthetic Construct
GSNTNMK

SEQ ID NO: 766 - protein, 7 aa, Artificial Sequence
  Synthetic Construct
VATTVHN

SEQ ID NO: 767 - protein, 7 aa, Artificial Sequence
  Synthetic Construct
NTLDSRV

SEQ ID NO: 768 - protein, 7 aa, Artificial Sequence
  Synthetic Construct
REANLQA

SEQ ID NO: 769 - protein, 7 aa, Artificial Sequence
  Synthetic Construct
VDALSHM

SEQ ID NO: 770 - protein, 7 aa, Artificial Sequence
  Synthetic Construct
LRLAGLA

SEQ ID NO: 771 - protein, 7 aa, Artificial Sequence
  Synthetic Construct
ITVTNYS

SEQ ID NO: 772 - protein, 7 aa, Artificial Sequence
  Synthetic Construct
WDSGSGE

SEQ ID NO: 773 - protein, 7 aa, Artificial Sequence
  Synthetic Construct
FASETVA

SEQ ID NO: 774 - protein, 7 aa, Artificial Sequence
  Synthetic Construct
QNVTGTR

SEQ ID NO: 775 - protein, 7 aa, Artificial Sequence
  Synthetic Construct
LNGLNVS

SEQ ID NO: 776 - protein, 7 aa, Artificial Sequence
  Synthetic Construct
NMLKQSE

SEQ ID NO: 777 - protein, 7 aa, Artificial Sequence
  Synthetic Construct
FNEVPKA

SEQ ID NO: 778 - protein, 7 aa, Artificial Sequence
  Synthetic Construct
LGDITGF

SEQ ID NO: 779 - protein, 7 aa, Artificial Sequence
  Synthetic Construct
ISASHSR

SEQ ID NO: 780 - protein, 7 aa, Artificial Sequence
  Synthetic Construct
SQTQIAL

SEQ ID NO: 781 - protein, 7 aa, Artificial Sequence
  Synthetic Construct
NMATQMK

SEQ ID NO: 782 - protein, 7 aa, Artificial Sequence
  Synthetic Construct
VNHNIRL

SEQ ID NO: 783 - protein, 7 aa, Artificial Sequence
  Synthetic Construct
NALQVPV

SEQ ID NO: 784 - protein, 7 aa, Artificial Sequence
  Synthetic Construct
NSTGIDT

SEQ ID NO: 785 - protein, 7 aa, Artificial Sequence
  Synthetic Construct
VVAGHLN

SEQ ID NO: 786 - protein, 7 aa, Artificial Sequence
  Synthetic Construct
RNDAILN

SEQ ID NO: 787 - protein, 7 aa, Artificial Sequence
  Synthetic Construct
NRVDSRA

SEQ ID NO: 788 - protein, 7 aa, Artificial Sequence
  Synthetic Construct
STHSTYV

SEQ ID NO: 789 - protein, 7 aa, Artificial Sequence
  Synthetic Construct
SGHGTLR

SEQ ID NO: 790 - protein, 7 aa, Artificial Sequence
  Synthetic Construct
PNSTTLS

SEQ ID NO: 791 - protein, 7 aa, Artificial Sequence
  Synthetic Construct
DTKPTNT

SEQ ID NO: 792 - protein, 7 aa, Artificial Sequence
  Synthetic Construct
NRDTINN

SEQ ID NO: 793 - protein, 7 aa, Artificial Sequence
  Synthetic Construct
PRTLSDG

SEQ ID NO: 794 - protein, 7 aa, Artificial Sequence
  Synthetic Construct
TKDVTTS

SEQ ID NO: 795 - protein, 7 aa, Artificial Sequence
  Synthetic Construct
LGNPTPS

SEQ ID NO: 796 - protein, 7 aa, Artificial Sequence
  Synthetic Construct
YQAMYRD

SEQ ID NO: 797 - protein, 7 aa, Artificial Sequence
  Synthetic Construct
SGVQEFD

SEQ ID NO: 798 - protein, 7 aa, Artificial Sequence
  Synthetic Construct
SNHLSTV

SEQ ID NO: 799 - protein, 7 aa, Artificial Sequence
  Synthetic Construct
HDERANM

SEQ ID NO: 800 - protein, 7 aa, Artificial Sequence
  Synthetic Construct
TNSTRSP

SEQ ID NO: 801 - protein, 7 aa, Artificial Sequence
  Synthetic Construct
PTDKSYP

SEQ ID NO: 802 - protein, 7 aa, Artificial Sequence
  Synthetic Construct
MTEQRTA

SEQ ID NO: 803 - protein, 7 aa, Artificial Sequence
  Synthetic Construct
TNATHSK

SEQ ID NO: 804 - protein, 7 aa, Artificial Sequence
  Synthetic Construct
NRGTFSA

SEQ ID NO: 805 - protein, 7 aa, Artificial Sequence
  Synthetic Construct
NTTKFNT

SEQ ID NO: 806 - protein, 7 aa, Artificial Sequence
  Synthetic Construct
GIPPLTK

SEQ ID NO: 807 - protein, 7 aa, Artificial Sequence
  Synthetic Construct
TANSTQR

SEQ ID NO: 808 - protein, 7 aa, Artificial Sequence
  Synthetic Construct
TQGPGPK

SEQ ID NO: 809 - protein, 7 aa, Artificial Sequence
  Synthetic Construct
MNTTRNY

SEQ ID NO: 810 - protein, 7 aa, Artificial Sequence
  Synthetic Construct
LREGTFM

SEQ ID NO: 811 - protein, 7 aa, Artificial Sequence
  Synthetic Construct
NISSTDR

SEQ ID NO: 812 - protein, 7 aa, Artificial Sequence
  Synthetic Construct
SVSRPFQ

SEQ ID NO: 813 - protein, 7 aa, Artificial Sequence
  Synthetic Construct
PMSANGK

SEQ ID NO: 814 - protein, 7 aa, Artificial Sequence
  Synthetic Construct
EVRGNTF

SEQ ID NO: 815 - protein, 7 aa, Artificial Sequence
  Synthetic Construct
SQKGLSV

SEQ ID NO: 816 - protein, 7 aa, Artificial Sequence
  Synthetic Construct
IAENLSA

SEQ ID NO: 817 - protein, 7 aa, Artificial Sequence
  Synthetic Construct
FSNMNLK

SEQ ID NO: 818 - protein, 7 aa, Artificial Sequence
  Synthetic Construct
PRERTYT

SEQ ID NO: 819 - protein, 7 aa, Artificial Sequence
  Synthetic Construct
WSHNPDS

SEQ ID NO: 820 - protein, 7 aa, Artificial Sequence
  Synthetic Construct
GLQTLIT

SEQ ID NO: 821 - protein, 7 aa, Artificial Sequence
  Synthetic Construct
SNRTKDI

SEQ ID NO: 822 - protein, 7 aa, Artificial Sequence
  Synthetic Construct
VTETILK

SEQ ID NO: 823 - protein, 7 aa, Artificial Sequence
  Synthetic Construct
YVTRSGL

SEQ ID NO: 824 - protein, 7 aa, Artificial Sequence
  Synthetic Construct
MNANILV

SEQ ID NO: 825 - protein, 7 aa, Artificial Sequence
  Synthetic Construct
TTNRVGT

SEQ ID NO: 826 - protein, 7 aa, Artificial Sequence
  Synthetic Construct
VLKSHLQ

SEQ ID NO: 827 - protein, 7 aa, Artificial Sequence
  Synthetic Construct
SDGLRTQ

SEQ ID NO: 828 - protein, 7 aa, Artificial Sequence
  Synthetic Construct
LNSVKPN

SEQ ID NO: 829 - protein, 7 aa, Artificial Sequence
  Synthetic Construct
SQAIAPK

SEQ ID NO: 830 - protein, 7 aa, Artificial Sequence
  Synthetic Construct
SNNVRAP

SEQ ID NO: 831 - protein, 7 aa, Artificial Sequence
  Synthetic Construct
ISHLSES

SEQ ID NO: 832 - protein, 7 aa, Artificial Sequence
  Synthetic Construct
LLPGMRF

SEQ ID NO: 833 - protein, 7 aa, Artificial Sequence
  Synthetic Construct
LLASATK

SEQ ID NO: 834 - protein, 7 aa, Artificial Sequence
  Synthetic Construct
NHNGMVS

SEQ ID NO: 835 - protein, 7 aa, Artificial Sequence
  Synthetic Construct
HSGELNN

SEQ ID NO: 836 - protein, 7 aa, Artificial Sequence
  Synthetic Construct
LSAPKDT

SEQ ID NO: 837 - protein, 7 aa, Artificial Sequence
  Synthetic Construct
IGTHVGT

SEQ ID NO: 838 - protein, 7 aa, Artificial Sequence
  Synthetic Construct
AVALASA

SEQ ID NO: 839 - protein, 7 aa, Artificial Sequence
  Synthetic Construct
ITLQSNA

SEQ ID NO: 840 - protein, 7 aa, Artificial Sequence
  Synthetic Construct
VDHSLTS

SEQ ID NO: 841 - protein, 7 aa, Artificial Sequence
  Synthetic Construct
GNEATSL

SEQ ID NO: 842 - protein, 7 aa, Artificial Sequence
  Synthetic Construct
PVSSTTL

SEQ ID NO: 843 - protein, 7 aa, Artificial Sequence
  Synthetic Construct
PYQTSSA

SEQ ID NO: 844 - protein, 7 aa, Artificial Sequence
  Synthetic Construct
TSVVSAF

SEQ ID NO: 845 - protein, 7 aa, Artificial Sequence
  Synthetic Construct
NGVPDNN

SEQ ID NO: 846 - protein, 7 aa, Artificial Sequence
  Synthetic Construct
STQTIGF

SEQ ID NO: 847 - protein, 7 aa, Artificial Sequence
  Synthetic Construct
IRSSDLA

SEQ ID NO: 848 - protein, 7 aa, Artificial Sequence
  Synthetic Construct
NTQSAKY

SEQ ID NO: 849 - protein, 7 aa, Artificial Sequence
  Synthetic Construct
SLESSRQ

SEQ ID NO: 850 - protein, 7 aa, Artificial Sequence
  Synthetic Construct
LNLASGR

SEQ ID NO: 851 - protein, 7 aa, Artificial Sequence
  Synthetic Construct
MQERREY

SEQ ID NO: 852 - protein, 7 aa, Artificial Sequence
  Synthetic Construct
WLLKDGY

SEQ ID NO: 853 - protein, 7 aa, Artificial Sequence
  Synthetic Construct
GRYQTTS

SEQ ID NO: 854 - protein, 7 aa, Artificial Sequence
  Synthetic Construct
NTTKFPF

SEQ ID NO: 855 - protein, 7 aa, Artificial Sequence
  Synthetic Construct
MSNGISR

SEQ ID NO: 856 - protein, 7 aa, Artificial Sequence
  Synthetic Construct
PIRDPEK

SEQ ID NO: 857 - protein, 7 aa, Artificial Sequence
  Synthetic Construct
STLSPHV

SEQ ID NO: 858 - protein, 7 aa, Artificial Sequence
  Synthetic Construct
FMPISSA

SEQ ID NO: 859 - protein, 7 aa, Artificial Sequence
  Synthetic Construct
RSDTQSS

SEQ ID NO: 860 - DNA, 33 bp, Artificial Sequence
  Synthetic Construct
gcccaaaccaccctcaaacccttcagcaacccc

SEQ ID NO: 861 - DNA, 33 bp, Artificial Sequence
  Synthetic Construct
gacggcaccaccctcaaacccttcagcaacccc

SEQ ID NO: 862 - DNA, 33 bp, Artificial Sequence
  Synthetic Construct
gacggcaccgccctcaaacccttcctcgcccaa

SEQ ID NO: 863 - DNA, 33 bp, Artificial Sequence
  Synthetic Construct
gatgggacgactcttaagccgtttctggcacag

SEQ ID NO: 864 - protein, 11 aa, Artificial Sequence
  Synthetic Construct
AQTTLKPFSNP

SEQ ID NO: 865 - protein, 11 aa, Artificial Sequence
  Synthetic Construct
DGTTLKPFSNP

SEQ ID NO: 866 - protein, 11 aa, Artificial Sequence
  Synthetic Construct
DGTALKPFLAQ

SEQ ID NO: 867 - protein, 11 aa, Artificial Sequence
  Synthetic Construct
DGTTLKPFLAQ

SEQ ID NO: 868 - DNA, 21 bp, Artificial Sequence
  Synthetic Construct
gccgaatacaacaccggcgtc

SEQ ID NO: 869 - DNA, 21 bp, Artificial Sequence
  Synthetic Construct
gctaatgcgatgggtgatcat

SEQ ID NO: 870 - DNA, 21 bp, Artificial Sequence
  Synthetic Construct
gaaagcatccaacaactcagc

SEQ ID NO: 871 - DNA, 21 bp, Artificial Sequence
  Synthetic Construct
tttaaggttagtattcagcag

SEQ ID NO: 872 - DNA, 21 bp, Artificial Sequence
  Synthetic Construct
tttcttcttacttcggatccg

SEQ ID NO: 873 - DNA, 21 bp, Artificial Sequence
  Synthetic Construct
tttcagcaggatacttatctg

SEQ ID NO: 874 - DNA, 21 bp, Artificial Sequence
  Synthetic Construct
ttttctggtagtgctagggtt

SEQ ID NO: 875 - DNA, 21 bp, Artificial Sequence
  Synthetic Construct
ttcagcgtcaccagacaagcc

SEQ ID NO: 876 - DNA, 21 bp, Artificial Sequence
  Synthetic Construct
ggggctgctggtaagagtttg

SEQ ID NO: 877 - DNA, 21 bp, Artificial Sequence
  Synthetic Construct
ggtcatatttcggcgcttgcg

SEQ ID NO: 878 - DNA, 21 bp, Artificial Sequence
  Synthetic Construct
gggctgaaggtgtctgggtct

SEQ ID NO: 879 - DNA, 21 bp, Artificial Sequence
  Synthetic Construct
ggtcttcagtcgccgaggtct

SEQ ID NO: 880 - DNA, 21 bp, Artificial Sequence
  Synthetic Construct
gggaggacggtgcaggatagg

SEQ ID NO: 881 - DNA, 21 bp, Artificial Sequence
  Synthetic Construct
ggcaccaaaacccacagcctc

SEQ ID NO: 882 - DNA, 21 bp, Artificial Sequence
  Synthetic Construct
ggcaccaccagaagccccacc

SEQ ID NO: 883 - DNA, 21 bp, Artificial Sequence
  Synthetic Construct
caccccagcctcagacaaagc

SEQ ID NO: 884 - DNA, 21 bp, Artificial Sequence
  Synthetic Construct
cattctgcgaagactattgcg

SEQ ID NO: 885 - DNA, 21 bp, Artificial Sequence
  Synthetic Construct
cacagcggccccaccagcagc

SEQ ID NO: 886 - DNA, 21 bp, Artificial Sequence
  Synthetic Construct
atcaacaaagacaacaaccaa

SEQ ID NO: 887 - DNA, 21 bp, Artificial Sequence
  Synthetic Construct
atcaacaccgccagctacaaa

SEQ ID NO: 888 - DNA, 21 bp, Artificial Sequence
  Synthetic Construct
aaagccatcagcaccgccaac

SEQ ID NO: 889 - DNA, 21 bp, Artificial Sequence
  Synthetic Construct
aaagccaacagccaaatcacc

SEQ ID NO: 890 - DNA, 21 bp, Artificial Sequence
  Synthetic Construct
aaagcctacagcgtccaagtc

SEQ ID NO: 891 - DNA, 21 bp, Artificial Sequence
  Synthetic Construct
aaactcagcaccctccaccaa

SEQ ID NO: 892 - DNA, 21 bp, Artificial Sequence
  Synthetic Construct
aagcgggcgcctgctgattct

SEQ ID NO: 893 - DNA, 21 bp, Artificial Sequence
  Synthetic Construct
aaaaccaacaacaccgtcctc

SEQ ID NO: 894 - DNA, 21 bp, Artificial Sequence
  Synthetic Construct
aaaacccaactcggccaaatg

SEQ ID NO: 895 - DNA, 21 bp, Artificial Sequence
  Synthetic Construct
cttggttctgcgcttacgagg

SEQ ID NO: 896 - DNA, 21 bp, Artificial Sequence
  Synthetic Construct
ctcatcagcaccacccacaga

SEQ ID NO: 897 - DNA, 21 bp, Artificial Sequence
  Synthetic Construct
cttaaggttgcgtctggtttg

SEQ ID NO: 898 - DNA, 21 bp, Artificial Sequence
  Synthetic Construct
cttcttgcgactgggcttaag

SEQ ID NO: 899 - DNA, 21 bp, Artificial Sequence
  Synthetic Construct
cttccgggtggtgcgaggttg

SEQ ID NO: 900 - DNA, 21 bp, Artificial Sequence
  Synthetic Construct
cttaggggttctgctcaggtg

SEQ ID NO: 901 - DNA, 21 bp, Artificial Sequence
  Synthetic Construct
ttgtctgctcagcttccgcgg

SEQ ID NO: 902 - DNA, 21 bp, Artificial Sequence
  Synthetic Construct
ctttctactgcgttgactgtg

SEQ ID NO: 903 - DNA, 21 bp, Artificial Sequence
  Synthetic Construct
ctcaccagagtcggcaccgtc

SEQ ID NO: 904 - DNA, 21 bp, Artificial Sequence
  Synthetic Construct
atggccaacaccagaagcgcc

SEQ ID NO: 905 - DNA, 21 bp, Artificial Sequence
  Synthetic Construct
atgatcagaggcaccagcagc

SEQ ID NO: 906 - DNA, 21 bp, Artificial Sequence
  Synthetic Construct
atgctcagcggccaagccaga

SEQ ID NO: 907 - DNA, 21 bp, Artificial Sequence
  Synthetic Construct
atgagaggccaaggcgtccac

SEQ ID NO: 908 - DNA, 21 bp, Artificial Sequence
  Synthetic Construct
aacaacaaccaaaaagtctac

SEQ ID NO: 909 - DNA, 21 bp, Artificial Sequence
  Synthetic Construct
aacaacagcggccacatcagc

SEQ ID NO: 910 - DNA, 21 bp, Artificial Sequence
  Synthetic Construct
aacaccctcatcaacgtcagc

SEQ ID NO: 911 - DNA, 21 bp, Artificial Sequence
  Synthetic Construct
aatacttctggtgtgcctaag

SEQ ID NO: 912 - DNA, 21 bp, Artificial Sequence
  Synthetic Construct
aatgtgccgacttcgccgcgg

SEQ ID NO: 913 - DNA, 21 bp, Artificial Sequence
  Synthetic Construct
cccgccagaatccccggcagc

SEQ ID NO: 914 - DNA, 21 bp, Artificial Sequence
  Synthetic Construct
cccctcagaaacatcagcgcc

SEQ ID NO: 915 - DNA, 21 bp, Artificial Sequence
  Synthetic Construct
ccgttgagtgggggtgttcgt

SEQ ID NO: 916 - DNA, 21 bp, Artificial Sequence
  Synthetic Construct
cccaacagagccgccaacaac

SEQ ID NO: 917 - DNA, 21 bp, Artificial Sequence
  Synthetic Construct
ccgcgtcatgcgactcagtcg

SEQ ID NO: 918 - DNA, 21 bp, Artificial Sequence
  Synthetic Construct
ccgcggccggtgtcgaatggg

SEQ ID NO: 919 - DNA, 21 bp, Artificial Sequence
  Synthetic Construct
ccttctggttctgcgcggagt

SEQ ID NO: 920 - DNA, 21 bp, Artificial Sequence
  Synthetic Construct
cccagccacgccagagccagc

SEQ ID NO: 921 - DNA, 21 bp, Artificial Sequence
  Synthetic Construct
cccgtcggcaccagaaccagc

SEQ ID NO: 922 - DNA, 21 bp, Artificial Sequence
  Synthetic Construct
agagacaccgtcagcagatac

SEQ ID NO: 923 - DNA, 21 bp, Artificial Sequence
  Synthetic Construct
agaatcagcaccctcggcctc

SEQ ID NO: 924 - DNA, 21 bp, Artificial Sequence
  Synthetic Construct
aggcttgataggactggtttg

SEQ ID NO: 925 - DNA, 21 bp, Artificial Sequence
  Synthetic Construct
agactcaccaacagcaaccaa

SEQ ID NO: 926 - DNA, 21 bp, Artificial Sequence
  Synthetic Construct
cgtcagcatcagcttcctatg

SEQ ID NO: 927 - DNA, 21 bp, Artificial Sequence
  Synthetic Construct
agaaccgccaacgccctcggc

SEQ ID NO: 928 - DNA, 21 bp, Artificial Sequence
  Synthetic Construct
cggacggatgtgcggacgaat

SEQ ID NO: 929 - DNA, 21 bp, Artificial Sequence
  Synthetic Construct
cggactacggctaattcgctt

SEQ ID NO: 930 - DNA, 21 bp, Artificial Sequence
  Synthetic Construct
agcggcggcaccagagaaggc

SEQ ID NO: 931 - DNA, 21 bp, Artificial Sequence
  Synthetic Construct
agcatcagagcccccgtcagc

SEQ ID NO: 932 - DNA, 21 bp, Artificial Sequence
  Synthetic Construct
tcgatttctcctcctcgtacg

SEQ ID NO: 933 - DNA, 21 bp, Artificial Sequence
  Synthetic Construct
tcgaaggttacgcctcctctg

SEQ ID NO: 934 - DNA, 21 bp, Artificial Sequence
  Synthetic Construct
agcagcagactcagcgtcggc

SEQ ID NO: 935 - DNA, 21 bp, Artificial Sequence
  Synthetic Construct
agcaccagaaacgtcgtcggc

SEQ ID NO: 936 - DNA, 21 bp, Artificial Sequence
  Synthetic Construct
tcggttcctccgaataggaat

SEQ ID NO: 937 - DNA, 21 bp, Artificial Sequence
  Synthetic Construct
acggctgcgcatgttagttat

SEQ ID NO: 938 - DNA, 21 bp, Artificial Sequence
  Synthetic Construct
accagaagcgaagtcatgaaa

SEQ ID NO: 939 - DNA, 21 bp, Artificial Sequence
  Synthetic Construct
gtggcgggtctgactgttcag

SEQ ID NO: 940 - DNA, 21 bp, Artificial Sequence
  Synthetic Construct
gttggttctagtaatacgtat

SEQ ID NO: 941 - DNA, 21 bp, Artificial Sequence
  Synthetic Construct
gttaagactgatcgggttctg

SEQ ID NO: 942 - DNA, 21 bp, Artificial Sequence
  Synthetic Construct
gtcaacagccacgaaagagcc

SEQ ID NO: 943 - DNA, 21 bp, Artificial Sequence
  Synthetic Construct
gtccaagtcgccatgagagcc

SEQ ID NO: 944 - DNA, 21 bp, Artificial Sequence
  Synthetic Construct
gtcagcatcagcgtcatgggc

SEQ ID NO: 945 - DNA, 21 bp, Artificial Sequence
  Synthetic Construct
gtgacgggggttcggattggg

SEQ ID NO: 946 - DNA, 21 bp, Artificial Sequence
  Synthetic Construct
tggtctgatcctagtgatctg

SEQ ID NO: 947 - DNA, 21 bp, Artificial Sequence
  Synthetic Construct
tacctcaccagcggcggctac

SEQ ID NO: 948 - DNA, 21 bp, Artificial Sequence
  Synthetic Construct
tacccccacatgacccacgac

SEQ ID NO: 949 - DNA, 21 bp, Artificial Sequence
  Synthetic Construct
tatgttaatagtgctccgaag

SEQ ID NO: 950 - protein, 7 aa, Artificial Sequence
  Synthetic Construct
AEYNTGV

SEQ ID NO: 951 - protein, 7 aa, Artificial Sequence
  Synthetic Construct
ANAMGDH

SEQ ID NO: 952 - protein, 7 aa, Artificial Sequence
  Synthetic Construct
ESIQQLS

SEQ ID NO: 953 - protein, 7 aa, Artificial Sequence
  Synthetic Construct
FKVSIQQ

SEQ ID NO: 954 - protein, 7 aa, Artificial Sequence
  Synthetic Construct
FLLTSDP

SEQ ID NO: 955 - protein, 7 aa, Artificial Sequence
  Synthetic Construct
FQQDTYL

SEQ ID NO: 956 - protein, 7 aa, Artificial Sequence
  Synthetic Construct
FSGSARV

SEQ ID NO: 957 - protein, 7 aa, Artificial Sequence
  Synthetic Construct
FSVTRQA

SEQ ID NO: 958 - protein, 7 aa, Artificial Sequence
  Synthetic Construct
GAAGKSL

SEQ ID NO: 959 - protein, 7 aa, Artificial Sequence
  Synthetic Construct
GHISALA

SEQ ID NO: 960 - protein, 7 aa, Artificial Sequence
  Synthetic Construct
GLKVSGS

SEQ ID NO: 961 - protein, 7 aa, Artificial Sequence
  Synthetic Construct
GLQSPRS

SEQ ID NO: 962 - protein, 7 aa, Artificial Sequence
  Synthetic Construct
GRTVQDR

SEQ ID NO: 963 - protein, 7 aa, Artificial Sequence
  Synthetic Construct
GTKTHSL

SEQ ID NO: 964 - protein, 7 aa, Artificial Sequence
  Synthetic Construct
GTTRSPT

SEQ ID NO: 965 - protein, 7 aa, Artificial Sequence
  Synthetic Construct
HPSLRQS

SEQ ID NO: 966 - protein, 7 aa, Artificial Sequence
  Synthetic Construct
HSAKTIA

SEQ ID NO: 967 - protein, 7 aa, Artificial Sequence
  Synthetic Construct
HSGPTSS

SEQ ID NO: 968 - protein, 7 aa, Artificial Sequence
  Synthetic Construct
INKDNNQ

SEQ ID NO: 969 - protein, 7 aa, Artificial Sequence
  Synthetic Construct
INTASYK

SEQ ID NO: 970 - protein, 7 aa, Artificial Sequence
  Synthetic Construct
KAISTAN

SEQ ID NO: 971 - protein, 7 aa, Artificial Sequence
  Synthetic Construct
KANSQIT

SEQ ID NO: 972 - protein, 7 aa, Artificial Sequence
  Synthetic Construct
KAYSVQV

SEQ ID NO: 973 - protein, 7 aa, Artificial Sequence
  Synthetic Construct
KLSTLHQ

SEQ ID NO: 974 - protein, 7 aa, Artificial Sequence
  Synthetic Construct
KRAPADS

SEQ ID NO: 975 - protein, 7 aa, Artificial Sequence
  Synthetic Construct
KTNNTVL

SEQ ID NO: 976 - protein, 7 aa, Artificial Sequence
  Synthetic Construct
KTQLGQM

SEQ ID NO: 977 - protein, 7 aa, Artificial Sequence
  Synthetic Construct
LGSALTR

SEQ ID NO: 978 - protein, 7 aa, Artificial Sequence
  Synthetic Construct
LISTTHR

SEQ ID NO: 979 - protein, 7 aa, Artificial Sequence
  Synthetic Construct
LKVASGL

SEQ ID NO: 980 - protein, 7 aa, Artificial Sequence
  Synthetic Construct
LLATGLK

SEQ ID NO: 981 - protein, 7 aa, Artificial Sequence
  Synthetic Construct
LPGGARL

SEQ ID NO: 982 - protein, 7 aa, Artificial Sequence
  Synthetic Construct
LRGSAQV

SEQ ID NO: 983 - protein, 7 aa, Artificial Sequence
  Synthetic Construct
LSAQLPR

SEQ ID NO: 984 - protein, 7 aa, Artificial Sequence
  Synthetic Construct
LSTALTV

SEQ ID NO: 985 - protein, 7 aa, Artificial Sequence
  Synthetic Construct
LTRVGTV

SEQ ID NO: 986 - protein, 7 aa, Artificial Sequence
  Synthetic Construct
MANTRSA

SEQ ID NO: 987 - protein, 7 aa, Artificial Sequence
  Synthetic Construct
MIRGTSS

SEQ ID NO: 988 - protein, 7 aa, Artificial Sequence
  Synthetic Construct
MLSGQAR

SEQ ID NO: 989 - protein, 7 aa, Artificial Sequence
  Synthetic Construct
MRGQGVH

SEQ ID NO: 990 - protein, 7 aa, Artificial Sequence
  Synthetic Construct
NNNQKVY

SEQ ID NO: 991 - protein, 7 aa, Artificial Sequence
  Synthetic Construct
NNSGHIS

SEQ ID NO: 992 - protein, 7 aa, Artificial Sequence
  Synthetic Construct
NTLINVS

SEQ ID NO: 993 - protein, 7 aa, Artificial Sequence
  Synthetic Construct
NTSGVPK

SEQ ID NO: 994 - protein, 7 aa, Artificial Sequence
  Synthetic Construct
NVPTSPR

SEQ ID NO: 995 - protein, 7 aa, Artificial Sequence
  Synthetic Construct
PARIPGS

SEQ ID NO: 996 - protein, 7 aa, Artificial Sequence
  Synthetic Construct
PLRNISA

SEQ ID NO: 997 - protein, 7 aa, Artificial Sequence
  Synthetic Construct
PLSGGVR

SEQ ID NO: 998 - protein, 7 aa, Artificial Sequence
  Synthetic Construct
PNRAANN

SEQ ID NO: 999 - protein, 7 aa, Artificial Sequence
  Synthetic Construct
PRHATQS

SEQ ID NO: 1000 - protein, 7 aa, Artificial Sequence
  Synthetic Construct
PRPVSNG

SEQ ID NO: 1001 - protein, 7 aa, Artificial Sequence
  Synthetic Construct
PSGSARS

SEQ ID NO: 1002 - protein, 7 aa, Artificial Sequence
  Synthetic Construct
PSHARAS

SEQ ID NO: 1003 - protein, 7 aa, Artificial Sequence
  Synthetic Construct
PVGTRTS

SEQ ID NO: 1004 - protein, 7 aa, Artificial Sequence
  Synthetic Construct
RDTVSRY

SEQ ID NO: 1005 - protein, 7 aa, Artificial Sequence
  Synthetic Construct
RISTLGL

SEQ ID NO: 1006 - protein, 7 aa, Artificial Sequence
  Synthetic Construct
RLDRTGL

SEQ ID NO: 1007 - protein, 7 aa, Artificial Sequence
  Synthetic Construct
RLTNSNQ

SEQ ID NO: 1008 - protein, 7 aa, Artificial Sequence
  Synthetic Construct
RQHQLPM

SEQ ID NO: 1009 - protein, 7 aa, Artificial Sequence
  Synthetic Construct
RTANALG

SEQ ID NO: 1010 - protein, 7 aa, Artificial Sequence
  Synthetic Construct
RTDVRTN

SEQ ID NO: 1011 - protein, 7 aa, Artificial Sequence
  Synthetic Construct
RTTANSL

SEQ ID NO: 1012 - protein, 7 aa, Artificial Sequence
  Synthetic Construct
SGGTREG

SEQ ID NO: 1013 - protein, 7 aa, Artificial Sequence
  Synthetic Construct
SIRAPVS

SEQ ID NO: 1014 - protein, 7 aa, Artificial Sequence
  Synthetic Construct
SISPPRT

SEQ ID NO: 1015 - protein, 7 aa, Artificial Sequence
  Synthetic Construct
SKVTPPL

SEQ ID NO: 1016 - protein, 7 aa, Artificial Sequence
  Synthetic Construct
SSRLSVG

SEQ ID NO: 1017 - protein, 7 aa, Artificial Sequence
  Synthetic Construct
STRNVVG

SEQ ID NO: 1018 - protein, 7 aa, Artificial Sequence
  Synthetic Construct
SVPPNRN

SEQ ID NO: 1019 - protein, 7 aa, Artificial Sequence
  Synthetic Construct
TAAHVSY

SEQ ID NO: 1020 - protein, 7 aa, Artificial Sequence
  Synthetic Construct
TRSEVMK

SEQ ID NO: 1021 - protein, 7 aa, Artificial Sequence
  Synthetic Construct
VAGLTVQ

SEQ ID NO: 1022 - protein, 7 aa, Artificial Sequence
  Synthetic Construct
VGSSNTY

SEQ ID NO: 1023 - protein, 7 aa, Artificial Sequence
  Synthetic Construct
VKTDRVL

SEQ ID NO: 1024 - protein, 7 aa, Artificial Sequence
  Synthetic Construct
VNSHERA

SEQ ID NO: 1025 - protein, 7 aa, Artificial Sequence
  Synthetic Construct
VQVAMRA

SEQ ID NO: 1026 - protein, 7 aa, Artificial Sequence
  Synthetic Construct
VSISVMG

SEQ ID NO: 1027 - protein, 7 aa, Artificial Sequence
  Synthetic Construct
VTGVRIG

SEQ ID NO: 1028 - protein, 7 aa, Artificial Sequence
  Synthetic Construct
WSDPSDL

SEQ ID NO: 1029 - protein, 7 aa, Artificial Sequence
  Synthetic Construct
YLTSGGY

SEQ ID NO: 1030 - protein, 7 aa, Artificial Sequence
  Synthetic Construct
YPHMTHD

SEQ ID NO: 1031 - protein, 7 aa, Artificial Sequence
  Synthetic Construct
YVNSAPK

SEQ ID NO: 1032 - DNA, 58 bp, Artificial Sequence
  Synthetic Construct
ggagtcctatggacaagtggccacaaaccaccagagtgcccaaaccgccctcaaaccc

SEQ ID NO: 1033 - DNA, 58 bp, Artificial Sequence
  Synthetic Construct
ggagtcctatggacaagtggccacaaaccaccagagtgcccaaaccaccctcaaaccc

SEQ ID NO: 1034 - DNA, 58 bp, Artificial Sequence
  Synthetic Construct
ggagtcctatggacaagtggccacaaaccaccagagtgcccaaacgttgcagattcct

SEQ ID NO: 1035 - DNA, 58 bp, Artificial Sequence
  Synthetic Construct
ggagtcctatggacaagtggccacaaaccaccagagtgcccaaaccctccaactcccc

SEQ ID NO: 1036 - DNA, 58 bp, Artificial Sequence
  Synthetic Construct
ggagtcctatggacaagtggccacaaaccaccagagtgcccaaactttgcagcagccg

SEQ ID NO: 1037 - DNA, 58 bp, Artificial Sequence
  Synthetic Construct
ggagtcctatggacaagtggccacaaaccaccagagtgcccaaagcatcgaaagaccc

SEQ ID NO: 1038 - DNA, 58 bp, Artificial Sequence
  Synthetic Construct
ggagtcctatggacaagtggccacaaaccaccagagtgcccaaaccatgcaaaaaccc

SEQ ID NO: 1039 - DNA, 58 bp, Artificial Sequence
  Synthetic Construct
ggagtcctatggacaagtggccacaaaccaccagagtgcccaaaggtatcagggtgat

SEQ ID NO: 1040 - DNA, 58 bp, Artificial Sequence
  Synthetic Construct
ggagtcctatggacaagtggccacaaaccaccagagtgcccaatggtcgacaaacgct

SEQ ID NO: 1041 - DNA, 58 bp, Artificial Sequence
  Synthetic Construct
ggagtcctatggacaagtggccacaaaccaccagagtgcccaagagcgtgtaggtttc

SEQ ID NO: 1042 - DNA, 58 bp, Artificial Sequence
  Synthetic Construct
ggagtcctatggacaagtggccacaaaccaccagagtgcgcagaccctagctgtccct

SEQ ID NO: 1043 - DNA, 58 bp, Artificial Sequence
  Synthetic Construct
ggagtcctatggacaagtggccacaaaccaccagagtgcccaagccagacaaatggac

SEQ ID NO: 1044 - DNA, 58 bp, Artificial Sequence
  Synthetic Construct
ggagtcctatggacaagtggccacaaaccaccagagtgcccaaaccaacaaagtcggc

SEQ ID NO: 1045 - DNA, 58 bp, Artificial Sequence
  Synthetic Construct
ggagtcctatggacaagtggccacaaaccaccagagtgcccaacagaacgtaacgaag

SEQ ID NO: 1046 - DNA, 58 bp, Artificial Sequence
  Synthetic Construct
ggagtcctatggacaagtggccacaaaccaccagagtgcccaactcaacgctatcaag

SEQ ID NO: 1047 - DNA, 64 bp, Artificial Sequence
  Synthetic Construct
ttccttggttttgaacccaaccggtctgcgcctgtgcgaggaagggtttgagggcggtttgggc

SEQ ID NO: 1048 - DNA, 64 bp, Artificial Sequence
  Synthetic Construct
ttccttggttttgaacccaaccggtctgcgcctgtgcgaggaagggtttgagggtggtttgggc

SEQ ID NO: 1049 - DNA, 64 bp, Artificial Sequence
  Synthetic Construct
ttccttggttttgaacccaaccggtctgcgcctgtgccttaaaaggaatctgcaacgtttgggc

SEQ ID NO: 1050 - DNA, 64 bp, Artificial Sequence
  Synthetic Construct
ttccttggttttgaacccaaccggtctgcgcttgggctttgaaggggagttggagggtttgggc

SEQ ID NO: 1051 - DNA, 64 bp, Artificial Sequence
  Synthetic Construct
ttccttggttttgaacccaaccggtctgcgcctgtgccttaaacggctgctgcaaagtttgggc

SEQ ID NO: 1052 - DNA, 64 bp, Artificial Sequence
  Synthetic Construct
ttccttggttttgaacccaaccggtctgcgcctgtgctttgaagggtctttcgatgctttgggc

SEQ ID NO: 1053 - DNA, 64 bp, Artificial Sequence
  Synthetic Construct
ttccttggttttgaacccaaccggtctgcgcctgtgcgatgaagggtttttgcatggtttgggc

SEQ ID NO: 1054 - DNA, 64 bp, Artificial Sequence
  Synthetic Construct
ttccttggttttgaacccaaccggtctgcgcctgtgcaacagaatcaccctgatacctttgggc

SEQ ID NO: 1055 - DNA, 64 bp, Artificial Sequence
  Synthetic Construct
ttccttggttttgaacccaaccggtctgcgcctgtgcgtaaccagcgtttgtcgaccattgggc

SEQ ID NO: 1056 - DNA, 64 bp, Artificial Sequence
  Synthetic Construct
ttccttggttttgaacccaaccggtctgcgcctgtgcctgtgcgaaacctacacgctcttgggc

SEQ ID NO: 1057 - DNA, 64 bp, Artificial Sequence
  Synthetic Construct
ttccttggttttgaacccaaccggtctgcgcagggttcgaaaaagggacagctagggtctgcgc

SEQ ID NO: 1058 - DNA, 64 bp, Artificial Sequence
  Synthetic Construct
ttccttggttttgaacccaaccggtctgcgcctgtgcgctgaggtccatttgtctggcttgggc

SEQ ID NO: 1059 - DNA, 64 bp, Artificial Sequence
  Synthetic Construct
ttccttggttttgaacccaaccggtctgcgcctgtgcgatgttgccgactttgttggtttgggc

SEQ ID NO: 1060 - DNA, 64 bp, Artificial Sequence
  Synthetic Construct
ttccttggttttgaacccaaccggtctgcgcctgtgccacacccttcgttacgttctgttgggc

SEQ ID NO: 1061 - DNA, 64 bp, Artificial Sequence
  Synthetic Construct
ttccttggttttgaacccaaccggtctgcgcctgtgcgatgttcttgatagcgttgagttgggc

SEQ ID NO: 1062 - protein, 11 aa, Artificial Sequence
  Synthetic Construct
AQTLQLPFKAQ

SEQ ID NO: 1063 - protein, 11 aa, Artificial Sequence
  Synthetic Construct
AQTLQQPFKAQ

SEQ ID NO: 1064 - protein, 11 aa, Artificial Sequence
  Synthetic Construct
AQTLAVPFSNP

SEQ ID NO: 1065 - protein, 11 aa, Artificial Sequence
  Synthetic Construct
AQARQMDLSAQ

SEQ ID NO: 1066 - protein, 11 aa, Artificial Sequence
  Synthetic Construct
AQTNKVGNIAQ

SEQ ID NO: 1067 - protein, 11 aa, Artificial Sequence
  Synthetic Construct
AQLNAIKNIAQ

SEQ ID NO: 1068 - DNA, 33 bp, Artificial Sequence
  Synthetic Construct
gcccaaaccctccaactccccttcaaagcccaa

SEQ ID NO: 1069 - DNA, 33 bp, Artificial Sequence
  Synthetic Construct
gcccaaactttgcagcagccgtttaaggcacag

SEQ ID NO: 1070 - DNA, 33 bp, Artificial Sequence
  Synthetic Construct
gcgcagaccctagctgtccctttttcgaaccct

SEQ ID NO: 1071 - DNA, 33 bp, Artificial Sequence
  Synthetic Construct
gcccaagccagacaaatggacctcagcgcacag

SEQ ID NO: 1072 - DNA, 33 bp, Artificial Sequence
  Synthetic Construct
gcccaaaccaacaaagtcggcaacatcgcacag

SEQ ID NO: 1073 - DNA, 33 bp, Artificial Sequence
  Synthetic Construct
gcccaactcaacgctatcaagaacatcgcacag

SEQ ID NO: 1074 - DNA, 33 bp, Artificial Sequence
  Synthetic Construct
gcccaaacgttgcagattccttttaaggcacag

SEQ ID NO: 1075 - DNA, 33 bp, Artificial Sequence
  Synthetic Construct
gcccaaaccgccctcaaacccttcctcgcacag

SEQ ID NO: 1076 - DNA, 33 bp, Artificial Sequence
  Synthetic Construct
gcccaaaccaccctcaaacccttcctcgcacag

SEQ ID NO: 1077 - DNA, 33 bp, Artificial Sequence
  Synthetic Construct
gcccaaagcatcgaaagacccttcaaagcacag

SEQ ID NO: 1078 - DNA, 33 bp, Artificial Sequence
  Synthetic Construct
gcccaaacccaaaacagacccttcctcgcacag

SEQ ID NO: 1079 - DNA, 33 bp, Artificial Sequence
  Synthetic Construct
gcccaaaccatgcaaaaacccttcatcgcacag

SEQ ID NO: 1080 - DNA, 33 bp, Artificial Sequence
  Synthetic Construct
gcccaaactagtacgcggccgtttttggcacag

SEQ ID NO: 1081 - DNA, 33 bp, Artificial Sequence
  Synthetic Construct
gcccaaggcaccttcgtcccccccaccgcacag

SEQ ID NO: 1082 - DNA, 33 bp, Artificial Sequence
  Synthetic Construct
gcccaatggtcgactaatgcgggttatgcacag

SEQ ID NO: 1083 - DNA, 33 bp, Artificial Sequence
  Synthetic Construct
gcccaaaccctcgaaagacccttcaccgcacag

SEQ ID NO: 1084 - DNA, 33 bp, Artificial Sequence
  Synthetic Construct
gcccaaactgctgctaagccgtttctggcacag

SEQ ID NO: 1085 - DNA, 33 bp, Artificial Sequence
  Synthetic Construct
gcccaaattaggattggttattcgcaggcacag

SEQ ID NO: 1086 - DNA, 33 bp, Artificial Sequence
  Synthetic Construct
gcccaagagcgtgtgggttttgctcaggcacag

SEQ ID NO: 1087 - DNA, 33 bp, Artificial Sequence
  Synthetic Construct
gcccaagccgacctcctcaactacagagcacag

SEQ ID NO: 1088 - DNA, 33 bp, Artificial Sequence
  Synthetic Construct
gcccaactcgtcgccggcttcagccaagcacag

SEQ ID NO: 1089 - DNA, 33 bp, Artificial Sequence
  Synthetic Construct
gcccaatcgtctctgaagccttttctggcacag

SEQ ID NO: 1090 - DNA, 33 bp, Artificial Sequence
  Synthetic Construct
gcccaaacgcattctaggccgtttattgcacag

SEQ ID NO: 1091 - DNA, 33 bp, Artificial Sequence
  Synthetic Construct
gcccaaccttttcctggttattctgcggcacag

SEQ ID NO: 1092 - DNA, 33 bp, Artificial Sequence
  Synthetic Construct
gcccaaattattgttgggtatagtcaggcacag

SEQ ID NO: 1093 - DNA, 33 bp, Artificial Sequence
  Synthetic Construct
gcccaaaggtatcagggtgattctgttgcacag

SEQ ID NO: 1094 - DNA, 33 bp, Artificial Sequence
  Synthetic Construct
gcccaaaggtatgctggggattctattgcacag

SEQ ID NO: 1095 - DNA, 33 bp, Artificial Sequence
  Synthetic Construct
gcccaaaagacgattggggagcattgggcacag

SEQ ID NO: 1096 - DNA, 33 bp, Artificial Sequence
  Synthetic Construct
gcccaatggatgacgcatggttctgcggcacag

SEQ ID NO: 1097 - DNA, 33 bp, Artificial Sequence
  Synthetic Construct
gcccaagctgcttcgaggccgtttcttgcacag

SEQ ID NO: 1098 - DNA, 33 bp, Artificial Sequence
  Synthetic Construct
gcccaaactacttctaggccgtttcttgcacag

SEQ ID NO: 1099 - DNA, 33 bp, Artificial Sequence
  Synthetic Construct
gcccaagctcgtgtgggtttggctcaggcacag

SEQ ID NO: 1100 - DNA, 33 bp, Artificial Sequence
  Synthetic Construct
gcccaagggactagtccgaatcttgcggcacag

SEQ ID NO: 1101 - DNA, 33 bp, Artificial Sequence
  Synthetic Construct
gcccaagtgcgtacggggtatagttctgcacag

SEQ ID NO: 1102 - DNA, 33 bp, Artificial Sequence
  Synthetic Construct
gcccaaattcgggtggggtatagttctgcacag

SEQ ID NO: 1103 - DNA, 33 bp, Artificial Sequence
  Synthetic Construct
gcccaaactactttgcgtccgtttattgcacag

SEQ ID NO: 1104 - DNA, 33 bp, Artificial Sequence
  Synthetic Construct
gcccaaggtattacgtctctgtttaaggcacag

SEQ ID NO: 1105 - DNA, 33 bp, Artificial Sequence
  Synthetic Construct
gcccaaaccacccaaacccccttcagagcacag

SEQ ID NO: 1106 - DNA, 33 bp, Artificial Sequence
  Synthetic Construct
gcccaaactgtgtcgaggccgtttttggcacag

SEQ ID NO: 1107 - DNA, 33 bp, Artificial Sequence
  Synthetic Construct
gcccaatatgggacgaatccgtttcgtgcacag

SEQ ID NO: 1108 - DNA, 33 bp, Artificial Sequence
  Synthetic Construct
gcccaacccaccatggtcgacagcagcgcacag

SEQ ID NO: 1109 - DNA, 33 bp, Artificial Sequence
  Synthetic Construct
gcccaaaataaggctagttctcagaatgcacag

SEQ ID NO: 1110 - DNA, 33 bp, Artificial Sequence
  Synthetic Construct
gcccaaacttttcgtagttcgaatgatgcacag

SEQ ID NO: 1111 - DNA, 33 bp, Artificial Sequence
  Synthetic Construct
gcccaactgccggatcgttatcctaatgcacag

SEQ ID NO: 1112 - DNA, 33 bp, Artificial Sequence
  Synthetic Construct
gcccaacagaatgttacgaagggtgttgcacag

SEQ ID NO: 1113 - DNA, 33 bp, Artificial Sequence
  Synthetic Construct
gcccaagctcagtctccgattcttcgggcacag

SEQ ID NO: 1114 - DNA, 33 bp, Artificial Sequence
  Synthetic Construct
gcccaagtggctactggttattcttcggcacag

SEQ ID NO: 1115 - DNA, 33 bp, Artificial Sequence
  Synthetic Construct
gcccaattgaattcgaatcggcctaatgcacag

SEQ ID NO: 1116 - DNA, 33 bp, Artificial Sequence
  Synthetic Construct
gcccaaacgattcgtaataatacgattgcacag

SEQ ID NO: 1117 - DNA, 33 bp, Artificial Sequence
  Synthetic Construct
gcccaagatcttagtcgtatttttaaggcacag

SEQ ID NO: 1118 - DNA, 33 bp, Artificial Sequence
  Synthetic Construct
gcccaactcagcaacagcgccagccaagcacag

SEQ ID NO: 1119 - DNA, 33 bp, Artificial Sequence
  Synthetic Construct
gcccaactcgaaaacatggtcatgagcgcacag

SEQ ID NO: 1120 - DNA, 33 bp, Artificial Sequence
  Synthetic Construct
gcccaattgactcagcagacggatgttgcacag

SEQ ID NO: 1121 - DNA, 33 bp, Artificial Sequence
  Synthetic Construct
gcccaagccggcctcgcccacgccaccgcacag

SEQ ID NO: 1122 - DNA, 33 bp, Artificial Sequence
  Synthetic Construct
gcccaaaatgctcatactgcgctggatgcacag

SEQ ID NO: 1123 - DNA, 33 bp, Artificial Sequence
  Synthetic Construct
gcccaatggccgattcttcgggctgatgcacag

SEQ ID NO: 1124 - DNA, 33 bp, Artificial Sequence
  Synthetic Construct
gcccaagcgctggctggtctgtctctggcacag

SEQ ID NO: 1125 - DNA, 33 bp, Artificial Sequence
  Synthetic Construct
gcccaacgtattgatatgccttttaaggcacag

SEQ ID NO: 1126 - DNA, 33 bp, Artificial Sequence
  Synthetic Construct
gcccaaacgatgtcgttgagtagtagtgcacag

SEQ ID NO: 1127 - DNA, 33 bp, Artificial Sequence
  Synthetic Construct
gcccaacaaaacgtcgccaaaaacctcgcacag

SEQ ID NO: 1128 - DNA, 33 bp, Artificial Sequence
  Synthetic Construct
gcccaattcgacaaccccaacaacgtcgcacag

SEQ ID NO: 1129 - DNA, 33 bp, Artificial Sequence
  Synthetic Construct
gcccaagtcctcatgagagaaagcctcgcacag

SEQ ID NO: 1130 - DNA, 33 bp, Artificial Sequence
  Synthetic Construct
gcccaacaccacgacaccggcagcgccgcacag

SEQ ID NO: 1131 - DNA, 33 bp, Artificial Sequence
  Synthetic Construct
gcccaagatgcgccgaatagtgtggatgcacag

SEQ ID NO: 1132 - DNA, 33 bp, Artificial Sequence
  Synthetic Construct
gcccaaactgcgagtagggatgctaaggcacag

SEQ ID NO: 1133 - DNA, 33 bp, Artificial Sequence
  Synthetic Construct
gcccaaactaattatacgaagcagattgcacag

SEQ ID NO: 1134 - DNA, 33 bp, Artificial Sequence
  Synthetic Construct
gcccaacctcataatgcttctgtgttggcacag

SEQ ID NO: 1135 - DNA, 33 bp, Artificial Sequence
  Synthetic Construct
gcccaaaccaacaacaccagaaacatcgcacag

SEQ ID NO: 1136 - DNA, 33 bp, Artificial Sequence
  Synthetic Construct
gcccaaatggttcctaatcattctggtgcacag

SEQ ID NO: 1137 - DNA, 33 bp, Artificial Sequence
  Synthetic Construct
gcccaaccggtgccgcagtctgagcatgcacag

SEQ ID NO: 1138 - DNA, 33 bp, Artificial Sequence
  Synthetic Construct
gcccaactctaccacggcggcagcaccgcacag

SEQ ID NO: 1139 - DNA, 33 bp, Artificial Sequence
  Synthetic Construct
gcccaaatgattcatactagggagacggcacag

SEQ ID NO: 1140 - DNA, 33 bp, Artificial Sequence
  Synthetic Construct
gcccaaactaataatacgaagcctcttgcacag

SEQ ID NO: 1141 - DNA, 33 bp, Artificial Sequence
  Synthetic Construct
gcccaactcaacaccaccagaaacaccgcacag

SEQ ID NO: 1142 - DNA, 33 bp, Artificial Sequence
  Synthetic Construct
gcccaagctttgcataattctcagaatgcacag

SEQ ID NO: 1143 - DNA, 33 bp, Artificial Sequence
  Synthetic Construct
gcccaagtgaatagtacgaggaatgttgcacag

SEQ ID NO: 1144 - DNA, 33 bp, Artificial Sequence
  Synthetic Construct
gcccaaggtgttggggttgttacgaaggcacag

SEQ ID NO: 1145 - DNA, 33 bp, Artificial Sequence
  Synthetic Construct
gcccaagttttgtcgaagcagttggctgcacag

SEQ ID NO: 1146 - DNA, 33 bp, Artificial Sequence
  Synthetic Construct
gcccaatctaagtctctgcagccgttggcacag

SEQ ID NO: 1147 - DNA, 33 bp, Artificial Sequence
  Synthetic Construct
gcccaatcgaattctacgcggttggttgcacag

SEQ ID NO: 1148 - DNA, 33 bp, Artificial Sequence
  Synthetic Construct
gcccaactcaaccaaaccaaacaaatcgcacag

SEQ ID NO: 1149 - DNA, 33 bp, Artificial Sequence
  Synthetic Construct
gcccaaaacaacagcgtcagacaactcgcacag

SEQ ID NO: 1150 - DNA, 33 bp, Artificial Sequence
  Synthetic Construct
gcccaaatgtcggggtattcgcatactgcacag

SEQ ID NO: 1151 - DNA, 33 bp, Artificial Sequence
  Synthetic Construct
gcccaagtcaaagtccccatcatcaccgcacag

SEQ ID NO: 1152 - DNA, 33 bp, Artificial Sequence
  Synthetic Construct
gcccaagggaataatactcgggcggtggcacag

SEQ ID NO: 1153 - DNA, 33 bp, Artificial Sequence
  Synthetic Construct
gcccaacagaatcagattaagaatattgcacag

SEQ ID NO: 1154 - DNA, 33 bp, Artificial Sequence
  Synthetic Construct
gcccaaaccaacatgaccaaacccctcgcacag

SEQ ID NO: 1155 - DNA, 33 bp, Artificial Sequence
  Synthetic Construct
gcccaaaacaacagcaccagactcagcgcacag

SEQ ID NO: 1156 - DNA, 33 bp, Artificial Sequence
  Synthetic Construct
gcccaaagcatgctcaccagcatcgtcgcacag

SEQ ID NO: 1157 - DNA, 33 bp, Artificial Sequence
  Synthetic Construct
gcccaactcaacgccaccgccagcagagcacag

SEQ ID NO: 1158 - DNA, 33 bp, Artificial Sequence
  Synthetic Construct
gcccaaaatactggggtgcaggttagggcacag

SEQ ID NO: 1159 - DNA, 33 bp, Artificial Sequence
  Synthetic Construct
gcccaaaccaacaccgtcagacccatcgcacag

SEQ ID NO: 1160 - DNA, 33 bp, Artificial Sequence
  Synthetic Construct
gcccaacagtctacgccgggggctactgcacag

SEQ ID NO: 1161 - DNA, 33 bp, Artificial Sequence
  Synthetic Construct
gcccaaggtcattctgagaattctcgtgcacag

SEQ ID NO: 1162 - DNA, 33 bp, Artificial Sequence
  Synthetic Construct
gcccaactccccacccaaaccctcagagcacag

SEQ ID NO: 1163 - DNA, 33 bp, Artificial Sequence
  Synthetic Construct
gcccaaaagaatgctccgatgcctgatgcacag

SEQ ID NO: 1164 - DNA, 33 bp, Artificial Sequence
  Synthetic Construct
gcccaaagcaacagcaccaaacccaccgcacag

SEQ ID NO: 1165 - DNA, 33 bp, Artificial Sequence
  Synthetic Construct
gcccaacctattattactatgcctgctgcacag

SEQ ID NO: 1166 - DNA, 33 bp, Artificial Sequence
  Synthetic Construct
gcccaacccctcaaaggcatcggcagcgcacag

SEQ ID NO: 1167 - DNA, 33 bp, Artificial Sequence
  Synthetic Construct
gcccaagtcctcagcgtcaaccacctcgcacag

SEQ ID NO: 1168 - DNA, 33 bp, Artificial Sequence
  Synthetic Construct
gcccaaagtgtggctgctgtgcatatggcacag

SEQ ID NO: 1169 - DNA, 33 bp, Artificial Sequence
  Synthetic Construct
gcccaaagcaacagcatcagactcgtcgcacag

SEQ ID NO: 1170 - DNA, 33 bp, Artificial Sequence
  Synthetic Construct
gcccaacataatgatactcgtcctcttgcacag

SEQ ID NO: 1171 - DNA, 33 bp, Artificial Sequence
  Synthetic Construct
gcccaacctccggtgaggtctacggctgcacag

SEQ ID NO: 1172 - DNA, 33 bp, Artificial Sequence
  Synthetic Construct
gcccaaatgaacaccgtcagaaacctcgcacag

SEQ ID NO: 1173 - DNA, 33 bp, Artificial Sequence
  Synthetic Construct
gcccaattgacggatggtcatcggattgcacag

SEQ ID NO: 1174 - DNA, 33 bp, Artificial Sequence
  Synthetic Construct
gcccaaacgaatgcggtgaagctgactgcacag

SEQ ID NO: 1175 - DNA, 33 bp, Artificial Sequence
  Synthetic Construct
gcccaacgtgtggatgcggttttgagtgcacag

SEQ ID NO: 1176 - DNA, 33 bp, Artificial Sequence
  Synthetic Construct
gcccaaaccaacgccgtcaaaagcaccgcacag

SEQ ID NO: 1177 - DNA, 33 bp, Artificial Sequence
  Synthetic Construct
gcccaaatgctcaacaccaccgccagagcacag

SEQ ID NO: 1178 - DNA, 33 bp, Artificial Sequence
  Synthetic Construct
gcccaaggcaacaacaccagacccaccgcacag

SEQ ID NO: 1179 - DNA, 33 bp, Artificial Sequence
  Synthetic Construct
gcccaacagtctgggggtagtgcgttggcacag

SEQ ID NO: 1180 - DNA, 33 bp, Artificial Sequence
  Synthetic Construct
gcccaagtgattgctttgtctactatggcacag

SEQ ID NO: 1181 - DNA, 33 bp, Artificial Sequence
  Synthetic Construct
gcccaactgaatacgattcggaatgtggcacag

SEQ ID NO: 1182 - DNA, 33 bp, Artificial Sequence
  Synthetic Construct
gcccaaagcaacgccaccagaagcgtcgcacag

SEQ ID NO: 1183 - DNA, 33 bp, Artificial Sequence
  Synthetic Construct
gcccaaggcaacggcaccaaattcatcgcacag

SEQ ID NO: 1184 - DNA, 33 bp, Artificial Sequence
  Synthetic Construct
gcccaaagcaacaccatcagacccgtcgcacag

SEQ ID NO: 1185 - DNA, 33 bp, Artificial Sequence
  Synthetic Construct
gcccaaagcaacagcaccagagccatcgcacag

SEQ ID NO: 1186 - DNA, 33 bp, Artificial Sequence
  Synthetic Construct
gcccaatttcatttgactgataggggtgcacag

SEQ ID NO: 1187 - DNA, 33 bp, Artificial Sequence
  Synthetic Construct
gcccaaccgattaggtcggatactgtggcacag

SEQ ID NO: 1188 - DNA, 33 bp, Artificial Sequence
  Synthetic Construct
gcccaagccaaccaaatccacaacaccgcacag

SEQ ID NO: 1189 - DNA, 33 bp, Artificial Sequence
  Synthetic Construct
gcccaatcgaatacggttcggaatactgcacag

SEQ ID NO: 1190 - DNA, 33 bp, Artificial Sequence
  Synthetic Construct
gcccaaaccagcctcggctacagcagcgcacag

SEQ ID NO: 1191 - DNA, 33 bp, Artificial Sequence
  Synthetic Construct
gcccaaatcagcggcgtccaaaccagagcacag

SEQ ID NO: 1192 - DNA, 33 bp, Artificial Sequence
  Synthetic Construct
gcccaatcgaatgctgttaggcagactgcacag

SEQ ID NO: 1193 - DNA, 33 bp, Artificial Sequence
  Synthetic Construct
gcccaatctctttctgagcttaggattgcacag

SEQ ID NO: 1194 - DNA, 33 bp, Artificial Sequence
  Synthetic Construct
gcccaaagtactgagaagagggatgaggcacag

SEQ ID NO: 1195 - DNA, 33 bp, Artificial Sequence
  Synthetic Construct
gcccaaaacctcgtcggcaccctcatcgcacag

SEQ ID NO: 1196 - DNA, 33 bp, Artificial Sequence
  Synthetic Construct
gcccaaggcaacaacatcagactcaccgcacag

SEQ ID NO: 1197 - DNA, 33 bp, Artificial Sequence
  Synthetic Construct
gcccaagccgtccccaccggcctcagagcacag

SEQ ID NO: 1198 - DNA, 33 bp, Artificial Sequence
  Synthetic Construct
gcccaaggtgataatagtctgactagggcacag

SEQ ID NO: 1199 - DNA, 33 bp, Artificial Sequence
  Synthetic Construct
gcccaacacgccgacaacagactcaaagcacag

SEQ ID NO: 1200 - DNA, 33 bp, Artificial Sequence
  Synthetic Construct
gcccaaagcaacgccaccagaaacttcgcacag

SEQ ID NO: 1201 - DNA, 33 bp, Artificial Sequence
  Synthetic Construct
gcccaagggaatacgactagggggctggcacag

SEQ ID NO: 1202 - DNA, 33 bp, Artificial Sequence
  Synthetic Construct
gcccaactcaacctcaccgccaccaacgcacag

SEQ ID NO: 1203 - DNA, 33 bp, Artificial Sequence
  Synthetic Construct
gcccaaagcggcgtcagcaccaccgacgcacag

SEQ ID NO: 1204 - DNA, 33 bp, Artificial Sequence
  Synthetic Construct
gcccaatatgctaagacgttggctatggcacag

SEQ ID NO: 1205 - DNA, 33 bp, Artificial Sequence
  Synthetic Construct
gcccaaatgaaccacaccaaacccaccgcacag

SEQ ID NO: 1206 - DNA, 33 bp, Artificial Sequence
  Synthetic Construct
gcccaagctaatgctacgaggaattctgcacag

SEQ ID NO: 1207 - DNA, 33 bp, Artificial Sequence
  Synthetic Construct
gcccaacaaaaccaaaccaaaatcaccgcacag

SEQ ID NO: 1208 - DNA, 33 bp, Artificial Sequence
  Synthetic Construct
gcccaatctaatgctattaaggctacggcacag

SEQ ID NO: 1209 - DNA, 33 bp, Artificial Sequence
  Synthetic Construct
gcccaatatcctgataattatggtaaggcacag

SEQ ID NO: 1210 - DNA, 33 bp, Artificial Sequence
  Synthetic Construct
gcccaaggcaacaccaccatcagaagcgcacag

SEQ ID NO: 1211 - DNA, 33 bp, Artificial Sequence
  Synthetic Construct
gcccaactgggtcttacgggtgcggttgcacag

SEQ ID NO: 1212 - DNA, 33 bp, Artificial Sequence
  Synthetic Construct
gcccaagcgaatagtacgcgtattctggcacag

SEQ ID NO: 1213 - DNA, 33 bp, Artificial Sequence
  Synthetic Construct
gcccaagataatgcgattcgtgcgcaggcacag

SEQ ID NO: 1214 - DNA, 33 bp, Artificial Sequence
  Synthetic Construct
gcccaaacgaattatactaagcttatggcacag

SEQ ID NO: 1215 - DNA, 33 bp, Artificial Sequence
  Synthetic Construct
gcccaacataatagtcctagtagttatgcacag

SEQ ID NO: 1216 - DNA, 33 bp, Artificial Sequence
  Synthetic Construct
gcccaagagaatatggttcggtctgtggcacag

SEQ ID NO: 1217 - DNA, 33 bp, Artificial Sequence
  Synthetic Construct
gcccaaaccaacaacatcaaaagctacgcacag

SEQ ID NO: 1218 - DNA, 33 bp, Artificial Sequence
  Synthetic Construct
gcccaaactaattcgacgaggcctgtggcacag

SEQ ID NO: 1219 - DNA, 33 bp, Artificial Sequence
  Synthetic Construct
gcccaacatacggctccgcctcatcctgcacag

SEQ ID NO: 1220 - DNA, 33 bp, Artificial Sequence
  Synthetic Construct
gcccaagccctcagccaaaacaccagcgcacag

SEQ ID NO: 1221 - DNA, 33 bp, Artificial Sequence
  Synthetic Construct
gcccaaccgaatgtgactaagaatgctgcacag

SEQ ID NO: 1222 - DNA, 33 bp, Artificial Sequence
  Synthetic Construct
gcccaacttgatacgctgacgggttatgcacag

SEQ ID NO: 1223 - DNA, 33 bp, Artificial Sequence
  Synthetic Construct
gcccaacctaatagtgtgcgttctgttgcacag

SEQ ID NO: 1224 - DNA, 33 bp, Artificial Sequence
  Synthetic Construct
gcccaaaccagcagccacctcccccacgcacag

SEQ ID NO: 1225 - DNA, 33 bp, Artificial Sequence
  Synthetic Construct
gcccaagttcttcatggtggtaatgatgcacag

SEQ ID NO: 1226 - DNA, 33 bp, Artificial Sequence
  Synthetic Construct
gcccaaagcaactacgtcaaaagcgccgcacag

SEQ ID NO: 1227 - DNA, 33 bp, Artificial Sequence
  Synthetic Construct
gcccaagacaacaacagcaccagatgggcacag

SEQ ID NO: 1228 - DNA, 33 bp, Artificial Sequence
  Synthetic Construct
gcccaaactgtgatgaagggttttactgcacag

SEQ ID NO: 1229 - DNA, 33 bp, Artificial Sequence
  Synthetic Construct
gcccaaagccacaccctcagcaccctcgcacag

SEQ ID NO: 1230 - DNA, 33 bp, Artificial Sequence
  Synthetic Construct
gcccaacctggtcctcagcaggcgaaggcacag

SEQ ID NO: 1231 - DNA, 33 bp, Artificial Sequence
  Synthetic Construct
gcccaaacttttgggacgtctaagttggcacag

SEQ ID NO: 1232 - DNA, 33 bp, Artificial Sequence
  Synthetic Construct
gcccaaagcaacgccgtcaccaacagagcacag

SEQ ID NO: 1233 - DNA, 33 bp, Artificial Sequence
  Synthetic Construct
gcccaattgtctatgtcgacggtgcctgcacag

SEQ ID NO: 1234 - DNA, 33 bp, Artificial Sequence
  Synthetic Construct
gcccaaaggcgttatgatggtagggaggcacag

SEQ ID NO: 1235 - DNA, 33 bp, Artificial Sequence
  Synthetic Construct
gcccaaaccaacagcaccaaaaacatcgcacag

SEQ ID NO: 1236 - DNA, 33 bp, Artificial Sequence
  Synthetic Construct
gcccaaattaatgctcagtggtctgcggcacag

SEQ ID NO: 1237 - DNA, 33 bp, Artificial Sequence
  Synthetic Construct
gcccaagcccaaaccagcaacgaccccgcacag

SEQ ID NO: 1238 - DNA, 33 bp, Artificial Sequence
  Synthetic Construct
gcccaaacgaatgagactaggatggtggcacag

SEQ ID NO: 1239 - DNA, 33 bp, Artificial Sequence
  Synthetic Construct
gcccaagccaacgccaccagaggcgtcgcacag

SEQ ID NO: 1240 - DNA, 33 bp, Artificial Sequence
  Synthetic Construct
gcccaagcggatgtgaatgcttcgggtgcacag

SEQ ID NO: 1241 - DNA, 33 bp, Artificial Sequence
  Synthetic Construct
gcccaacttagtgagcggaattatgtggcacag

SEQ ID NO: 1242 - DNA, 33 bp, Artificial Sequence
  Synthetic Construct
gcccaaagtggtgagcttgcgcgggcggcacag

SEQ ID NO: 1243 - DNA, 33 bp, Artificial Sequence
  Synthetic Construct
gcccaagggaatactgctaagaatattgcacag

SEQ ID NO: 1244 - DNA, 33 bp, Artificial Sequence
  Synthetic Construct
gcccaagacaacgccgtcagacccctcgcacag

SEQ ID NO: 1245 - DNA, 33 bp, Artificial Sequence
  Synthetic Construct
gcccaaatgatgctcagcggcctcaacgcacag

SEQ ID NO: 1246 - DNA, 33 bp, Artificial Sequence
  Synthetic Construct
gcccaacccaacaccatcagaaacgtcgcacag

SEQ ID NO: 1247 - DNA, 33 bp, Artificial Sequence
  Synthetic Construct
gcccaagagaatttgacgcgtggggtggcacag

SEQ ID NO: 1248 - DNA, 33 bp, Artificial Sequence
  Synthetic Construct
gcccaatttagtgctcggagtacgggggcacag

SEQ ID NO: 1249 - DNA, 33 bp, Artificial Sequence
  Synthetic Construct
gcccaagaaaacgccaccagaacctacgcacag

SEQ ID NO: 1250 - DNA, 33 bp, Artificial Sequence
  Synthetic Construct
gcccaaggcaacagcaccagaatgaacgcacag

SEQ ID NO: 1251 - DNA, 33 bp, Artificial Sequence
  Synthetic Construct
gcccaagggaattctactaagtctcctgcacag

SEQ ID NO: 1252 - DNA, 33 bp, Artificial Sequence
  Synthetic Construct
gcccaaatgcaaaccaccctccacctcgcacag

SEQ ID NO: 1253 - DNA, 33 bp, Artificial Sequence
  Synthetic Construct
gcccaaaaccccaccctcatcaccctcgcacag

SEQ ID NO: 1254 - DNA, 33 bp, Artificial Sequence
  Synthetic Construct
gcccaacttatttctggtcatgcgcaggcacag

SEQ ID NO: 1255 - DNA, 33 bp, Artificial Sequence
  Synthetic Construct
gcccaattcaaccaagtcagaagcctcgcacag

SEQ ID NO: 1256 - DNA, 33 bp, Artificial Sequence
  Synthetic Construct
gcccaaatgaacatcctcagagaagtcgcacag

SEQ ID NO: 1257 - DNA, 33 bp, Artificial Sequence
  Synthetic Construct
gcccaaagtgctatgatgcgtggtgttgcacag

SEQ ID NO: 1258 - DNA, 33 bp, Artificial Sequence
  Synthetic Construct
gcccaacccatgctcagcagccccagcgcacag

SEQ ID NO: 1259 - DNA, 33 bp, Artificial Sequence
  Synthetic Construct
gcccaacagaataatacgcttaggtcggcacag

SEQ ID NO: 1260 - DNA, 33 bp, Artificial Sequence
  Synthetic Construct
gcccaaaggcattcggatccggtggaggcacag

SEQ ID NO: 1261 - DNA, 33 bp, Artificial Sequence
  Synthetic Construct
gcccaagtgaatacgacgttttctacggcacag

SEQ ID NO: 1262 - DNA, 33 bp, Artificial Sequence
  Synthetic Construct
gcccaaatcaacagcaccagaggcatcgcacag

SEQ ID NO: 1263 - DNA, 33 bp, Artificial Sequence
  Synthetic Construct
gcccaaaccaacgccgtcagagacctcgcacag

SEQ ID NO: 1264 - DNA, 33 bp, Artificial Sequence
  Synthetic Construct
gcccaatctaatagtactaggctgtcggcacag

SEQ ID NO: 1265 - DNA, 33 bp, Artificial Sequence
  Synthetic Construct
gcccaaacgtctattgctgggtcgtttgcacag

SEQ ID NO: 1266 - DNA, 33 bp, Artificial Sequence
  Synthetic Construct
gcccaactcggcagcacctaccccagagcacag

SEQ ID NO: 1267 - DNA, 33 bp, Artificial Sequence
  Synthetic Construct
gcccaagccaacgtcaccacccaaagagcacag

SEQ ID NO: 1268 - DNA, 33 bp, Artificial Sequence
  Synthetic Construct
gcccaaagcaacagcgtcagactcagcgcacag

SEQ ID NO: 1269 - DNA, 33 bp, Artificial Sequence
  Synthetic Construct
gcccaagctacgaatgagcctgatcgggcacag

SEQ ID NO: 1270 - DNA, 33 bp, Artificial Sequence
  Synthetic Construct
gcccaaagaatgaaccccgaacaaagcgcacag

SEQ ID NO: 1271 - DNA, 33 bp, Artificial Sequence
  Synthetic Construct
gcccaatcggttagtggttcggctaatgcacag

SEQ ID NO: 1272 - DNA, 33 bp, Artificial Sequence
  Synthetic Construct
gcccaaccgagtaatagtactacgcgtgcacag

SEQ ID NO: 1273 - DNA, 33 bp, Artificial Sequence
  Synthetic Construct
gcccaactttttcatggtacgcatgaggcacag

SEQ ID NO: 1274 - DNA, 33 bp, Artificial Sequence
  Synthetic Construct
gcccaaccccaactcggcagcaccaaagcacag

SEQ ID NO: 1275 - DNA, 33 bp, Artificial Sequence
  Synthetic Construct
gcccaacccatcagcgccaacagactcgcacag

SEQ ID NO: 1276 - DNA, 33 bp, Artificial Sequence
  Synthetic Construct
gcccaaaattcgggtaatctttctatggcacag

SEQ ID NO: 1277 - DNA, 33 bp, Artificial Sequence
  Synthetic Construct
gcccaaaaggttgaggctattgggatggcacag

SEQ ID NO: 1278 - DNA, 33 bp, Artificial Sequence
  Synthetic Construct
gcccaaaagactttgcttaatagtgttgcacag

SEQ ID NO: 1279 - DNA, 33 bp, Artificial Sequence
  Synthetic Construct
gcccaaaatgctatggatcttaaggtggcacag

SEQ ID NO: 1280 - DNA, 33 bp, Artificial Sequence
  Synthetic Construct
gcccaaatgatgggtaatgggtcttcggcacag

SEQ ID NO: 1281 - DNA, 33 bp, Artificial Sequence
  Synthetic Construct
gcccaaagcaacagcaccaaagccctcgcacag

SEQ ID NO: 1282 - DNA, 33 bp, Artificial Sequence
  Synthetic Construct
gcccaatctaatagtacgcggggtacggcacag

SEQ ID NO: 1283 - DNA, 33 bp, Artificial Sequence
  Synthetic Construct
gcccaaagcctcagcagcctccacgtcgcacag

SEQ ID NO: 1284 - DNA, 33 bp, Artificial Sequence
  Synthetic Construct
gcccaaaccctcagcggcgccctcaccgcacag

SEQ ID NO: 1285 - DNA, 33 bp, Artificial Sequence
  Synthetic Construct
gcccaaccgaatacggtgaggaataatgcacag

SEQ ID NO: 1286 - DNA, 33 bp, Artificial Sequence
  Synthetic Construct
gcccaaaataataatgtgaagatgactgcacag

SEQ ID NO: 1287 - DNA, 33 bp, Artificial Sequence
  Synthetic Construct
gcccaatctgttgctaagccttttatggcacag

SEQ ID NO: 1288 - DNA, 33 bp, Artificial Sequence
  Synthetic Construct
gcccaaacgcagacgactcggctttcggcacag

SEQ ID NO: 1289 - DNA, 33 bp, Artificial Sequence
  Synthetic Construct
gcccaaaataatgcgactcggggtggggcacag

SEQ ID NO: 1290 - DNA, 33 bp, Artificial Sequence
  Synthetic Construct
gcccaaaccaacaccaccgccagaatcgcacag

SEQ ID NO: 1291 - DNA, 33 bp, Artificial Sequence
  Synthetic Construct
gcccaagagaatagtattcggactattgcacag

SEQ ID NO: 1292 - DNA, 33 bp, Artificial Sequence
  Synthetic Construct
gcccaaattagggagacttctgggaaggcacag

SEQ ID NO: 1293 - DNA, 33 bp, Artificial Sequence
  Synthetic Construct
gcccaaagcatctactaccacaccgaagcacag

SEQ ID NO: 1294 - DNA, 33 bp, Artificial Sequence
  Synthetic Construct
gcccaagtcctcgacaacagcggccaagcacag

SEQ ID NO: 1295 - DNA, 33 bp, Artificial Sequence
  Synthetic Construct
gcccaaagccacaacatgaccatcagagcacag

SEQ ID NO: 1296 - DNA, 33 bp, Artificial Sequence
  Synthetic Construct
gcccaaaccatccccagcgccggcaaagcacag

SEQ ID NO: 1297 - DNA, 33 bp, Artificial Sequence
  Synthetic Construct
gccccacctaggcatactttgagtcaggcacag

SEQ ID NO: 1298 - DNA, 33 bp, Artificial Sequence
  Synthetic Construct
gcccaatcgcttaatgtgcaggatgtggcacag

SEQ ID NO: 1299 - DNA, 33 bp, Artificial Sequence
  Synthetic Construct
gcccaatatcagtctctggctaatccggcacag

SEQ ID NO: 1300 - DNA, 33 bp, Artificial Sequence
  Synthetic Construct
gcccaaattctgaatatgtctacggatgcacag

SEQ ID NO: 1301 - DNA, 33 bp, Artificial Sequence
  Synthetic Construct
gcccaagtcctccacctcggccacagcgcacag

SEQ ID NO: 1302 - DNA, 33 bp, Artificial Sequence
  Synthetic Construct
gcccaaggtgttactcagactccgcgtgcacag

SEQ ID NO: 1303 - DNA, 33 bp, Artificial Sequence
  Synthetic Construct
gcccaaaccaacgacaccagaagaatcgcacag

SEQ ID NO: 1304 - DNA, 33 bp, Artificial Sequence
  Synthetic Construct
gcccaacaaaccgaccacaccagcagagcacag

SEQ ID NO: 1305 - DNA, 33 bp, Artificial Sequence
  Synthetic Construct
gcccaaaagaatgagattaagaatgtggcacag

SEQ ID NO: 1306 - DNA, 33 bp, Artificial Sequence
  Synthetic Construct
gcccaatggactggtaatgagaggcttgcacag

SEQ ID NO: 1307 - DNA, 33 bp, Artificial Sequence
  Synthetic Construct
gcccaaggtaagagtgatgctatgcgggcacag

SEQ ID NO: 1308 - DNA, 33 bp, Artificial Sequence
  Synthetic Construct
gcccaagggaatgcgactcgtacttatgcacag

SEQ ID NO: 1309 - DNA, 33 bp, Artificial Sequence
  Synthetic Construct
gcccaagccagcaacctcggcctccccgcacag

SEQ ID NO: 1310 - DNA, 33 bp, Artificial Sequence
  Synthetic Construct
gcccaaagcagcctcagcggcagccccgcacag

SEQ ID NO: 1311 - DNA, 33 bp, Artificial Sequence
  Synthetic Construct
gcccaagccgccgtcaaccaaggcgtcgcacag

SEQ ID NO: 1312 - DNA, 33 bp, Artificial Sequence
  Synthetic Construct
gcccaagaccaaaaccaacccagagaagcacag

SEQ ID NO: 1313 - DNA, 33 bp, Artificial Sequence
  Synthetic Construct
gcccaactcacccaagacaaacaagccgcacag

SEQ ID NO: 1314 - DNA, 33 bp, Artificial Sequence
  Synthetic Construct
gcccaattcggcagcaacgaacacaacgcacag

SEQ ID NO: 1315 - DNA, 33 bp, Artificial Sequence
  Synthetic Construct
gcccaactgaatcagccgaatgtgcgggcacag

SEQ ID NO: 1316 - DNA, 33 bp, Artificial Sequence
  Synthetic Construct
gcccaaatgaatactacgcgtaatctggcacag

SEQ ID NO: 1317 - DNA, 33 bp, Artificial Sequence
  Synthetic Construct
gcccaaactaattctactaggacgagtgcacag

SEQ ID NO: 1318 - DNA, 33 bp, Artificial Sequence
  Synthetic Construct
gcccaatttgagctttcgcatgtgcctgcacag

SEQ ID NO: 1319 - DNA, 33 bp, Artificial Sequence
  Synthetic Construct
gcccaagaaggcctcggcaacgccgccgcacag

SEQ ID NO: 1320 - DNA, 33 bp, Artificial Sequence
  Synthetic Construct
gcccaactcaccgtcaccctcaaccacgcacag

SEQ ID NO: 1321 - DNA, 33 bp, Artificial Sequence
  Synthetic Construct
gcccaatttgggaatgcgattcagtctgcacag

SEQ ID NO: 1322 - DNA, 33 bp, Artificial Sequence
  Synthetic Construct
gcccaaccgggtgggggtttgactccggcacag

SEQ ID NO: 1323 - DNA, 33 bp, Artificial Sequence
  Synthetic Construct
gcccaacccaacatgaccagaagcctcgcacag

SEQ ID NO: 1324 - DNA, 33 bp, Artificial Sequence
  Synthetic Construct
gcccaaagtcagctgcataggttgcaggcacag

SEQ ID NO: 1325 - DNA, 33 bp, Artificial Sequence
  Synthetic Construct
gcccaaaatgatcctgtgctgactgtggcacag

SEQ ID NO: 1326 - DNA, 33 bp, Artificial Sequence
  Synthetic Construct
gcccaagaaaacagcgtcagaaccaccgcacag

SEQ ID NO: 1327 - DNA, 33 bp, Artificial Sequence
  Synthetic Construct
gcccaagatcgtgtgactaatccgaaggcacag

SEQ ID NO: 1328 - DNA, 33 bp, Artificial Sequence
  Synthetic Construct
gcccaactcaacaccggccaaatgagagcacag

SEQ ID NO: 1329 - DNA, 33 bp, Artificial Sequence
  Synthetic Construct
gcccaaattagtccttctcaggtgaaggcacag

SEQ ID NO: 1330 - DNA, 33 bp, Artificial Sequence
  Synthetic Construct
gcccaatacagcgccgacaaaaccaccgcacag

SEQ ID NO: 1331 - DNA, 33 bp, Artificial Sequence
  Synthetic Construct
gcccaaattgatagtgcggggatggcggcacag

SEQ ID NO: 1332 - DNA, 33 bp, Artificial Sequence
  Synthetic Construct
gcccaaagcaacaacatcaaactcaacgcacag

SEQ ID NO: 1333 - DNA, 33 bp, Artificial Sequence
  Synthetic Construct
gcccaacttgagacgcagcctaggactgcacag

SEQ ID NO: 1334 - DNA, 33 bp, Artificial Sequence
  Synthetic Construct
gcccaaaatttgcatagtaatgtgctggcacag

SEQ ID NO: 1335 - DNA, 33 bp, Artificial Sequence
  Synthetic Construct
gcccaaatggtcaaagacacccaactcgcacag

SEQ ID NO: 1336 - DNA, 33 bp, Artificial Sequence
  Synthetic Construct
gcccaactcatgcacctcaccaaccccgcacag

SEQ ID NO: 1337 - DNA, 33 bp, Artificial Sequence
  Synthetic Construct
gcccaagtcgccagccccgacaaaagagcacag

SEQ ID NO: 1338 - DNA, 33 bp, Artificial Sequence
  Synthetic Construct
gcccaagtcgtcgccgtcctcaccagcgcacag

SEQ ID NO: 1339 - DNA, 33 bp, Artificial Sequence
  Synthetic Construct
gcccaaaacatcatggtcaacgtccccgcacag

SEQ ID NO: 1340 - DNA, 33 bp, Artificial Sequence
  Synthetic Construct
gcccaaccgtatagtgggcagcggactgcacag

SEQ ID NO: 1341 - DNA, 33 bp, Artificial Sequence
  Synthetic Construct
gcccaacctctgcttaagacgaatactgcacag

SEQ ID NO: 1342 - DNA, 33 bp, Artificial Sequence
  Synthetic Construct
gcccaagggaatactacggtgcgtggggcacag

SEQ ID NO: 1343 - DNA, 33 bp, Artificial Sequence
  Synthetic Construct
gcccaaaccaacaaagtcagagacgacgcacag

SEQ ID NO: 1344 - DNA, 33 bp, Artificial Sequence
  Synthetic Construct
gcccaacccagcaccgccctcctcgtcgcacag

SEQ ID NO: 1345 - DNA, 33 bp, Artificial Sequence
  Synthetic Construct
gcccaaatccaaagcatcaccctcaaagcacag

SEQ ID NO: 1346 - DNA, 33 bp, Artificial Sequence
  Synthetic Construct
gcccaacccctccacgccaacatgagcgcacag

SEQ ID NO: 1347 - DNA, 33 bp, Artificial Sequence
  Synthetic Construct
gcccaaaccgcccacgccgaagccagagcacag

SEQ ID NO: 1348 - DNA, 33 bp, Artificial Sequence
  Synthetic Construct
gcccaaacgaatacggattcgtatcgtgcacag

SEQ ID NO: 1349 - DNA, 33 bp, Artificial Sequence
  Synthetic Construct
gcccaaacccacgtcagcctcgacagagcacag

SEQ ID NO: 1350 - DNA, 33 bp, Artificial Sequence
  Synthetic Construct
gcccaatttagtacgaaggatcatgttgcacag

SEQ ID NO: 1351 - DNA, 33 bp, Artificial Sequence
  Synthetic Construct
gcccaagacaacacccaaaccgcccccgcacag

SEQ ID NO: 1352 - DNA, 33 bp, Artificial Sequence
  Synthetic Construct
gcccaaagcaacagaatcatcagcggcgcacag

SEQ ID NO: 1353 - DNA, 33 bp, Artificial Sequence
  Synthetic Construct
gcccaaactaattctgttaggaataatgcacag

SEQ ID NO: 1354 - DNA, 33 bp, Artificial Sequence
  Synthetic Construct
gcccaaagcaacgaagtcagaaacatggcacag

SEQ ID NO: 1355 - DNA, 33 bp, Artificial Sequence
  Synthetic Construct
gcccaagaactctacaaacccagcagagcacag

SEQ ID NO: 1356 - DNA, 33 bp, Artificial Sequence
  Synthetic Construct
gcccaatggattacggggggtgcgagtgcacag

SEQ ID NO: 1357 - DNA, 33 bp, Artificial Sequence
  Synthetic Construct
gcccaaaacaacagcgtcagacccaccgcacag

SEQ ID NO: 1358 - DNA, 33 bp, Artificial Sequence
  Synthetic Construct
gcccaacacaccgccgtcctcagaaccgcacag

SEQ ID NO: 1359 - DNA, 33 bp, Artificial Sequence
  Synthetic Construct
gcccaaaatactttgtctcttgctcctgcacag

SEQ ID NO: 1360 - DNA, 33 bp, Artificial Sequence
  Synthetic Construct
gcccaacccaacgccagcgtcaacagcgcacag

SEQ ID NO: 1361 - DNA, 33 bp, Artificial Sequence
  Synthetic Construct
gcccaagttactggtgggaatacttatgcacag

SEQ ID NO: 1362 - DNA, 33 bp, Artificial Sequence
  Synthetic Construct
gcccaagtcaacgaaaacctcatcgaagcacag

SEQ ID NO: 1363 - DNA, 33 bp, Artificial Sequence
  Synthetic Construct
gcccaagttttgacgactcattcgaatgcacag

SEQ ID NO: 1364 - DNA, 33 bp, Artificial Sequence
  Synthetic Construct
gcccaacacacccaactccccctcaccgcacag

SEQ ID NO: 1365 - DNA, 33 bp, Artificial Sequence
  Synthetic Construct
gcccaacggcagtctcttgaggcgttggcacag

SEQ ID NO: 1366 - DNA, 33 bp, Artificial Sequence
  Synthetic Construct
gcccaacccgacgtcaccgaaggcagagcacag

SEQ ID NO: 1367 - DNA, 33 bp, Artificial Sequence
  Synthetic Construct
gcccaaccgactaatattatgcttgatgcacag

SEQ ID NO: 1368 - DNA, 33 bp, Artificial Sequence
  Synthetic Construct
gcccaacccaacatgagcgccatgatcgcacag

SEQ ID NO: 1369 - DNA, 33 bp, Artificial Sequence
  Synthetic Construct
gcccaaattatgaatggtcaggctctggcacag

SEQ ID NO: 1370 - DNA, 33 bp, Artificial Sequence
  Synthetic Construct
gcccaaaataataattcgacgcgttttgcacag

SEQ ID NO: 1371 - DNA, 33 bp, Artificial Sequence
  Synthetic Construct
gcccaagccaacgtcaccagaagcaccgcacag

SEQ ID NO: 1372 - DNA, 33 bp, Artificial Sequence
  Synthetic Construct
gcccaacagaatcttggtcttaatgtggcacag

SEQ ID NO: 1373 - DNA, 33 bp, Artificial Sequence
  Synthetic Construct
gcccaacaagcccaaatgagcagcgccgcacag

SEQ ID NO: 1374 - DNA, 33 bp, Artificial Sequence
  Synthetic Construct
gcccaactcaccatggccaccaacgtcgcacag

SEQ ID NO: 1375 - DNA, 33 bp, Artificial Sequence
  Synthetic Construct
gcccaagatcgtgattctgtgcagaatgcacag

SEQ ID NO: 1376 - DNA, 33 bp, Artificial Sequence
  Synthetic Construct
gcccaagtcaaccccaccaacaacctcgcacag

SEQ ID NO: 1377 - DNA, 33 bp, Artificial Sequence
  Synthetic Construct
gcccaaccgtcttttacgactatgagtgcacag

SEQ ID NO: 1378 - DNA, 33 bp, Artificial Sequence
  Synthetic Construct
gcccaaagggagacgcctattcctaaggcacag

SEQ ID NO: 1379 - DNA, 33 bp, Artificial Sequence
  Synthetic Construct
gcccaaagcctcaacttcaccaccgccgcacag

SEQ ID NO: 1380 - DNA, 33 bp, Artificial Sequence
  Synthetic Construct
gcccaaggtatgagtggggttgctcaggcacag

SEQ ID NO: 1381 - DNA, 33 bp, Artificial Sequence
  Synthetic Construct
gcccaaaaggttgatgcggctcagagtgcacag

SEQ ID NO: 1382 - DNA, 33 bp, Artificial Sequence
  Synthetic Construct
gcccaacatattacgactaatgtgtctgcacag

SEQ ID NO: 1383 - DNA, 33 bp, Artificial Sequence
  Synthetic Construct
gcccaagagcgggagtcggctcgtcttgcacag

SEQ ID NO: 1384 - DNA, 33 bp, Artificial Sequence
  Synthetic Construct
gcccaagataataggactcagaggacggcacag

SEQ ID NO: 1385 - DNA, 33 bp, Artificial Sequence
  Synthetic Construct
gcccaatctgcgcctaatgtgactattgcacag

SEQ ID NO: 1386 - DNA, 33 bp, Artificial Sequence
  Synthetic Construct
gcccaagaaaacggcaccagaaacaccgcacag

SEQ ID NO: 1387 - DNA, 33 bp, Artificial Sequence
  Synthetic Construct
gcccaaggcaccgccgtcttcaccgccgcacag

SEQ ID NO: 1388 - DNA, 33 bp, Artificial Sequence
  Synthetic Construct
gcccaagccaacaacatgagccaaaccgcacag

SEQ ID NO: 1389 - DNA, 33 bp, Artificial Sequence
  Synthetic Construct
gcccaaggtaatcatacttataatctggcacag

SEQ ID NO: 1390 - DNA, 33 bp, Artificial Sequence
  Synthetic Construct
gcccaactgagtccttcgaattctaatgcacag

SEQ ID NO: 1391 - DNA, 33 bp, Artificial Sequence
  Synthetic Construct
gcccaaatgggcgccgaccacagaaccgcacag

SEQ ID NO: 1392 - DNA, 33 bp, Artificial Sequence
  Synthetic Construct
gcccaaagtaattcgacgcgtggttctgcacag

SEQ ID NO: 1393 - DNA, 33 bp, Artificial Sequence
  Synthetic Construct
gcccaaaatacttctggtgtgcctaaggcacag

SEQ ID NO: 1394 - DNA, 33 bp, Artificial Sequence
  Synthetic Construct
gcccaaatcaacaccgccgtcgtcagcgcacag

SEQ ID NO: 1395 - DNA, 33 bp, Artificial Sequence
  Synthetic Construct
gcccaaatgggggttcaggcttatgtggcacag

SEQ ID NO: 1396 - DNA, 33 bp, Artificial Sequence
  Synthetic Construct
gcccaagggaattttgttaagccgaatgcacag

SEQ ID NO: 1397 - DNA, 33 bp, Artificial Sequence
  Synthetic Construct
gcccaagtgaattcggtgaggatgattgcacag

SEQ ID NO: 1398 - DNA, 33 bp, Artificial Sequence
  Synthetic Construct
gcccaacacgacagcgccaacagcagagcacag

SEQ ID NO: 1399 - DNA, 33 bp, Artificial Sequence
  Synthetic Construct
gcccaactcggcgtcagagacgacagcgcacag

SEQ ID NO: 1400 - DNA, 33 bp, Artificial Sequence
  Synthetic Construct
gcccaaagcaacgccgtcagagccaacgcacag

SEQ ID NO: 1401 - DNA, 33 bp, Artificial Sequence
  Synthetic Construct
gcccaacccgtcctcgccgccaccatggcacag

SEQ ID NO: 1402 - DNA, 33 bp, Artificial Sequence
  Synthetic Construct
gcccaaaataagcctgtgtctggtaatgcacag

SEQ ID NO: 1403 - DNA, 33 bp, Artificial Sequence
  Synthetic Construct
gcccaagtcggcctcgccagccacaccgcacag

SEQ ID NO: 1404 - DNA, 33 bp, Artificial Sequence
  Synthetic Construct
gcccaaggcagcaacaccaacatgaaagcacag

SEQ ID NO: 1405 - DNA, 33 bp, Artificial Sequence
  Synthetic Construct
gcccaagttgctactactgtgcataatgcacag

SEQ ID NO: 1406 - DNA, 33 bp, Artificial Sequence
  Synthetic Construct
gcccaaaacaccctcgacagcagagtcgcacag

SEQ ID NO: 1407 - DNA, 33 bp, Artificial Sequence
  Synthetic Construct
gcccaaagggaggctaatttgcaggcggcacag

SEQ ID NO: 1408 - DNA, 33 bp, Artificial Sequence
  Synthetic Construct
gcccaagtcgacgccctcagccacatggcacag

SEQ ID NO: 1409 - DNA, 33 bp, Artificial Sequence
  Synthetic Construct
gcccaacttcgtcttgctggtcttgctgcacag

SEQ ID NO: 1410 - DNA, 33 bp, Artificial Sequence
  Synthetic Construct
gcccaaattacggtgactaattattcggcacag

SEQ ID NO: 1411 - DNA, 33 bp, Artificial Sequence
  Synthetic Construct
gcccaatgggacagcggcagcggcgaagcacag

SEQ ID NO: 1412 - DNA, 33 bp, Artificial Sequence
  Synthetic Construct
gcccaattcgccagcgaaaccgtcgccgcacag

SEQ ID NO: 1413 - DNA, 33 bp, Artificial Sequence
  Synthetic Construct
gcccaacagaatgttacggggacgagggcacag

SEQ ID NO: 1414 - DNA, 33 bp, Artificial Sequence
  Synthetic Construct
gcccaacttaatgggttgaatgtgtctgcacag

SEQ ID NO: 1415 - DNA, 33 bp, Artificial Sequence
  Synthetic Construct
gcccaaaatatgcttaagcagagtgaggcacag

SEQ ID NO: 1416 - DNA, 33 bp, Artificial Sequence
  Synthetic Construct
gcccaatttaatgaggttccgaaggcggcacag

SEQ ID NO: 1417 - DNA, 33 bp, Artificial Sequence
  Synthetic Construct
gcccaactcggcgacatcaccggcttcgcacag

SEQ ID NO: 1418 - DNA, 33 bp, Artificial Sequence
  Synthetic Construct
gcccaaatttcggcttctcattctcgtgcacag

SEQ ID NO: 1419 - DNA, 33 bp, Artificial Sequence
  Synthetic Construct
gcccaaagtcagacgcagattgctcttgcacag

SEQ ID NO: 1420 - DNA, 33 bp, Artificial Sequence
  Synthetic Construct
gcccaaaatatggctactcagatgaaggcacag

SEQ ID NO: 1421 - DNA, 33 bp, Artificial Sequence
  Synthetic Construct
gcccaagtcaaccacaacatcagactcgcacag

SEQ ID NO: 1422 - DNA, 33 bp, Artificial Sequence
  Synthetic Construct
gcccaaaacgccctccaagtccccgtcgcacag

SEQ ID NO: 1423 - DNA, 33 bp, Artificial Sequence
  Synthetic Construct
gcccaaaattcgacgggtattgatacggcacag

SEQ ID NO: 1424 - DNA, 33 bp, Artificial Sequence
  Synthetic Construct
gcccaagttgttgctgggcatcttaatgcacag

SEQ ID NO: 1425 - DNA, 33 bp, Artificial Sequence
  Synthetic Construct
gcccaacggaatgatgcgattctgaatgcacag

SEQ ID NO: 1426 - DNA, 33 bp, Artificial Sequence
  Synthetic Construct
gcccaaaatcgggttgattcgcgggctgcacag

SEQ ID NO: 1427 - DNA, 33 bp, Artificial Sequence
  Synthetic Construct
gcccaatcgacgcattctacttatgtggcacag

SEQ ID NO: 1428 - DNA, 33 bp, Artificial Sequence
  Synthetic Construct
gcccaaagtgggcatgggactctgcgggcacag

SEQ ID NO: 1429 - DNA, 33 bp, Artificial Sequence
  Synthetic Construct
gcccaacccaacagcaccaccctcagcgcacag

SEQ ID NO: 1430 - DNA, 33 bp, Artificial Sequence
  Synthetic Construct
gcccaagacaccaaacccaccaacaccgcacag

SEQ ID NO: 1431 - DNA, 33 bp, Artificial Sequence
  Synthetic Construct
gcccaaaacagagacaccatcaacaacgcacag

SEQ ID NO: 1432 - DNA, 33 bp, Artificial Sequence
  Synthetic Construct
gcccaacccagaaccctcagcgacggcgcacag

SEQ ID NO: 1433 - DNA, 33 bp, Artificial Sequence
  Synthetic Construct
gcccaaaccaaagacgtcaccaccagcgcacag

SEQ ID NO: 1434 - DNA, 33 bp, Artificial Sequence
  Synthetic Construct
gcccaactgggtaatcctacgccttctgcacag

SEQ ID NO: 1435 - DNA, 33 bp, Artificial Sequence
  Synthetic Construct
gcccaatatcaggcgatgtatagggatgcacag

SEQ ID NO: 1436 - DNA, 33 bp, Artificial Sequence
  Synthetic Construct
gcccaaagcggcgtccaagaattcgacgcacag

SEQ ID NO: 1437 - DNA, 33 bp, Artificial Sequence
  Synthetic Construct
gcccaatctaatcatctgtcgacggttgcacag

SEQ ID NO: 1438 - DNA, 33 bp, Artificial Sequence
  Synthetic Construct
gcccaacacgacgaaagagccaacatggcacag

SEQ ID NO: 1439 - DNA, 33 bp, Artificial Sequence
  Synthetic Construct
gcccaaacgaatagtactcggtcgcctgcacag

SEQ ID NO: 1440 - DNA, 33 bp, Artificial Sequence
  Synthetic Construct
gcccaaccgacggataagtcttatccggcacag

SEQ ID NO: 1441 - DNA, 33 bp, Artificial Sequence
  Synthetic Construct
gcccaaatgaccgaacaaagaaccgccgcacag

SEQ ID NO: 1442 - DNA, 33 bp, Artificial Sequence
  Synthetic Construct
gcccaaaccaacgccacccacagcaaagcacag

SEQ ID NO: 1443 - DNA, 33 bp, Artificial Sequence
  Synthetic Construct
gcccaaaatcggggtacttttagtgcggcacag

SEQ ID NO: 1444 - DNA, 33 bp, Artificial Sequence
  Synthetic Construct
gcccaaaacaccaccaaattcaacaccgcacag

SEQ ID NO: 1445 - DNA, 33 bp, Artificial Sequence
  Synthetic Construct
gcccaagggattccgcctttgactaaggcacag

SEQ ID NO: 1446 - DNA, 33 bp, Artificial Sequence
  Synthetic Construct
gcccaaaccgccaacagcacccaaagagcacag

SEQ ID NO: 1447 - DNA, 33 bp, Artificial Sequence
  Synthetic Construct
gcccaaactcagggtccgggtccgaaggcacag

SEQ ID NO: 1448 - DNA, 33 bp, Artificial Sequence
  Synthetic Construct
gcccaaatgaatactacgcggaattatgcacag

SEQ ID NO: 1449 - DNA, 33 bp, Artificial Sequence
  Synthetic Construct
gcccaactcagagaaggcaccttcatggcacag

SEQ ID NO: 1450 - DNA, 33 bp, Artificial Sequence
  Synthetic Construct
gcccaaaacatcagcagcaccgacagagcacag

SEQ ID NO: 1451 - DNA, 33 bp, Artificial Sequence
  Synthetic Construct
gcccaatcggttagtcggccgtttcaggcacag

SEQ ID NO: 1452 - DNA, 33 bp, Artificial Sequence
  Synthetic Construct
gcccaacctatgtctgctaatgggaaggcacag

SEQ ID NO: 1453 - DNA, 33 bp, Artificial Sequence
  Synthetic Construct
gcccaagaagtcagaggcaacaccttcgcacag

SEQ ID NO: 1454 - DNA, 33 bp, Artificial Sequence
  Synthetic Construct
gcccaatcgcagaagggtctgtctgtggcacag

SEQ ID NO: 1455 - DNA, 33 bp, Artificial Sequence
  Synthetic Construct
gcccaaattgctgagaatctgagtgctgcacag

SEQ ID NO: 1456 - DNA, 33 bp, Artificial Sequence
  Synthetic Construct
gcccaattcagcaacatgaacctcaaagcacag

SEQ ID NO: 1457 - DNA, 33 bp, Artificial Sequence
  Synthetic Construct
gcccaacctcgtgagcggacttatactgcacag

SEQ ID NO: 1458 - DNA, 33 bp, Artificial Sequence
  Synthetic Construct
gcccaatggtcgcataatccggattctgcacag

SEQ ID NO: 1459 - DNA, 33 bp, Artificial Sequence
  Synthetic Construct
gcccaaggtcttcagactctgattacggcacag

SEQ ID NO: 1460 - DNA, 33 bp, Artificial Sequence
  Synthetic Construct
gcccaaagcaacagaaccaaagacatcgcacag

SEQ ID NO: 1461 - DNA, 33 bp, Artificial Sequence
  Synthetic Construct
gcccaagtgactgagacgattcttaaggcacag

SEQ ID NO: 1462 - DNA, 33 bp, Artificial Sequence
  Synthetic Construct
gcccaatatgttacgcgtagtggtctggcacag

SEQ ID NO: 1463 - DNA, 33 bp, Artificial Sequence
  Synthetic Construct
gcccaaatgaacgccaacatcctcgtcgcacag

SEQ ID NO: 1464 - DNA, 33 bp, Artificial Sequence
  Synthetic Construct
gcccaaactacgaatcgggtgggtacggcacag

SEQ ID NO: 1465 - DNA, 33 bp, Artificial Sequence
  Synthetic Construct
gcccaagtcctcaaaagccacctccaagcacag

SEQ ID NO: 1466 - DNA, 33 bp, Artificial Sequence
  Synthetic Construct
gcccaaagcgacggcctcagaacccaagcacag

SEQ ID NO: 1467 - DNA, 33 bp, Artificial Sequence
  Synthetic Construct
gcccaactcaacagcgtcaaacccaacgcacag

SEQ ID NO: 1468 - DNA, 33 bp, Artificial Sequence
  Synthetic Construct
gcccaaagccaagccatcgcccccaaagcacag

SEQ ID NO: 1469 - DNA, 33 bp, Artificial Sequence
  Synthetic Construct
gcccaatctaataatgttcgtgctccggcacag

SEQ ID NO: 1470 - DNA, 33 bp, Artificial Sequence
  Synthetic Construct
gcccaaatcagccacctcagcgaaagcgcacag

SEQ ID NO: 1471 - DNA, 33 bp, Artificial Sequence
  Synthetic Construct
gcccaactcctccccggcatgagattcgcacag

SEQ ID NO: 1472 - DNA, 33 bp, Artificial Sequence
  Synthetic Construct
gcccaacttcttgcgtcggctacgaaggcacag

SEQ ID NO: 1473 - DNA, 33 bp, Artificial Sequence
  Synthetic Construct
gcccaaaaccacaacggcatggtcagcgcacag

SEQ ID NO: 1474 - DNA, 33 bp, Artificial Sequence
  Synthetic Construct
gcccaacacagcggcgaactcaacaacgcacag

SEQ ID NO: 1475 - DNA, 33 bp, Artificial Sequence
  Synthetic Construct
gcccaactttctgcgcctaaggatactgcacag

SEQ ID NO: 1476 - DNA, 33 bp, Artificial Sequence
  Synthetic Construct
gcccaaattgggactcatgtggggacggcacag

SEQ ID NO: 1477 - DNA, 33 bp, Artificial Sequence
  Synthetic Construct
gcccaagccgtcgccctcgccagcgccgcacag

SEQ ID NO: 1478 - DNA, 33 bp, Artificial Sequence
  Synthetic Construct
gcccaaattactcttcagtctaatgctgcacag

SEQ ID NO: 1479 - DNA, 33 bp, Artificial Sequence
  Synthetic Construct
gcccaagtcgaccacagcctcaccagcgcacag

SEQ ID NO: 1480 - DNA, 33 bp, Artificial Sequence
  Synthetic Construct
gcccaaggcaacgaagccaccagcctcgcacag

SEQ ID NO: 1481 - DNA, 33 bp, Artificial Sequence
  Synthetic Construct
gcccaacccgtcagcagcaccaccctcgcacag

SEQ ID NO: 1482 - DNA, 33 bp, Artificial Sequence
  Synthetic Construct
gcccaaccctaccaaaccagcagcgccgcacag

SEQ ID NO: 1483 - DNA, 33 bp, Artificial Sequence
  Synthetic Construct
gcccaaaccagcgtcgtcagcgccttcgcacag

SEQ ID NO: 1484 - DNA, 33 bp, Artificial Sequence
  Synthetic Construct
gcccaaaacggcgtccccgacaacaacgcacag

SEQ ID NO: 1485 - DNA, 33 bp, Artificial Sequence
  Synthetic Construct
gcccaaagcacccaaaccatcggcttcgcacag

SEQ ID NO: 1486 - DNA, 33 bp, Artificial Sequence
  Synthetic Construct
gcccaaattcggagttctgatcttgcggcacag

SEQ ID NO: 1487 - DNA, 33 bp, Artificial Sequence
  Synthetic Construct
gcccaaaacacccaaagcgccaaatacgcacag

SEQ ID NO: 1488 - DNA, 33 bp, Artificial Sequence
  Synthetic Construct
gcccaaagtcttgagtcgtctaggcaggcacag

SEQ ID NO: 1489 - DNA, 33 bp, Artificial Sequence
  Synthetic Construct
gcccaactcaacctcgccagcggcagagcacag

SEQ ID NO: 1490 - DNA, 33 bp, Artificial Sequence
  Synthetic Construct
gcccaaatgcaggagcgtcgggagtatgcacag

SEQ ID NO: 1491 - DNA, 33 bp, Artificial Sequence
  Synthetic Construct
gcccaatggctcctcaaagacggctacgcacag

SEQ ID NO: 1492 - DNA, 33 bp, Artificial Sequence
  Synthetic Construct
gcccaaggcagataccaaaccaccagcgcacag

SEQ ID NO: 1493 - DNA, 33 bp, Artificial Sequence
  Synthetic Construct
gcccaaaatacgacgaagtttccgtttgcacag

SEQ ID NO: 1494 - DNA, 33 bp, Artificial Sequence
  Synthetic Construct
gcccaaatgagcaacggcatcagcagagcacag

SEQ ID NO: 1495 - DNA, 33 bp, Artificial Sequence
  Synthetic Construct
gcccaaccgattcgggatccggagaaggcacag

SEQ ID NO: 1496 - DNA, 33 bp, Artificial Sequence
  Synthetic Construct
gcccaaagtacgctgagtccgcatgttgcacag

SEQ ID NO: 1497 - DNA, 33 bp, Artificial Sequence
  Synthetic Construct
gcccaattcatgcccatcagcagcgccgcacag

SEQ ID NO: 1498 - DNA, 33 bp, Artificial Sequence
  Synthetic Construct
gcccaaagaagcgacacccaaagcagcgcacag

SEQ ID NO: 1499 - DNA, 33 bp, Artificial Sequence
  Synthetic Construct
gcccaagataatcatgttatggctcgtgcacag

SEQ ID NO: 1500 - DNA, 33 bp, Artificial Sequence
  Synthetic Construct
gcccaaaatctgtcttctaagagttgggcacag

SEQ ID NO: 1501 - DNA, 33 bp, Artificial Sequence
  Synthetic Construct
gcccaatctacgattctgaaggatactgcacag

SEQ ID NO: 1502 - DNA, 33 bp, Artificial Sequence
  Synthetic Construct
gcccaacctactcatcagtctaagccggcacag

SEQ ID NO: 1503 - DNA, 33 bp, Artificial Sequence
  Synthetic Construct
gcccaaacggaggtgactcagaataaggcacag

SEQ ID NO: 1504 - DNA, 33 bp, Artificial Sequence
  Synthetic Construct
gcccaacacctcgacagcaacggcagcgcacag

SEQ ID NO: 1505 - DNA, 33 bp, Artificial Sequence
  Synthetic Construct
gcccaaaatactgattctcgtgtgggggcacag

SEQ ID NO: 1506 - DNA, 33 bp, Artificial Sequence
  Synthetic Construct
gcccaaagcatgggcctcaaagaaaaagcacag

SEQ ID NO: 1507 - DNA, 33 bp, Artificial Sequence
  Synthetic Construct
gcccaattgagtacgtcgtatactcgggcacag

SEQ ID NO: 1508 - DNA, 33 bp, Artificial Sequence
  Synthetic Construct
gcccaatctgggatgagtaataatcatgcacag

SEQ ID NO: 1509 - DNA, 33 bp, Artificial Sequence
  Synthetic Construct
gcccaaaccaactacgacctcagagccgcacag

SEQ ID NO: 1510 - DNA, 33 bp, Artificial Sequence
  Synthetic Construct
gcccaaaccccccaaagccaagaaatggcacag

SEQ ID NO: 1511 - DNA, 33 bp, Artificial Sequence
  Synthetic Construct
gcccaaaatagtaatatggttacgcctgcacag

SEQ ID NO: 1512 - DNA, 33 bp, Artificial Sequence
  Synthetic Construct
gcccaatcggctgttccgaatgttaaggcacag

SEQ ID NO: 1513 - DNA, 33 bp, Artificial Sequence
  Synthetic Construct
gcccaagtcctcgtcgccggcagcagagcacag

SEQ ID NO: 1514 - DNA, 33 bp, Artificial Sequence
  Synthetic Construct
gcccaaggcaacaacagcagaaacatggcacag

SEQ ID NO: 1515 - DNA, 33 bp, Artificial Sequence
  Synthetic Construct
gcccaaatgcctaggggtcatgtttcggcacag

SEQ ID NO: 1516 - DNA, 33 bp, Artificial Sequence
  Synthetic Construct
gcccaatggagccacagcgaaaacagcgcacag

SEQ ID NO: 1517 - DNA, 33 bp, Artificial Sequence
  Synthetic Construct
gcccaatttgagaaggatcctgtggctgcacag

SEQ ID NO: 1518 - DNA, 33 bp, Artificial Sequence
  Synthetic Construct
gcccaaattactcaggctactcctagtgcacag

SEQ ID NO: 1519 - DNA, 33 bp, Artificial Sequence
  Synthetic Construct
gcccaagccaacctcagccacctccacgcacag

SEQ ID NO: 1520 - DNA, 33 bp, Artificial Sequence
  Synthetic Construct
gcccaaggcatcaccaacagcaccatcgcacag

SEQ ID NO: 1521 - DNA, 33 bp, Artificial Sequence
  Synthetic Construct
gcccaaccgtctcagcagcctactagggcacag

SEQ ID NO: 1522 - DNA, 33 bp, Artificial Sequence
  Synthetic Construct
gcccaacagcagacgcatgaggatattgcacag

SEQ ID NO: 1523 - DNA, 33 bp, Artificial Sequence
  Synthetic Construct
gcccaacaggttaatgtgtctccggatgcacag

SEQ ID NO: 1524 - DNA, 33 bp, Artificial Sequence
  Synthetic Construct
gcccaaaaagccgtcgtcacccaaaccgcacag

SEQ ID NO: 1525 - DNA, 33 bp, Artificial Sequence
  Synthetic Construct
gcccaaaatactgtgaggtcgtcgactgcacag

SEQ ID NO: 1526 - DNA, 33 bp, Artificial Sequence
  Synthetic Construct
gcccaaaacgccagcagccacctcctcgcacag

SEQ ID NO: 1527 - DNA, 33 bp, Artificial Sequence
  Synthetic Construct
gcccaatacatcaaagacagcacccccgcacag

SEQ ID NO: 1528 - DNA, 33 bp, Artificial Sequence
  Synthetic Construct
gcccaaagcagcgaaagcaccaacctcgcacag

SEQ ID NO: 1529 - DNA, 33 bp, Artificial Sequence
  Synthetic Construct
gcccaaaaagaaaacgtcgaaggcaacgcacag

SEQ ID NO: 1530 - DNA, 33 bp, Artificial Sequence
  Synthetic Construct
gcccaaaacaacgtcctcggcacccccgcacag

SEQ ID NO: 1531 - DNA, 33 bp, Artificial Sequence
  Synthetic Construct
gcccaacagaatgttagtattttggatgcacag

SEQ ID NO: 1532 - DNA, 33 bp, Artificial Sequence
  Synthetic Construct
gcccaacctctgaattctgagaataatgcacag

SEQ ID NO: 1533 - DNA, 33 bp, Artificial Sequence
  Synthetic Construct
gcccaaacgattaatctggttgggtatgcacag

SEQ ID NO: 1534 - DNA, 33 bp, Artificial Sequence
  Synthetic Construct
gcccaaccggcgttggctgctcaggctgcacag

SEQ ID NO: 1535 - DNA, 33 bp, Artificial Sequence
  Synthetic Construct
gcccaaactttgcagaattcgattacggcacag

SEQ ID NO: 1536 - DNA, 33 bp, Artificial Sequence
  Synthetic Construct
gcccaattgggtgggacggatggtcatgcacag

SEQ ID NO: 1537 - DNA, 33 bp, Artificial Sequence
  Synthetic Construct
gcccaagccggccccatcaacaacaccgcacag

SEQ ID NO: 1538 - DNA, 33 bp, Artificial Sequence
  Synthetic Construct
gcccaacatgttcttacgcagtcggttgcacag

SEQ ID NO: 1539 - DNA, 33 bp, Artificial Sequence
  Synthetic Construct
gcccaaaccaccatccccagccaccaagcacag

SEQ ID NO: 1540 - DNA, 33 bp, Artificial Sequence
  Synthetic Construct
gcccaacacgacggcctcctcagcagagcacag

SEQ ID NO: 1541 - DNA, 33 bp, Artificial Sequence
  Synthetic Construct
gcccaaagcatccacaccggcctcaccgcacag

SEQ ID NO: 1542 - DNA, 33 bp, Artificial Sequence
  Synthetic Construct
gcccaagggaatatgactaagtttactgcacag

SEQ ID NO: 1543 - DNA, 33 bp, Artificial Sequence
  Synthetic Construct
gcccaatatgctttgagtactgatacggcacag

SEQ ID NO: 1544 - DNA, 33 bp, Artificial Sequence
  Synthetic Construct
gcccaaacccaagccgacaacctcaaagcacag

SEQ ID NO: 1545 - DNA, 33 bp, Artificial Sequence
  Synthetic Construct
gcccaatggtacaaaaccctcgacgccgcacag

SEQ ID NO: 1546 - DNA, 33 bp, Artificial Sequence
  Synthetic Construct
gcccaaccccaatacgccaaaatcagcgcacag

SEQ ID NO: 1547 - DNA, 33 bp, Artificial Sequence
  Synthetic Construct
gcccaactcgccaccgacaacaaaagcgcacag

SEQ ID NO: 1548 - DNA, 33 bp, Artificial Sequence
  Synthetic Construct
gcccaactcagcgtcgtcatcaccagcgcacag

SEQ ID NO: 1549 - DNA, 33 bp, Artificial Sequence
  Synthetic Construct
gcccaaaatgtgccgacttcgccgcgggcacag

SEQ ID NO: 1550 - DNA, 33 bp, Artificial Sequence
  Synthetic Construct
gcccaagccagacccgacctcaaactcgcacag

SEQ ID NO: 1551 - DNA, 33 bp, Artificial Sequence
  Synthetic Construct
gcccaaagcgccctcgccaacaccctcgcacag

SEQ ID NO: 1552 - DNA, 33 bp, Artificial Sequence
  Synthetic Construct
gcccaactcatggacttcagcaaccccgcacag

SEQ ID NO: 1553 - DNA, 33 bp, Artificial Sequence
  Synthetic Construct
gcccaacctcggacggagttgattagtgcacag

SEQ ID NO: 1554 - DNA, 33 bp, Artificial Sequence
  Synthetic Construct
gcccaaaccagcgacatcaaaagcaaagcacag

SEQ ID NO: 1555 - DNA, 33 bp, Artificial Sequence
  Synthetic Construct
gcccaaagcaacgccaccatgagattcgcacag

SEQ ID NO: 1556 - DNA, 33 bp, Artificial Sequence
  Synthetic Construct
gcccaagtccaaagccccgccctccaagcacag

SEQ ID NO: 1557 - DNA, 33 bp, Artificial Sequence
  Synthetic Construct
gcccaaaccgccaacaccaccagcagagcacag

SEQ ID NO: 1558 - DNA, 33 bp, Artificial Sequence
  Synthetic Construct
gcccaacaacacatgaccagccaaatcgcacag

SEQ ID NO: 1559 - DNA, 33 bp, Artificial Sequence
  Synthetic Construct
gcccaaagtaatatgtcgttgagtagtgcacag

SEQ ID NO: 1560 - DNA, 33 bp, Artificial Sequence
  Synthetic Construct
gcccaaattacggggattccgacgtcggcacag

SEQ ID NO: 1561 - DNA, 33 bp, Artificial Sequence
  Synthetic Construct
gcccaatttactaataatgtgagggatgcacag

SEQ ID NO: 1562 - DNA, 33 bp, Artificial Sequence
  Synthetic Construct
gcccaaaacagcaacgccggcggcaaagcacag

SEQ ID NO: 1563 - DNA, 33 bp, Artificial Sequence
  Synthetic Construct
gcccaatacaacaccgacatcaccaaagcacag

SEQ ID NO: 1564 - DNA, 33 bp, Artificial Sequence
  Synthetic Construct
gcccaattttcgaatccggataagatggcacag

SEQ ID NO: 1565 - DNA, 33 bp, Artificial Sequence
  Synthetic Construct
gcccaactcatgaccaccagcaccatcgcacag

SEQ ID NO: 1566 - DNA, 33 bp, Artificial Sequence
  Synthetic Construct
gcccaaacgaatagtactcttaggcaggcacag

SEQ ID NO: 1567 - DNA, 33 bp, Artificial Sequence
  Synthetic Construct
gcccaatcgaattatactaagattattgcacag

SEQ ID NO: 1568 - DNA, 33 bp, Artificial Sequence
  Synthetic Construct
gcccaatctgctgggcttatttcttcggcacag

SEQ ID NO: 1569 - DNA, 33 bp, Artificial Sequence
  Synthetic Construct
gcccaaaagcagggtccgatgctgtctgcacag

SEQ ID NO: 1570 - DNA, 33 bp, Artificial Sequence
  Synthetic Construct
gcccaagtgaggactccgggtgtgcaggcacag

SEQ ID NO: 1571 - DNA, 33 bp, Artificial Sequence
  Synthetic Construct
gcccaaactcctgatcatcgggagcgggcacag

SEQ ID NO: 1572 - DNA, 33 bp, Artificial Sequence
  Synthetic Construct
gcccaaatgaatgctactgttccttctgcacag

SEQ ID NO: 1573 - DNA, 33 bp, Artificial Sequence
  Synthetic Construct
gcccaactccacagcatgctcgcccccgcacag

SEQ ID NO: 1574 - DNA, 33 bp, Artificial Sequence
  Synthetic Construct
gcccaagacatgcaccacagccaacccgcacag

SEQ ID NO: 1575 - DNA, 33 bp, Artificial Sequence
  Synthetic Construct
gcccaaaaacccctccccaccacctacgcacag

SEQ ID NO: 1576 - DNA, 33 bp, Artificial Sequence
  Synthetic Construct
gcccaagccatgcaagtcaccctcagcgcacag

SEQ ID NO: 1577 - DNA, 33 bp, Artificial Sequence
  Synthetic Construct
gcccaaagccccacccacgacgccagagcacag

SEQ ID NO: 1578 - DNA, 33 bp, Artificial Sequence
  Synthetic Construct
gcccaagcgctttctgttaaggagcttgcacag

SEQ ID NO: 1579 - DNA, 33 bp, Artificial Sequence
  Synthetic Construct
gcccaaccgtctcgtgtgccgactcaggcacag

SEQ ID NO: 1580 - DNA, 33 bp, Artificial Sequence
  Synthetic Construct
gcccaaggcagcctcggcctcggcaaagcacag

SEQ ID NO: 1581 - DNA, 33 bp, Artificial Sequence
  Synthetic Construct
gcccaacatagttcgtattcgtcgaaggcacag

SEQ ID NO: 1582 - DNA, 33 bp, Artificial Sequence
  Synthetic Construct
gcccaaccgaatcctagtaatccttctgcacag

SEQ ID NO: 1583 - DNA, 33 bp, Artificial Sequence
  Synthetic Construct
gcccaaactaagaatggtgttgcgcaggcacag

SEQ ID NO: 1584 - DNA, 33 bp, Artificial Sequence
  Synthetic Construct
gcccaaggtagtacgagtagtgcttatgcacag

SEQ ID NO: 1585 - DNA, 33 bp, Artificial Sequence
  Synthetic Construct
gcccaaagaagcacccacgaaaacaccgcacag

SEQ ID NO: 1586 - DNA, 33 bp, Artificial Sequence
  Synthetic Construct
gcccaatctggtcatgatcgtgatgctgcacag

SEQ ID NO: 1587 - DNA, 33 bp, Artificial Sequence
  Synthetic Construct
gcccaaaatactcagtcttatactagtgcacag

SEQ ID NO: 1588 - DNA, 33 bp, Artificial Sequence
  Synthetic Construct
gcccaagatcgtgttccgcatttgcgggcacag

SEQ ID NO: 1589 - DNA, 33 bp, Artificial Sequence
  Synthetic Construct
gcccaaaataatccgcctcatatgcgggcacag

SEQ ID NO: 1590 - DNA, 33 bp, Artificial Sequence
  Synthetic Construct
gcccaaagaagcctccaaagccaattcgcacag

SEQ ID NO: 1591 - DNA, 33 bp, Artificial Sequence
  Synthetic Construct
gcccaaattcgtgatgatcggtctttggcacag

SEQ ID NO: 1592 - DNA, 33 bp, Artificial Sequence
  Synthetic Construct
gcccaaatgttgtctgctccgctgccggcacag

SEQ ID NO: 1593 - DNA, 33 bp, Artificial Sequence
  Synthetic Construct
gcccaaacttcgagtattttgactacggcacag

SEQ ID NO: 1594 - DNA, 33 bp, Artificial Sequence
  Synthetic Construct
gcccaacgtgagcagatgaatcttgtggcacag

SEQ ID NO: 1595 - DNA, 33 bp, Artificial Sequence
  Synthetic Construct
gcccaaaagacgcagagtttgagtaatgcacag

SEQ ID NO: 1596 - DNA, 33 bp, Artificial Sequence
  Synthetic Construct
gcccaattgaagactgctgagtatactgcacag

SEQ ID NO: 1597 - DNA, 33 bp, Artificial Sequence
  Synthetic Construct
gcccaatcgagtgagaagccgtttcgggcacag

SEQ ID NO: 1598 - DNA, 33 bp, Artificial Sequence
  Synthetic Construct
gcccaacccaccagcggcgtcttcggcgcacag

SEQ ID NO: 1599 - DNA, 33 bp, Artificial Sequence
  Synthetic Construct
gcccaaggccccagcatcgtcaccatggcacag

SEQ ID NO: 1600 - DNA, 33 bp, Artificial Sequence
  Synthetic Construct
gcccaaacgagtgataagagttcgcttgcacag

SEQ ID NO: 1601 - DNA, 33 bp, Artificial Sequence
  Synthetic Construct
gcccaaaatactattactatggctaaggcacag

SEQ ID NO: 1602 - DNA, 33 bp, Artificial Sequence
  Synthetic Construct
gcccaacggaatcagcctgttccgagtgcacag

SEQ ID NO: 1603 - DNA, 33 bp, Artificial Sequence
  Synthetic Construct
gcccaaagcgtccacctcaacctccaagcacag

SEQ ID NO: 1604 - DNA, 33 bp, Artificial Sequence
  Synthetic Construct
gcccaatataatctgacgatggttagtgcacag

SEQ ID NO: 1605 - DNA, 33 bp, Artificial Sequence
  Synthetic Construct
gcccaaaccgccgacagccaccccagagcacag

SEQ ID NO: 1606 - DNA, 33 bp, Artificial Sequence
  Synthetic Construct
gcccaattgcttggtgagaaggtgatggcacag

SEQ ID NO: 1607 - DNA, 33 bp, Artificial Sequence
  Synthetic Construct
gcccaatgggatctgactgctccgcaggcacag

SEQ ID NO: 1608 - DNA, 33 bp, Artificial Sequence
  Synthetic Construct
gcccaagtgcttgctgatcgtcttccggcacag

SEQ ID NO: 1609 - DNA, 33 bp, Artificial Sequence
  Synthetic Construct
gcccaatctcgtgcgctgccgaattcggcacag

SEQ ID NO: 1610 - DNA, 33 bp, Artificial Sequence
  Synthetic Construct
gcccaaagcagcctcaacatgcccagagcacag

SEQ ID NO: 1611 - DNA, 33 bp, Artificial Sequence
  Synthetic Construct
gcccaacagaaggtttcgattttggctgcacag

SEQ ID NO: 1612 - DNA, 33 bp, Artificial Sequence
  Synthetic Construct
gcccaaagaggcgacaacagcagactcgcacag

SEQ ID NO: 1613 - DNA, 33 bp, Artificial Sequence
  Synthetic Construct
gcccaaagaatcgacctcggcagccaagcacag

SEQ ID NO: 1614 - DNA, 33 bp, Artificial Sequence
  Synthetic Construct
gcccaagcgtcgctgggtcttcgggctgcacag

SEQ ID NO: 1615 - DNA, 33 bp, Artificial Sequence
  Synthetic Construct
gcccaatcgatgcagaatggtcttcgggcacag

SEQ ID NO: 1616 - DNA, 33 bp, Artificial Sequence
  Synthetic Construct
gcccaaacgttggctgtggggattgcggcacag

SEQ ID NO: 1617 - DNA, 33 bp, Artificial Sequence
  Synthetic Construct
gcccaagggcagactgtgacgggggcggcacag

SEQ ID NO: 1618 - DNA, 33 bp, Artificial Sequence
  Synthetic Construct
gcccaacatgctttgagtccttctccggcacag

SEQ ID NO: 1619 - DNA, 33 bp, Artificial Sequence
  Synthetic Construct
gcccaagtcagcagcgtcttcaccgaagcacag

SEQ ID NO: 1620 - DNA, 33 bp, Artificial Sequence
  Synthetic Construct
gcccaatacggcgccggcgccgtcaaagcacag

SEQ ID NO: 1621 - DNA, 33 bp, Artificial Sequence
  Synthetic Construct
gcccaaaaagaaaccctccccaacgccgcacag

SEQ ID NO: 1622 - DNA, 33 bp, Artificial Sequence
  Synthetic Construct
gcccaaatccccagccaaacccccctcgcacag

SEQ ID NO: 1623 - DNA, 33 bp, Artificial Sequence
  Synthetic Construct
gcccaaagcgccatcagcaccttcgtcgcacag

SEQ ID NO: 1624 - DNA, 33 bp, Artificial Sequence
  Synthetic Construct
gcccaagtcaacagcaccagcagcaccgcacag

SEQ ID NO: 1625 - DNA, 33 bp, Artificial Sequence
  Synthetic Construct
gcccaacctacgcgtgattataaggaggcacag

SEQ ID NO: 1626 - DNA, 33 bp, Artificial Sequence
  Synthetic Construct
gcccaaaacaaccccgccagcacccaagcacag

SEQ ID NO: 1627 - DNA, 33 bp, Artificial Sequence
  Synthetic Construct
gcccaagtgacgcagacgtctgttaatgcacag

SEQ ID NO: 1628 - DNA, 33 bp, Artificial Sequence
  Synthetic Construct
gcccaatgggccggcaccaccagccacgcacag

SEQ ID NO: 1629 - DNA, 33 bp, Artificial Sequence
  Synthetic Construct
gcccaagtcaccgccggcttcagcgccgcacag

SEQ ID NO: 1630 - DNA, 33 bp, Artificial Sequence
  Synthetic Construct
gcccaattgcattctccttctatgcaggcacag

SEQ ID NO: 1631 - DNA, 33 bp, Artificial Sequence
  Synthetic Construct
gcccaatttcctacgcagccttcgatggcacag

SEQ ID NO: 1632 - DNA, 33 bp, Artificial Sequence
  Synthetic Construct
gcccaagcccaaagcgtcaacgacggcgcacag

SEQ ID NO: 1633 - DNA, 33 bp, Artificial Sequence
  Synthetic Construct
gcccaagtcgccagcaccacctacaccgcacag

SEQ ID NO: 1634 - DNA, 33 bp, Artificial Sequence
  Synthetic Construct
gcccaactgggggggttgaattcggtggcacag

SEQ ID NO: 1635 - DNA, 33 bp, Artificial Sequence
  Synthetic Construct
gcccaagccggcgcccccagcctcagcgcacag

SEQ ID NO: 1636 - DNA, 33 bp, Artificial Sequence
  Synthetic Construct
gcccaaagtaataggaagattgatgatgcacag

SEQ ID NO: 1637 - DNA, 33 bp, Artificial Sequence
  Synthetic Construct
gcccaatctcctaataatagggctgtggcacag

SEQ ID NO: 1638 - DNA, 33 bp, Artificial Sequence
  Synthetic Construct
gcccaagttttgagggaggatcagtcggcacag

SEQ ID NO: 1639 - DNA, 33 bp, Artificial Sequence
  Synthetic Construct
gcccaacttcttgcgactgggcttaaggcacag

SEQ ID NO: 1640 - DNA, 33 bp, Artificial Sequence
  Synthetic Construct
gcccaagtccacctcagaagccaaatcgcacag

SEQ ID NO: 1641 - DNA, 33 bp, Artificial Sequence
  Synthetic Construct
gcccaaagtgcgaattcgaatttgaaggcacag

SEQ ID NO: 1642 - DNA, 33 bp, Artificial Sequence
  Synthetic Construct
gcccaaagcaaagccggcgaaggcaacgcacag

SEQ ID NO: 1643 - DNA, 33 bp, Artificial Sequence
  Synthetic Construct
gcccaagtcagcaaccccgccatgaaagcacag

SEQ ID NO: 1644 - DNA, 33 bp, Artificial Sequence
  Synthetic Construct
gcccaaatcaacggcaacaaccaaagagcacag

SEQ ID NO: 1645 - DNA, 33 bp, Artificial Sequence
  Synthetic Construct
gcccaatataagtcgacgactctttctgcacag

SEQ ID NO: 1646 - DNA, 33 bp, Artificial Sequence
  Synthetic Construct
gcccaaaaagaaggcctcgtcagcagagcacag

SEQ ID NO: 1647 - DNA, 33 bp, Artificial Sequence
  Synthetic Construct
gcccaacacctcaaagtcatgaccatcgcacag

SEQ ID NO: 1648 - DNA, 33 bp, Artificial Sequence
  Synthetic Construct
gcccaaagaaccaacgaccacagcagcgcacag

SEQ ID NO: 1649 - DNA, 33 bp, Artificial Sequence
  Synthetic Construct
gcccaactgccttctcagtctgctaaggcacag

SEQ ID NO: 1650 - DNA, 33 bp, Artificial Sequence
  Synthetic Construct
gcccaaattacgctgaggcatttgcaggcacag

SEQ ID NO: 1651 - DNA, 33 bp, Artificial Sequence
  Synthetic Construct
gcccaacaaatgatcgccaacatccccgcacag

SEQ ID NO: 1652 - DNA, 33 bp, Artificial Sequence
  Synthetic Construct
gcccaaagttcttcgactgatcagcatgcacag

SEQ ID NO: 1653 - DNA, 33 bp, Artificial Sequence
  Synthetic Construct
gcccaaagaagcaccgacttcacccccgcacag

SEQ ID NO: 1654 - DNA, 33 bp, Artificial Sequence
  Synthetic Construct
gcccaacagcatgcgtctatttctgctgcacag

SEQ ID NO: 1655 - DNA, 33 bp, Artificial Sequence
  Synthetic Construct
gcccaaaacatcagcagcatgcaaatggcacag

SEQ ID NO: 1656 - DNA, 33 bp, Artificial Sequence
  Synthetic Construct
gcccaatcggggaatgttgtggggcgggcacag

SEQ ID NO: 1657 - DNA, 33 bp, Artificial Sequence
  Synthetic Construct
gcccaaagcaaaggcgacaccagcgccgcacag

SEQ ID NO: 1658 - DNA, 33 bp, Artificial Sequence
  Synthetic Construct
gcccaactgctgaatacggggactaaggcacag

SEQ ID NO: 1659 - DNA, 33 bp, Artificial Sequence
  Synthetic Construct
gcccaaggtactggggctagtatgaatgcacag

SEQ ID NO: 1660 - DNA, 33 bp, Artificial Sequence
  Synthetic Construct
gcccaacgtcttgatgcgaattctacggcacag

SEQ ID NO: 1661 - DNA, 33 bp, Artificial Sequence
  Synthetic Construct
gcccaactccccgaaagacccaacagcgcacag

SEQ ID NO: 1662 - DNA, 33 bp, Artificial Sequence
  Synthetic Construct
gcccaagccagagaaatcctcaaccacgcacag

SEQ ID NO: 1663 - DNA, 33 bp, Artificial Sequence
  Synthetic Construct
gcccaaaacttcaaaaccaccaacagcgcacag

SEQ ID NO: 1664 - DNA, 33 bp, Artificial Sequence
  Synthetic Construct
gcccaaggcagaaccgtccaagacagagcacag

SEQ ID NO: 1665 - DNA, 33 bp, Artificial Sequence
  Synthetic Construct
gcccaaggtatgaatcagacgacgactgcacag

SEQ ID NO: 1666 - DNA, 33 bp, Artificial Sequence
  Synthetic Construct
gcccaagtcggcaaagacggcgtcctcgcacag

SEQ ID NO: 1667 - DNA, 33 bp, Artificial Sequence
  Synthetic Construct
gcccaagtcaccagagacggcgccaaagcacag

SEQ ID NO: 1668 - DNA, 33 bp, Artificial Sequence
  Synthetic Construct
gcccaaggtactgctacgtatggtaaggcacag

SEQ ID NO: 1669 - DNA, 33 bp, Artificial Sequence
  Synthetic Construct
gcccaaatgttgggtgctgaggggtatgcacag

SEQ ID NO: 1670 - DNA, 33 bp, Artificial Sequence
  Synthetic Construct
gcccaagtcacccaacaaaaccaccacgcacag

SEQ ID NO: 1671 - DNA, 33 bp, Artificial Sequence
  Synthetic Construct
gcccaaaccgtcaacgccgaccaactcgcacag

SEQ ID NO: 1672 - DNA, 33 bp, Artificial Sequence
  Synthetic Construct
gcccaacagatgcagaatagtcctattgcacag

SEQ ID NO: 1673 - DNA, 33 bp, Artificial Sequence
  Synthetic Construct
gcccaagggacgctggcgagttcgaaggcacag

SEQ ID NO: 1674 - DNA, 33 bp, Artificial Sequence
  Synthetic Construct
gcccaatctaatgtgacgattgcgcatgcacag

SEQ ID NO: 1675 - DNA, 33 bp, Artificial Sequence
  Synthetic Construct
gcccaagcgaataattctcgtccgtttgcacag

SEQ ID NO: 1676 - DNA, 33 bp, Artificial Sequence
  Synthetic Construct
gcccaaattgcgacggcgggtggtcctgcacag

SEQ ID NO: 1677 - DNA, 33 bp, Artificial Sequence
  Synthetic Construct
gcccaagccttcagcggccccagcagagcacag

SEQ ID NO: 1678 - DNA, 33 bp, Artificial Sequence
  Synthetic Construct
gcccaactcaccaacctcgtcagcagagcacag

SEQ ID NO: 1679 - DNA, 33 bp, Artificial Sequence
  Synthetic Construct
gcccaagccggccaacacctcgccctcgcacag

SEQ ID NO: 1680 - DNA, 33 bp, Artificial Sequence
  Synthetic Construct
gcccaaagtgttgtggcgtctgcgaatgcacag

SEQ ID NO: 1681 - DNA, 33 bp, Artificial Sequence
  Synthetic Construct
gcccaagagactgtttcgactagtcttgcacag

SEQ ID NO: 1682 - DNA, 33 bp, Artificial Sequence
  Synthetic Construct
gcccaaatcctcgccgccctcaccggcgcacag

SEQ ID NO: 1683 - DNA, 33 bp, Artificial Sequence
  Synthetic Construct
gcccaaacgacggataaggctgcgcttgcacag

SEQ ID NO: 1684 - DNA, 33 bp, Artificial Sequence
  Synthetic Construct
gcccaatacctcgacaaacccggcgccgcacag

SEQ ID NO: 1685 - DNA, 33 bp, Artificial Sequence
  Synthetic Construct
gcccaacccaacctcagcaacctcatggcacag

SEQ ID NO: 1686 - DNA, 33 bp, Artificial Sequence
  Synthetic Construct
gcccaaattaatgcgcctacggctagtgcacag

SEQ ID NO: 1687 - DNA, 33 bp, Artificial Sequence
  Synthetic Construct
gcccaacatggtggtacgagtctggctgcacag

SEQ ID NO: 1688 - DNA, 33 bp, Artificial Sequence
  Synthetic Construct
gcccaaaatattcagttgtctcttgctgcacag

SEQ ID NO: 1689 - DNA, 33 bp, Artificial Sequence
  Synthetic Construct
gcccaaactcttcatatgtctagtaaggcacag

SEQ ID NO: 1690 - DNA, 33 bp, Artificial Sequence
  Synthetic Construct
gcccaagccatcatcaacccccacagcgcacag

SEQ ID NO: 1691 - DNA, 33 bp, Artificial Sequence
  Synthetic Construct
gcccaaaatactctgattaatgttagtgcacag

SEQ ID NO: 1692 - DNA, 33 bp, Artificial Sequence
  Synthetic Construct
gcccaaaacagcgtcgtcctcgccatggcacag

SEQ ID NO: 1693 - DNA, 33 bp, Artificial Sequence
  Synthetic Construct
gcccaaaatatggcttctttgtcggcggcacag

SEQ ID NO: 1694 - DNA, 33 bp, Artificial Sequence
  Synthetic Construct
gcccaaagcagcacccacctcctcgccgcacag

SEQ ID NO: 1695 - DNA, 33 bp, Artificial Sequence
  Synthetic Construct
gcccaagacaacagccaaagcgacaaagcacag

SEQ ID NO: 1696 - DNA, 33 bp, Artificial Sequence
  Synthetic Construct
gcccaaggcatcaccaccaacgcccacgcacag

SEQ ID NO: 1697 - DNA, 33 bp, Artificial Sequence
  Synthetic Construct
gcccaatctagtactattaatgggtatgcacag

SEQ ID NO: 1698 - DNA, 33 bp, Artificial Sequence
  Synthetic Construct
gcccaaaatcatacgcggatgaatgaggcacag

SEQ ID NO: 1699 - DNA, 33 bp, Artificial Sequence
  Synthetic Construct
gcccaaggcaaccaacaaaaaaacctcgcacag

SEQ ID NO: 1700 - DNA, 33 bp, Artificial Sequence
  Synthetic Construct
gcccaaggtacgagtgatcggcagcaggcacag

SEQ ID NO: 1701 - DNA, 33 bp, Artificial Sequence
  Synthetic Construct
gcccaaagcgacagcgaatacaaacccgcacag

SEQ ID NO: 1702 - DNA, 33 bp, Artificial Sequence
  Synthetic Construct
gcccaaacggctgcgcatgttagttatgcacag

SEQ ID NO: 1703 - DNA, 33 bp, Artificial Sequence
  Synthetic Construct
gcccaaatggccaccacccacgccgccgcacag

SEQ ID NO: 1704 - DNA, 33 bp, Artificial Sequence
  Synthetic Construct
gcccaaaacagcgtcagacaaagcctcgcacag

SEQ ID NO: 1705 - DNA, 33 bp, Artificial Sequence
  Synthetic Construct
gcccaatcgggtagtggtgttagtagtgcacag

SEQ ID NO: 1706 - DNA, 33 bp, Artificial Sequence
  Synthetic Construct
gcccaacccaccaccagaatcaccgacgcacag

SEQ ID NO: 1707 - DNA, 33 bp, Artificial Sequence
  Synthetic Construct
gcccaaagtcatgaggcgaagaatcctgcacag

SEQ ID NO: 1708 - DNA, 33 bp, Artificial Sequence
  Synthetic Construct
gcccaaccgtatagtactgctgatcgggcacag

SEQ ID NO: 1709 - DNA, 33 bp, Artificial Sequence
  Synthetic Construct
gcccaaatgctcagcaacaccaaccacgcacag

SEQ ID NO: 1710 - DNA, 33 bp, Artificial Sequence
  Synthetic Construct
gcccaaagcctcggcctcggcggcagcgcacag

SEQ ID NO: 1711 - DNA, 33 bp, Artificial Sequence
  Synthetic Construct
gcccaaaacgccatgaacatgcccgtcgcacag

SEQ ID NO: 1712 - DNA, 33 bp, Artificial Sequence
  Synthetic Construct
gcccaaatgcttgggcatattgcgaatgcacag

SEQ ID NO: 1713 - DNA, 33 bp, Artificial Sequence
  Synthetic Construct
gcccaaaaaggccaaaccgtcagcgaagcacag

SEQ ID NO: 1714 - DNA, 33 bp, Artificial Sequence
  Synthetic Construct
gcccaaatggataatcgtaataattgggcacag

SEQ ID NO: 1715 - DNA, 33 bp, Artificial Sequence
  Synthetic Construct
gcccaactgttgcataggaatgatgttgcacag

SEQ ID NO: 1716 - DNA, 33 bp, Artificial Sequence
  Synthetic Construct
gcccaagctaatctggtttcggcgaaggcacag

SEQ ID NO: 1717 - DNA, 33 bp, Artificial Sequence
  Synthetic Construct
gcccaaagtctgacgagggatctgaaggcacag

SEQ ID NO: 1718 - DNA, 33 bp, Artificial Sequence
  Synthetic Construct
gcccaaggtgggcagattgtgtcgcgtgcacag

SEQ ID NO: 1719 - DNA, 33 bp, Artificial Sequence
  Synthetic Construct
gcccaaaattatactcctgataagagggcacag

SEQ ID NO: 1720 - DNA, 33 bp, Artificial Sequence
  Synthetic Construct
gcccaactctacgccaaccaccacagcgcacag

SEQ ID NO: 1721 - DNA, 33 bp, Artificial Sequence
  Synthetic Construct
gcccaagagagtgtggctgggcatatggcacag

SEQ ID NO: 1722 - DNA, 33 bp, Artificial Sequence
  Synthetic Construct
gcccaagagcctcgtcaggatgcgcatgcacag

SEQ ID NO: 1723 - DNA, 33 bp, Artificial Sequence
  Synthetic Construct
gcccaaagcgtcggcggcaccacccaagcacag

SEQ ID NO: 1724 - DNA, 33 bp, Artificial Sequence
  Synthetic Construct
gcccaacaacccgccatgttcaacggcgcacag

SEQ ID NO: 1725 - DNA, 33 bp, Artificial Sequence
  Synthetic Construct
gcccaagtcaaacaaaccgtcatgagcgcacag

SEQ ID NO: 1726 - DNA, 33 bp, Artificial Sequence
  Synthetic Construct
gcccaactttatgagcaggcttctaaggcacag

SEQ ID NO: 1727 - DNA, 33 bp, Artificial Sequence
  Synthetic Construct
gcccaaattaatgcggcgattgctctggcacag

SEQ ID NO: 1728 - DNA, 33 bp, Artificial Sequence
  Synthetic Construct
gcccaactcgaactcagccacagcagagcacag

SEQ ID NO: 1729 - DNA, 33 bp, Artificial Sequence
  Synthetic Construct
gcccaaagtgtgaagagtattatgaatgcacag

SEQ ID NO: 1730 - DNA, 33 bp, Artificial Sequence
  Synthetic Construct
gcccaagtgccgaatcgtgagcctaaggcacag

SEQ ID NO: 1731 - DNA, 33 bp, Artificial Sequence
  Synthetic Construct
gcccaaattgcttctttgctgtcgcgtgcacag

SEQ ID NO: 1732 - DNA, 33 bp, Artificial Sequence
  Synthetic Construct
gcccaagccaacaacgtcgccgacagagcacag

SEQ ID NO: 1733 - DNA, 33 bp, Artificial Sequence
  Synthetic Construct
gcccaaagcgtcgacagagccgaaagagcacag

SEQ ID NO: 1734 - DNA, 33 bp, Artificial Sequence
  Synthetic Construct
gcccaagtcctcgccgacagagtccccgcacag

SEQ ID NO: 1735 - DNA, 33 bp, Artificial Sequence
  Synthetic Construct
gcccaacggactgattcgtctcatccggcacag

SEQ ID NO: 1736 - DNA, 33 bp, Artificial Sequence
  Synthetic Construct
gcccaaattcttggtactggtgggcaggcacag

SEQ ID NO: 1737 - DNA, 33 bp, Artificial Sequence
  Synthetic Construct
gcccaatctactgcgcaggctagttatgcacag

SEQ ID NO: 1738 - DNA, 33 bp, Artificial Sequence
  Synthetic Construct
gcccaagtcggccccatcaacaccgtcgcacag

SEQ ID NO: 1739 - DNA, 33 bp, Artificial Sequence
  Synthetic Construct
gcccaacaaaccaacaacaccgtcagagcacag

SEQ ID NO: 1740 - DNA, 33 bp, Artificial Sequence
  Synthetic Construct
gcccaaggcaacgccgtcagaagcaccgcacag

SEQ ID NO: 1741 - DNA, 33 bp, Artificial Sequence
  Synthetic Construct
gcccaacagaatttgactaagggtcaggcacag

SEQ ID NO: 1742 - DNA, 33 bp, Artificial Sequence
  Synthetic Construct
gcccaaaaacaactcagcaaagactacgcacag

SEQ ID NO: 1743 - DNA, 33 bp, Artificial Sequence
  Synthetic Construct
gcccaaatggttcagaatggtctgattgcacag

SEQ ID NO: 1744 - DNA, 33 bp, Artificial Sequence
  Synthetic Construct
gcccaaatcgtcgaacacatgcccctcgcacag

SEQ ID NO: 1745 - DNA, 33 bp, Artificial Sequence
  Synthetic Construct
gcccaatacgacaccaccagcatcttcgcacag

SEQ ID NO: 1746 - DNA, 33 bp, Artificial Sequence
  Synthetic Construct
gcccaaaatagtatttcgtcttcggctgcacag

SEQ ID NO: 1747 - DNA, 33 bp, Artificial Sequence
  Synthetic Construct
gcccaaggcggcaacaacagcctccacgcacag

SEQ ID NO: 1748 - DNA, 33 bp, Artificial Sequence
  Synthetic Construct
gcccaaatttctggtgcgtctcttatggcacag

SEQ ID NO: 1749 - DNA, 33 bp, Artificial Sequence
  Synthetic Construct
gcccaagctactctttcgaggaatgttgcacag

SEQ ID NO: 1750 - DNA, 33 bp, Artificial Sequence
  Synthetic Construct
gcccaactggctaataatgttccgcttgcacag

SEQ ID NO: 1751 - DNA, 33 bp, Artificial Sequence
  Synthetic Construct
gcccaatggagcgaccccagcgacctcgcacag

SEQ ID NO: 1752 - DNA, 33 bp, Artificial Sequence
  Synthetic Construct
gcccaaagcagcctcaccgaccaacccgcacag

SEQ ID NO: 1753 - DNA, 33 bp, Artificial Sequence
  Synthetic Construct
gcccaatacgtccccgaccacaccagagcacag

SEQ ID NO: 1754 - DNA, 33 bp, Artificial Sequence
  Synthetic Construct
gcccaaaataatacggagggtaaggcggcacag

SEQ ID NO: 1755 - DNA, 33 bp, Artificial Sequence
  Synthetic Construct
gcccaaggtaatagtgttaggttgattgcacag

SEQ ID NO: 1756 - DNA, 33 bp, Artificial Sequence
  Synthetic Construct
gcccaaattgcgcagtcgaatactcttgcacag

SEQ ID NO: 1757 - DNA, 33 bp, Artificial Sequence
  Synthetic Construct
gcccaacacgacaacgccaccaaatacgcacag

SEQ ID NO: 1758 - DNA, 33 bp, Artificial Sequence
  Synthetic Construct
gcccaaactaaggctaatgagatgcaggcacag

SEQ ID NO: 1759 - DNA, 33 bp, Artificial Sequence
  Synthetic Construct
gcccaatatttgggtacggttgttgcggcacag

SEQ ID NO: 1760 - DNA, 33 bp, Artificial Sequence
  Synthetic Construct
gcccaaccttcgattgagcttaagcctgcacag

SEQ ID NO: 1761 - DNA, 33 bp, Artificial Sequence
  Synthetic Construct
gcccaagctgcggggaatgttcttatggcacag

SEQ ID NO: 1762 - DNA, 33 bp, Artificial Sequence
  Synthetic Construct
gcccaaacgtctgtggctaatttgcgtgcacag

SEQ ID NO: 1763 - DNA, 33 bp, Artificial Sequence
  Synthetic Construct
gcccaattttcgcgtgagccgaagcctgcacag

SEQ ID NO: 1764 - DNA, 33 bp, Artificial Sequence
  Synthetic Construct
gcccaaacccccagagaaaactggggcgcacag

SEQ ID NO: 1765 - DNA, 33 bp, Artificial Sequence
  Synthetic Construct
gcccaatcgcagaatgttggtactaaggcacag

SEQ ID NO: 1766 - DNA, 33 bp, Artificial Sequence
  Synthetic Construct
gcccaatatctggataaggggaggactgcacag

SEQ ID NO: 1767 - DNA, 33 bp, Artificial Sequence
  Synthetic Construct
gcccaaacgagtacgacgccttttcttgcacag

SEQ ID NO: 1768 - DNA, 33 bp, Artificial Sequence
  Synthetic Construct
gcccaacggcaggataatctggagctggcacag

SEQ ID NO: 1769 - DNA, 33 bp, Artificial Sequence
  Synthetic Construct
gcccaaatcagcgacagcagagtccacgcacag

SEQ ID NO: 1770 - DNA, 33 bp, Artificial Sequence
  Synthetic Construct
gcccaaagtcagagtagtcattataaggcacag

SEQ ID NO: 1771 - DNA, 33 bp, Artificial Sequence
  Synthetic Construct
gcccaattgaatcgggtggtttcgcaggcacag

SEQ ID NO: 1772 - DNA, 33 bp, Artificial Sequence
  Synthetic Construct
gcccaaatggccctcgacaacagcagagcacag

SEQ ID NO: 1773 - DNA, 33 bp, Artificial Sequence
  Synthetic Construct
gcccaactcatccaaagcatggccaaagcacag

SEQ ID NO: 1774 - DNA, 33 bp, Artificial Sequence
  Synthetic Construct
gcccaagcgggtgagcctaattctagggcacag

SEQ ID NO: 1775 - DNA, 33 bp, Artificial Sequence
  Synthetic Construct
gcccaaagtaatcagtctactgttcgggcacag

SEQ ID NO: 1776 - DNA, 33 bp, Artificial Sequence
  Synthetic Construct
gcccaaaccagcaacctcagcgaaagagcacag

SEQ ID NO: 1777 - DNA, 33 bp, Artificial Sequence
  Synthetic Construct
gcccaatcgaattctacttctcgtgctgcacag

SEQ ID NO: 1778 - DNA, 33 bp, Artificial Sequence
  Synthetic Construct
gcccaaatgcagcagcagtttccttcggcacag

SEQ ID NO: 1779 - DNA, 33 bp, Artificial Sequence
  Synthetic Construct
gcccaattcaacaccctcgccgaagtcgcacag

SEQ ID NO: 1780 - DNA, 33 bp, Artificial Sequence
  Synthetic Construct
gcccaaccgggggttacggttattagtgcacag

SEQ ID NO: 1781 - DNA, 33 bp, Artificial Sequence
  Synthetic Construct
gcccaactccaaaacgtccacgacagcgcacag

SEQ ID NO: 1782 - DNA, 33 bp, Artificial Sequence
  Synthetic Construct
gcccaaaattcggttattggtgggtcggcacag

SEQ ID NO: 1783 - DNA, 33 bp, Artificial Sequence
  Synthetic Construct
gcccaaaacgaaggcgtcagacccctcgcacag

SEQ ID NO: 1784 - DNA, 33 bp, Artificial Sequence
  Synthetic Construct
gcccaatcggtgaatcctagtgtggttgcacag

SEQ ID NO: 1785 - DNA, 33 bp, Artificial Sequence
  Synthetic Construct
gcccaaatgagtacgacgtctgaggatgcacag

SEQ ID NO: 1786 - DNA, 33 bp, Artificial Sequence
  Synthetic Construct
gcccaaattcatagtgggcttccgaaggcacag

SEQ ID NO: 1787 - DNA, 33 bp, Artificial Sequence
  Synthetic Construct
gcccaaggtatgaatggttatccgaaggcacag

SEQ ID NO: 1788 - DNA, 33 bp, Artificial Sequence
  Synthetic Construct
gcccaaagtattcgggattctgtgaaggcacag

SEQ ID NO: 1789 - DNA, 33 bp, Artificial Sequence
  Synthetic Construct
gcccaaatgcttaagccggataatgttgcacag

SEQ ID NO: 1790 - DNA, 33 bp, Artificial Sequence
  Synthetic Construct
gcccaagcttttacgtcgtctcttggggcacag

SEQ ID NO: 1791 - DNA, 33 bp, Artificial Sequence
  Synthetic Construct
gcccaaatgctggataagtcttcgtcggcacag

SEQ ID NO: 1792 - DNA, 33 bp, Artificial Sequence
  Synthetic Construct
gcccaaaagactcagaatactcagatggcacag

SEQ ID NO: 1793 - DNA, 33 bp, Artificial Sequence
  Synthetic Construct
gcccaagggactactagttcgatggctgcacag

SEQ ID NO: 1794 - DNA, 33 bp, Artificial Sequence
  Synthetic Construct
gcccaaggcagcgccgccagccaagccgcacag

SEQ ID NO: 1795 - DNA, 33 bp, Artificial Sequence
  Synthetic Construct
gcccaagcccacagcaacatcgacagcgcacag

SEQ ID NO: 1796 - DNA, 33 bp, Artificial Sequence
  Synthetic Construct
gcccaaggcagcgccagcagcctcctcgcacag

SEQ ID NO: 1797 - DNA, 33 bp, Artificial Sequence
  Synthetic Construct
gcccaattgagtcctaattctagttttgcacag

SEQ ID NO: 1798 - DNA, 33 bp, Artificial Sequence
  Synthetic Construct
gcccaagggcattctgttactccgtctgcacag

SEQ ID NO: 1799 - DNA, 33 bp, Artificial Sequence
  Synthetic Construct
gcccaaaaaggcggcaacagcatcgacgcacag

SEQ ID NO: 1800 - DNA, 33 bp, Artificial Sequence
  Synthetic Construct
gcccaactcggccccagccccagcgccgcacag

SEQ ID NO: 1801 - DNA, 33 bp, Artificial Sequence
  Synthetic Construct
gcccaacagctgcctatgcttaatgctgcacag

SEQ ID NO: 1802 - DNA, 33 bp, Artificial Sequence
  Synthetic Construct
gcccaagctacgaatattcttactgcggcacag

SEQ ID NO: 1803 - DNA, 33 bp, Artificial Sequence
  Synthetic Construct
gcccaactcatgcaaaacggccaaaaagcacag

SEQ ID NO: 1804 - DNA, 33 bp, Artificial Sequence
  Synthetic Construct
gcccaacataataatgggcaggctttggcacag

SEQ ID NO: 1805 - DNA, 33 bp, Artificial Sequence
  Synthetic Construct
gcccaatctattactcagactctttctgcacag

SEQ ID NO: 1806 - DNA, 33 bp, Artificial Sequence
  Synthetic Construct
gcccaagggaataggattagtaatacggcacag

SEQ ID NO: 1807 - DNA, 33 bp, Artificial Sequence
  Synthetic Construct
gcccaaggtcctcagaatgatccgccggcacag

SEQ ID NO: 1808 - DNA, 33 bp, Artificial Sequence
  Synthetic Construct
gcccaaatcaacggcatgggccccaacgcacag

SEQ ID NO: 1809 - DNA, 33 bp, Artificial Sequence
  Synthetic Construct
gcccaaactgggaatgcgcatcctaatgcacag

SEQ ID NO: 1810 - DNA, 33 bp, Artificial Sequence
  Synthetic Construct
gcccaatatgctgtgaatctgaataatgcacag

SEQ ID NO: 1811 - DNA, 33 bp, Artificial Sequence
  Synthetic Construct
gcccaagcgttgatttctaatagtacggcacag

SEQ ID NO: 1812 - DNA, 33 bp, Artificial Sequence
  Synthetic Construct
gcccaatctcatgtttctactactatggcacag

SEQ ID NO: 1813 - DNA, 33 bp, Artificial Sequence
  Synthetic Construct
gcccaactggatgattttgtgaggccggcacag

SEQ ID NO: 1814 - DNA, 33 bp, Artificial Sequence
  Synthetic Construct
gcccaaaataatactgcgcggtctgttgcacag

SEQ ID NO: 1815 - DNA, 33 bp, Artificial Sequence
  Synthetic Construct
gcccaaaacaaatacccccaacccagcgcacag

SEQ ID NO: 1816 - DNA, 33 bp, Artificial Sequence
  Synthetic Construct
gcccaatatgcgtcggagttgtttgttgcacag

SEQ ID NO: 1817 - DNA, 33 bp, Artificial Sequence
  Synthetic Construct
gcccaattctacaccgccaacgccagcgcacag

SEQ ID NO: 1818 - DNA, 33 bp, Artificial Sequence
  Synthetic Construct
gcccaatttacgaagtcgaatgcgactgcacag

SEQ ID NO: 1819 - DNA, 33 bp, Artificial Sequence
  Synthetic Construct
gcccaactcgccgtcagccaaatgagagcacag

SEQ ID NO: 1820 - DNA, 33 bp, Artificial Sequence
  Synthetic Construct
gcccaaaggaatggtcagctgattgtggcacag

SEQ ID NO: 1821 - DNA, 33 bp, Artificial Sequence
  Synthetic Construct
gcccaagacaccgccaacaccgccagagcacag

SEQ ID NO: 1822 - DNA, 33 bp, Artificial Sequence
  Synthetic Construct
gcccaaaaacccaccgaagtccaacacgcacag

SEQ ID NO: 1823 - DNA, 33 bp, Artificial Sequence
  Synthetic Construct
gcccaacttactaatgcggcgacttatgcacag

SEQ ID NO: 1824 - DNA, 33 bp, Artificial Sequence
  Synthetic Construct
gcccaaatcagcaacgtccaagccaacgcacag

SEQ ID NO: 1825 - DNA, 33 bp, Artificial Sequence
  Synthetic Construct
gcccaagagagtcgtaataatgggtttgcacag

SEQ ID NO: 1826 - DNA, 33 bp, Artificial Sequence
  Synthetic Construct
gcccaaagcaccggccccaccatgcacgcacag

SEQ ID NO: 1827 - DNA, 33 bp, Artificial Sequence
  Synthetic Construct
gcccaaacgcctggtgagtcgcataaggcacag

SEQ ID NO: 1828 - DNA, 33 bp, Artificial Sequence
  Synthetic Construct
gcccaaagcgtcagcatcgccagcagcgcacag

SEQ ID NO: 1829 - DNA, 33 bp, Artificial Sequence
  Synthetic Construct
gcccaaaatggtgttacgcagtctaaggcacag

SEQ ID NO: 1830 - DNA, 33 bp, Artificial Sequence
  Synthetic Construct
gcccaagctaagaatacgtatgcttctgcacag

SEQ ID NO: 1831 - DNA, 33 bp, Artificial Sequence
  Synthetic Construct
gcccaaggtacttcggatggtcatagggcacag

SEQ ID NO: 1832 - DNA, 33 bp, Artificial Sequence
  Synthetic Construct
gcccaatggtctcagaataaggggtatgcacag

SEQ ID NO: 1833 - DNA, 33 bp, Artificial Sequence
  Synthetic Construct
gcccaaggtcagttggcgcggtctgttgcacag

SEQ ID NO: 1834 - DNA, 33 bp, Artificial Sequence
  Synthetic Construct
gcccaaatcggcggcggcgcccaaaaagcacag

SEQ ID NO: 1835 - DNA, 33 bp, Artificial Sequence
  Synthetic Construct
gcccaagccggcaacgccagccacaccgcacag

SEQ ID NO: 1836 - DNA, 33 bp, Artificial Sequence
  Synthetic Construct
gcccaattcaaccaagtcggcaaaatggcacag

SEQ ID NO: 1837 - DNA, 33 bp, Artificial Sequence
  Synthetic Construct
gcccaaacgagggatactctgtataaggcacag

SEQ ID NO: 1838 - DNA, 33 bp, Artificial Sequence
  Synthetic Construct
gcccaaaacggcagccccagctacaacgcacag

SEQ ID NO: 1839 - DNA, 33 bp, Artificial Sequence
  Synthetic Construct
gcccaattggctgaggcgcatgctcgtgcacag

SEQ ID NO: 1840 - DNA, 33 bp, Artificial Sequence
  Synthetic Construct
gcccaacctatgtctaattcggagcgtgcacag

SEQ ID NO: 1841 - DNA, 33 bp, Artificial Sequence
  Synthetic Construct
gcccaacacgtcaccagcctcaacgacgcacag

SEQ ID NO: 1842 - DNA, 33 bp, Artificial Sequence
  Synthetic Construct
gcccaaggggctccgcatgtttcgagggcacag

SEQ ID NO: 1843 - DNA, 33 bp, Artificial Sequence
  Synthetic Construct
gcccaaaatactaatgggaatagtgcggcacag

SEQ ID NO: 1844 - DNA, 33 bp, Artificial Sequence
  Synthetic Construct
gcccaaaacgaactcaccggcatgctcgcacag

SEQ ID NO: 1845 - DNA, 33 bp, Artificial Sequence
  Synthetic Construct
gcccaaagttctcttttgcctgctgctgcacag

SEQ ID NO: 1846 - DNA, 33 bp, Artificial Sequence
  Synthetic Construct
gcccaaccggttggtcagtcgttgactgcacag

SEQ ID NO: 1847 - DNA, 33 bp, Artificial Sequence
  Synthetic Construct
gcccaattgactgctgcgaagggtcttgcacag

SEQ ID NO: 1848 - DNA, 33 bp, Artificial Sequence
  Synthetic Construct
gcccaactgattgggcggctgacttctgcacag

SEQ ID NO: 1849 - DNA, 33 bp, Artificial Sequence
  Synthetic Construct
gcccaagctaagcataatgataatattgcacag

SEQ ID NO: 1850 - DNA, 33 bp, Artificial Sequence
  Synthetic Construct
gcccaattgcgtagtggtgatgagatggcacag

SEQ ID NO: 1851 - DNA, 33 bp, Artificial Sequence
  Synthetic Construct
gcccaaccccaaaacagcaccaccgccgcacag

SEQ ID NO: 1852 - DNA, 33 bp, Artificial Sequence
  Synthetic Construct
gcccaactggctactgggcctctttttgcacag

SEQ ID NO: 1853 - DNA, 33 bp, Artificial Sequence
  Synthetic Construct
gcccaagcgtctgctgtgagtcagaaggcacag

SEQ ID NO: 1854 - DNA, 33 bp, Artificial Sequence
  Synthetic Construct
gcccaagcgcctgttagttctgcgttggcacag

SEQ ID NO: 1855 - DNA, 33 bp, Artificial Sequence
  Synthetic Construct
gcccaaacgatgccgagtctggatagtgcacag

SEQ ID NO: 1856 - DNA, 33 bp, Artificial Sequence
  Synthetic Construct
gcccaacatatgaattttccgaatccggcacag

SEQ ID NO: 1857 - DNA, 33 bp, Artificial Sequence
  Synthetic Construct
gcccaagcgtctgcgaggatggatgcggcacag

SEQ ID NO: 1858 - DNA, 33 bp, Artificial Sequence
  Synthetic Construct
gcccaaaccgtcatcgtcggcggcagagcacag

SEQ ID NO: 1859 - DNA, 33 bp, Artificial Sequence
  Synthetic Construct
gcccaaagtagtcagagtcagactgttgcacag

SEQ ID NO: 1860 - DNA, 33 bp, Artificial Sequence
  Synthetic Construct
gcccaaatcaacaccaccagccaaaaagcacag

SEQ ID NO: 1861 - DNA, 33 bp, Artificial Sequence
  Synthetic Construct
gcccaagctggggcgcgtgttacggaggcacag

SEQ ID NO: 1862 - DNA, 33 bp, Artificial Sequence
  Synthetic Construct
gcccaacccgccccccacagcggcagcgcacag

SEQ ID NO: 1863 - DNA, 33 bp, Artificial Sequence
  Synthetic Construct
gcccaactcaacgtcatgtacaaccccgcacag

SEQ ID NO: 1864 - DNA, 33 bp, Artificial Sequence
  Synthetic Construct
gcccaagggcatgctcagactctttatgcacag

SEQ ID NO: 1865 - DNA, 33 bp, Artificial Sequence
  Synthetic Construct
gcccaaactcctaatctgtctactcatgcacag

SEQ ID NO: 1866 - DNA, 33 bp, Artificial Sequence
  Synthetic Construct
gcccaaagcgccgaaagaaccaacgtcgcacag

SEQ ID NO: 1867 - DNA, 33 bp, Artificial Sequence
  Synthetic Construct
gcccaaaacaacctcagacccgtctacgcacag

SEQ ID NO: 1868 - DNA, 33 bp, Artificial Sequence
  Synthetic Construct
gcccaaaatcagcagtctgcttatacggcacag

SEQ ID NO: 1869 - DNA, 33 bp, Artificial Sequence
  Synthetic Construct
gcccaagtcgtcgacggcaaaacccaagcacag

SEQ ID NO: 1870 - DNA, 33 bp, Artificial Sequence
  Synthetic Construct
gcccaacccctcccccaacaactcgacgcacag

SEQ ID NO: 1871 - DNA, 33 bp, Artificial Sequence
  Synthetic Construct
gcccaagtcgccgaaatcgtccaactcgcacag

SEQ ID NO: 1872 - DNA, 33 bp, Artificial Sequence
  Synthetic Construct
gcccaagacagaaacaccaccgtcagagcacag

SEQ ID NO: 1873 - DNA, 33 bp, Artificial Sequence
  Synthetic Construct
gcccaaaatatgatgaagacggggatggcacag

SEQ ID NO: 1874 - DNA, 33 bp, Artificial Sequence
  Synthetic Construct
gcccaagtccaattcaacaccagcaaagcacag

SEQ ID NO: 1875 - DNA, 33 bp, Artificial Sequence
  Synthetic Construct
gcccaacctgggaatgctagtattcgtgcacag

SEQ ID NO: 1876 - DNA, 33 bp, Artificial Sequence
  Synthetic Construct
gcccaactcggcggcatcctcagcgccgcacag

SEQ ID NO: 1877 - DNA, 33 bp, Artificial Sequence
  Synthetic Construct
gcccaacagacggatcattcgcatcttgcacag

SEQ ID NO: 1878 - DNA, 33 bp, Artificial Sequence
  Synthetic Construct
gcccaaacgctgcatgctgagtttagtgcacag

SEQ ID NO: 1879 - DNA, 33 bp, Artificial Sequence
  Synthetic Construct
gcccaactgtcggatcgtctgaatgcggcacag

SEQ ID NO: 1880 - DNA, 33 bp, Artificial Sequence
  Synthetic Construct
gcccaactgaatgagcgtattggtggggcacag

SEQ ID NO: 1881 - DNA, 33 bp, Artificial Sequence
  Synthetic Construct
gcccaaactttgaattcgacggcgtcggcacag

SEQ ID NO: 1882 - DNA, 33 bp, Artificial Sequence
  Synthetic Construct
gcccaatctgggcgggttgttgcgcaggcacag

SEQ ID NO: 1883 - DNA, 33 bp, Artificial Sequence
  Synthetic Construct
gcccaaaataatcgtacgactaataatgcacag

SEQ ID NO: 1884 - DNA, 33 bp, Artificial Sequence
  Synthetic Construct
gcccaaaacgtccccagcagcacctacgcacag

SEQ ID NO: 1885 - DNA, 33 bp, Artificial Sequence
  Synthetic Construct
gcccaagtccccagcaccgccctcaaagcacag

SEQ ID NO: 1886 - DNA, 33 bp, Artificial Sequence
  Synthetic Construct
gcccaacctcctaatactcagagtctggcacag

SEQ ID NO: 1887 - DNA, 33 bp, Artificial Sequence
  Synthetic Construct
gcccaaacgaatacgacgcgggcgatggcacag

SEQ ID NO: 1888 - DNA, 33 bp, Artificial Sequence
  Synthetic Construct
gcccaaagcaacagaaccgtcagagaagcacag

SEQ ID NO: 1889 - DNA, 33 bp, Artificial Sequence
  Synthetic Construct
gcccaagcttcgactcagattatgagggcacag

SEQ ID NO: 1890 - DNA, 33 bp, Artificial Sequence
  Synthetic Construct
gcccaaacggtgattagttctagtcgtgcacag

SEQ ID NO: 1891 - DNA, 33 bp, Artificial Sequence
  Synthetic Construct
gcccaagtctacagcccccaaggcaccgcacag

SEQ ID NO: 1892 - DNA, 33 bp, Artificial Sequence
  Synthetic Construct
gcccaaggcagccccacccaaagcatggcacag

SEQ ID NO: 1893 - DNA, 33 bp, Artificial Sequence
  Synthetic Construct
gcccaagcggtgtcgtcggaggctcgtgcacag

SEQ ID NO: 1894 - DNA, 33 bp, Artificial Sequence
  Synthetic Construct
gcccaaggttcggttgcgactcttactgcacag

SEQ ID NO: 1895 - DNA, 33 bp, Artificial Sequence
  Synthetic Construct
gcccaaagcgccaacaccggcaccggcgcacag

SEQ ID NO: 1896 - DNA, 33 bp, Artificial Sequence
  Synthetic Construct
gcccaaattgttcaggggactagtatggcacag

SEQ ID NO: 1897 - DNA, 33 bp, Artificial Sequence
  Synthetic Construct
gcccaaactccttcgcttggtgttcttgcacag

SEQ ID NO: 1898 - DNA, 33 bp, Artificial Sequence
  Synthetic Construct
gcccaacccaacatgatgggcagcagcgcacag

SEQ ID NO: 1899 - DNA, 33 bp, Artificial Sequence
  Synthetic Construct
gcccaactcacccaaagccccgcccccgcacag

SEQ ID NO: 1900 - DNA, 33 bp, Artificial Sequence
  Synthetic Construct
gcccaaaaaggcagcaacagcaccctcgcacag

SEQ ID NO: 1901 - DNA, 33 bp, Artificial Sequence
  Synthetic Construct
gcccaacccatggccgccgcccccagagcacag

SEQ ID NO: 1902 - DNA, 33 bp, Artificial Sequence
  Synthetic Construct
gcccaagttacgacgggtccgagtcgtgcacag

SEQ ID NO: 1903 - DNA, 33 bp, Artificial Sequence
  Synthetic Construct
gcccaagtcgtcagccccctcagctacgcacag

SEQ ID NO: 1904 - DNA, 33 bp, Artificial Sequence
  Synthetic Construct
gcccaagtgacgggttctgtgcagaaggcacag

SEQ ID NO: 1905 - DNA, 33 bp, Artificial Sequence
  Synthetic Construct
gcccaaggcggcaccaccgtccaaaccgcacag

SEQ ID NO: 1906 - DNA, 33 bp, Artificial Sequence
  Synthetic Construct
gcccaaaacagcgcccaaatcaacatggcacag

SEQ ID NO: 1907 - DNA, 33 bp, Artificial Sequence
  Synthetic Construct
gcccaacccggcacccaaaaacccaccgcacag

SEQ ID NO: 1908 - DNA, 33 bp, Artificial Sequence
  Synthetic Construct
gcccaagggaaggctagtcattatcctgcacag

SEQ ID NO: 1909 - DNA, 33 bp, Artificial Sequence
  Synthetic Construct
gcccaatataatagtgttccgtcggcggcacag

SEQ ID NO: 1910 - DNA, 33 bp, Artificial Sequence
  Synthetic Construct
gcccaagtttatgagcgggtttctcatgcacag

SEQ ID NO: 1911 - DNA, 33 bp, Artificial Sequence
  Synthetic Construct
gcccaagatgtgaataataggtctatggcacag

SEQ ID NO: 1912 - DNA, 33 bp, Artificial Sequence
  Synthetic Construct
gcccaacctcatgcggtttctatgcttgcacag

SEQ ID NO: 1913 - DNA, 33 bp, Artificial Sequence
  Synthetic Construct
gcccaagggatgcctgctcctcttggtgcacag

SEQ ID NO: 1914 - DNA, 33 bp, Artificial Sequence
  Synthetic Construct
gcccaacagcttcagattaatccggctgcacag

SEQ ID NO: 1915 - DNA, 33 bp, Artificial Sequence
  Synthetic Construct
gcccaaactatggatctgtcgccgccggcacag

SEQ ID NO: 1916 - DNA, 33 bp, Artificial Sequence
  Synthetic Construct
gcccaaaccaccgacctccacgccaaagcacag

SEQ ID NO: 1917 - DNA, 33 bp, Artificial Sequence
  Synthetic Construct
gcccaacaccacaccacccaaaccaccgcacag

SEQ ID NO: 1918 - DNA, 33 bp, Artificial Sequence
  Synthetic Construct
gcccaaccgagttctaattctactaatgcacag

SEQ ID NO: 1919 - DNA, 33 bp, Artificial Sequence
  Synthetic Construct
gcccaaaccagatacaacgtcgaccccgcacag

SEQ ID NO: 1920 - DNA, 33 bp, Artificial Sequence
  Synthetic Construct
gcccaaagcgtcgtcagcctcagccccgcacag

SEQ ID NO: 1921 - DNA, 33 bp, Artificial Sequence
  Synthetic Construct
gcccaagaaaaagtcgaccaactcagagcacag

SEQ ID NO: 1922 - DNA, 33 bp, Artificial Sequence
  Synthetic Construct
gcccaaagcgacagcagacaaaccctcgcacag

SEQ ID NO: 1923 - DNA, 33 bp, Artificial Sequence
  Synthetic Construct
gcccaaacttatcctgctacgagtgatgcacag

SEQ ID NO: 1924 - DNA, 33 bp, Artificial Sequence
  Synthetic Construct
gcccaaagcatgaacgtcggcagcgccgcacag

SEQ ID NO: 1925 - DNA, 33 bp, Artificial Sequence
  Synthetic Construct
gcccaacttgagtctagtaatgctattgcacag

SEQ ID NO: 1926 - DNA, 33 bp, Artificial Sequence
  Synthetic Construct
gcccaatctccgacgaatcatgctcctgcacag

SEQ ID NO: 1927 - DNA, 33 bp, Artificial Sequence
  Synthetic Construct
gcccaagcgcatgaggggatggttaaggcacag

SEQ ID NO: 1928 - DNA, 33 bp, Artificial Sequence
  Synthetic Construct
gcccaagttgatactttgttgtcgaaggcacag

SEQ ID NO: 1929 - DNA, 33 bp, Artificial Sequence
  Synthetic Construct
gcccaaaccgccggccaactcacctgggcacag

SEQ ID NO: 1930 - DNA, 33 bp, Artificial Sequence
  Synthetic Construct
gcccaaatgggcatggacggccaaatcgcacag

SEQ ID NO: 1931 - DNA, 33 bp, Artificial Sequence
  Synthetic Construct
gcccaagagctggagaatggtcgtcgtgcacag

SEQ ID NO: 1932 - DNA, 33 bp, Artificial Sequence
  Synthetic Construct
gcccaactcgacctcagcgtcagcagagcacag

SEQ ID NO: 1933 - DNA, 33 bp, Artificial Sequence
  Synthetic Construct
gcccaatctcagcatccgaatatgacggcacag

SEQ ID NO: 1934 - DNA, 33 bp, Artificial Sequence
  Synthetic Construct
gcccaatatcatgaggtgtcggagcatgcacag

SEQ ID NO: 1935 - DNA, 33 bp, Artificial Sequence
  Synthetic Construct
gcccaaatgcggtcgccgcctcctacggcacag

SEQ ID NO: 1936 - DNA, 33 bp, Artificial Sequence
  Synthetic Construct
gcccaaggtagtggtagttcgacgattgcacag

SEQ ID NO: 1937 - DNA, 33 bp, Artificial Sequence
  Synthetic Construct
gcccaaggtggtgatgctgggaggtgggcacag

SEQ ID NO: 1938 - DNA, 33 bp, Artificial Sequence
  Synthetic Construct
gcccaaaaggctgaggcgatggttattgcacag

SEQ ID NO: 1939 - DNA, 33 bp, Artificial Sequence
  Synthetic Construct
gcccaagccaacaaagacctcggcgtcgcacag

SEQ ID NO: 1940 - DNA, 33 bp, Artificial Sequence
  Synthetic Construct
gcccaaacgtcgtcggagaataggactgcacag

SEQ ID NO: 1941 - DNA, 33 bp, Artificial Sequence
  Synthetic Construct
gcccaaggccccgacagaaccgccgccgcacag

SEQ ID NO: 1942 - DNA, 33 bp, Artificial Sequence
  Synthetic Construct
gcccaaggcagcaccgtcgtccacctcgcacag

SEQ ID NO: 1943 - DNA, 33 bp, Artificial Sequence
  Synthetic Construct
gcccaaactgcggtggtggtgcctcaggcacag

SEQ ID NO: 1944 - DNA, 33 bp, Artificial Sequence
  Synthetic Construct
gcccaagcggttaatattgctaatgcggcacag

SEQ ID NO: 1945 - DNA, 33 bp, Artificial Sequence
  Synthetic Construct
gcccaattgctgtctcagagtggggtggcacag

SEQ ID NO: 1946 - DNA, 33 bp, Artificial Sequence
  Synthetic Construct
gcccaacacaccggcgaaggcaaactcgcacag

SEQ ID NO: 1947 - DNA, 33 bp, Artificial Sequence
  Synthetic Construct
gcccaaagcaacggcaacaacatcagagcacag

SEQ ID NO: 1948 - DNA, 33 bp, Artificial Sequence
  Synthetic Construct
gcccaagaagtcaccctcatgcacaaagcacag

SEQ ID NO: 1949 - DNA, 33 bp, Artificial Sequence
  Synthetic Construct
gcccaacttactactacggggagtaatgcacag

SEQ ID NO: 1950 - DNA, 33 bp, Artificial Sequence
  Synthetic Construct
gcccaagacatcagcggcaaaatcgccgcacag

SEQ ID NO: 1951 - DNA, 33 bp, Artificial Sequence
  Synthetic Construct
gcccaaatttcgccgaatgtttatagtgcacag

SEQ ID NO: 1952 - DNA, 33 bp, Artificial Sequence
  Synthetic Construct
gcccaatataataagcttgttgatggtgcacag

SEQ ID NO: 1953 - DNA, 33 bp, Artificial Sequence
  Synthetic Construct
gcccaatttcatacgcatcctacgagtgcacag

SEQ ID NO: 1954 - DNA, 33 bp, Artificial Sequence
  Synthetic Construct
gcccaacctactctggaggctacgagtgcacag

SEQ ID NO: 1955 - DNA, 33 bp, Artificial Sequence
  Synthetic Construct
gcccaagaactcggcagaaacggccccgcacag

SEQ ID NO: 1956 - DNA, 33 bp, Artificial Sequence
  Synthetic Construct
gcccaagtcgacaaagtcgaaagactcgcacag

SEQ ID NO: 1957 - DNA, 33 bp, Artificial Sequence
  Synthetic Construct
gcccaaaccaccaccatgacccccagagcacag

SEQ ID NO: 1958 - DNA, 33 bp, Artificial Sequence
  Synthetic Construct
gcccaactccaacaaatccccacccccgcacag

SEQ ID NO: 1959 - DNA, 33 bp, Artificial Sequence
  Synthetic Construct
gcccaaaccgacagcaacagcctccaagcacag

SEQ ID NO: 1960 - DNA, 33 bp, Artificial Sequence
  Synthetic Construct
gcccaagacgacagaagcgtcagattcgcacag

SEQ ID NO: 1961 - DNA, 33 bp, Artificial Sequence
  Synthetic Construct
gcccaacttgctactcagaatgcttcggcacag

SEQ ID NO: 1962 - DNA, 33 bp, Artificial Sequence
  Synthetic Construct
gcccaagtcggcacccacatccacagcgcacag

SEQ ID NO: 1963 - DNA, 33 bp, Artificial Sequence
  Synthetic Construct
gcccaaagcgaaagaagcagcgtcaaagcacag

SEQ ID NO: 1964 - DNA, 33 bp, Artificial Sequence
  Synthetic Construct
gcccaaggctacgcccacagcatgatcgcacag

SEQ ID NO: 1965 - DNA, 33 bp, Artificial Sequence
  Synthetic Construct
gcccaaccgttgagtgggggtgttcgtgcacag

SEQ ID NO: 1966 - DNA, 33 bp, Artificial Sequence
  Synthetic Construct
gcccaactcacctacgtcgccagcagcgcacag

SEQ ID NO: 1967 - DNA, 33 bp, Artificial Sequence
  Synthetic Construct
gcccaagtcgacaaaaccctcagcagagcacag

SEQ ID NO: 1968 - DNA, 33 bp, Artificial Sequence
  Synthetic Construct
gcccaacccaacctcgtcggcgtccccgcacag

SEQ ID NO: 1969 - DNA, 33 bp, Artificial Sequence
  Synthetic Construct
gcccaaaccaaaatcgacaccgtcagagcacag

SEQ ID NO: 1970 - DNA, 33 bp, Artificial Sequence
  Synthetic Construct
gcccaaagcggcggcacccaagccagagcacag

SEQ ID NO: 1971 - DNA, 33 bp, Artificial Sequence
  Synthetic Construct
gcccaacatagtacgccgctggtgtcggcacag

SEQ ID NO: 1972 - DNA, 33 bp, Artificial Sequence
  Synthetic Construct
gcccaacattcggggacgaatcttcgtgcacag

SEQ ID NO: 1973 - DNA, 33 bp, Artificial Sequence
  Synthetic Construct
gcccaagcgcagcctaggctggtgactgcacag

SEQ ID NO: 1974 - DNA, 33 bp, Artificial Sequence
  Synthetic Construct
gcccaacctcttggtgcgcatggttcggcacag

SEQ ID NO: 1975 - DNA, 33 bp, Artificial Sequence
  Synthetic Construct
gcccaaatcagcgacgccagcgtcctcgcacag

SEQ ID NO: 1976 - DNA, 33 bp, Artificial Sequence
  Synthetic Construct
gcccaaatgagcgtcggcgtcaaaaccgcacag

SEQ ID NO: 1977 - DNA, 33 bp, Artificial Sequence
  Synthetic Construct
gcccaaaacatcgccgaaggcctcagcgcacag

SEQ ID NO: 1978 - DNA, 33 bp, Artificial Sequence
  Synthetic Construct
gcccaatcgtcgaattctgatgggattgcacag

SEQ ID NO: 1979 - DNA, 33 bp, Artificial Sequence
  Synthetic Construct
gcccaagtcggccaaaccaccaacagcgcacag

SEQ ID NO: 1980 - DNA, 33 bp, Artificial Sequence
  Synthetic Construct
gcccaagagtcgaagcggccttttcttgcacag

SEQ ID NO: 1981 - DNA, 33 bp, Artificial Sequence
  Synthetic Construct
gcccaaagtcaggagaatagtcgtactgcacag

SEQ ID NO: 1982 - DNA, 33 bp, Artificial Sequence
  Synthetic Construct
gcccaaaatactgggactgatcatccggcacag

SEQ ID NO: 1983 - DNA, 33 bp, Artificial Sequence
  Synthetic Construct
gcccaagggaattgggttaaggatattgcacag

SEQ ID NO: 1984 - DNA, 33 bp, Artificial Sequence
  Synthetic Construct
gcccaaagactcaccgaaaccgtcaccgcacag

SEQ ID NO: 1985 - DNA, 33 bp, Artificial Sequence
  Synthetic Construct
gcccaaggcgaaatcggcgtcctctacgcacag

SEQ ID NO: 1986 - DNA, 33 bp, Artificial Sequence
  Synthetic Construct
gcccaactggctccggagccgcttaaggcacag

SEQ ID NO: 1987 - DNA, 33 bp, Artificial Sequence
  Synthetic Construct
gcccaaaacaaactcccccccgccctcgcacag

SEQ ID NO: 1988 - DNA, 33 bp, Artificial Sequence
  Synthetic Construct
gcccaaaatattgggactcgggatgcggcacag

SEQ ID NO: 1989 - DNA, 33 bp, Artificial Sequence
  Synthetic Construct
gcccaaaccgtcagagaactccaacccgcacag

SEQ ID NO: 1990 - DNA, 33 bp, Artificial Sequence
  Synthetic Construct
gcccaagagaatcatggtacgactagtgcacag

SEQ ID NO: 1991 - DNA, 33 bp, Artificial Sequence
  Synthetic Construct
gcccaacacaccgacagaaactacgtcgcacag

SEQ ID NO: 1992 - DNA, 33 bp, Artificial Sequence
  Synthetic Construct
gcccaaactgttggtccgacgtctcatgcacag

SEQ ID NO: 1993 - DNA, 33 bp, Artificial Sequence
  Synthetic Construct
gcccaaggcctcgtcaaagaccaccccgcacag

SEQ ID NO: 1994 - DNA, 33 bp, Artificial Sequence
  Synthetic Construct
gcccaaatcaacgccctcaccaacggcgcacag

SEQ ID NO: 1995 - DNA, 33 bp, Artificial Sequence
  Synthetic Construct
gcccaacccctcgacagcaacagagacgcacag

SEQ ID NO: 1996 - DNA, 33 bp, Artificial Sequence
  Synthetic Construct
gcccaacttaaggtgacgaagattgatgcacag

SEQ ID NO: 1997 - DNA, 33 bp, Artificial Sequence
  Synthetic Construct
gcccaacataatagtaatcctgggttggcacag

SEQ ID NO: 1998 - DNA, 33 bp, Artificial Sequence
  Synthetic Construct
gcccaaaccaccgtcatcctcaaaaccgcacag

SEQ ID NO: 1999 - DNA, 33 bp, Artificial Sequence
  Synthetic Construct
gcccaacttggtaagggtatgactgcggcacag

SEQ ID NO: 2000 - DNA, 33 bp, Artificial Sequence
  Synthetic Construct
gcccaattcagcatcagcgacctcaaagcacag

SEQ ID NO: 2001 - DNA, 33 bp, Artificial Sequence
  Synthetic Construct
gcccaaagtacggatactcatcttcctgcacag

SEQ ID NO: 2002 - DNA, 33 bp, Artificial Sequence
  Synthetic Construct
gcccaattgaatgctgttaagaatgttgcacag

SEQ ID NO: 2003 - DNA, 33 bp, Artificial Sequence
  Synthetic Construct
gcccaacgttcgactccgaatacgattgcacag

SEQ ID NO: 2004 - DNA, 33 bp, Artificial Sequence
  Synthetic Construct
gcccaattgagtattaagttgcagaatgcacag

SEQ ID NO: 2005 - DNA, 33 bp, Artificial Sequence
  Synthetic Construct
gcccaaagtcttgcgattactagtagtgcacag

SEQ ID NO: 2006 - DNA, 33 bp, Artificial Sequence
  Synthetic Construct
gcccaacggcaggatattactattgctgcacag

SEQ ID NO: 2007 - DNA, 33 bp, Artificial Sequence
  Synthetic Construct
gcccaaggtaatgctacgcctcggtctgcacag

SEQ ID NO: 2008 - DNA, 33 bp, Artificial Sequence
  Synthetic Construct
gcccaaagcctcgtcggcaccaccagcgcacag

SEQ ID NO: 2009 - DNA, 33 bp, Artificial Sequence
  Synthetic Construct
gcccaatggcagactcaggataaggaggcacag

SEQ ID NO: 2010 - DNA, 33 bp, Artificial Sequence
  Synthetic Construct
gcccaaacgcctaatgtgccgtctccggcacag

SEQ ID NO: 2011 - DNA, 33 bp, Artificial Sequence
  Synthetic Construct
gcccaaattaatactattagtccgaaggcacag

SEQ ID NO: 2012 - DNA, 33 bp, Artificial Sequence
  Synthetic Construct
gcccaacccctcggcaccagcaacaccgcacag

SEQ ID NO: 2013 - DNA, 33 bp, Artificial Sequence
  Synthetic Construct
gcccaaagccaagtcaacggcggcaaagcacag

SEQ ID NO: 2014 - DNA, 33 bp, Artificial Sequence
  Synthetic Construct
gcccaaccgattaatgataaggtgatggcacag

SEQ ID NO: 2015 - DNA, 33 bp, Artificial Sequence
  Synthetic Construct
gcccaaaacgtcagcagcagcatcctcgcacag

SEQ ID NO: 2016 - DNA, 33 bp, Artificial Sequence
  Synthetic Construct
gcccaacaggcgaattggactgcgtctgcacag

SEQ ID NO: 2017 - DNA, 33 bp, Artificial Sequence
  Synthetic Construct
gcccaaagacccgaaaaccacagcagcgcacag

SEQ ID NO: 2018 - DNA, 33 bp, Artificial Sequence
  Synthetic Construct
gcccaaactaggaatttggatgttcatgcacag

SEQ ID NO: 2019 - DNA, 33 bp, Artificial Sequence
  Synthetic Construct
gcccaaattaatagttcgttttctaaggcacag

SEQ ID NO: 2020 - DNA, 33 bp, Artificial Sequence
  Synthetic Construct
gcccaatctattcaggggtctcagcgggcacag

SEQ ID NO: 2021 - DNA, 33 bp, Artificial Sequence
  Synthetic Construct
gcccaagttgtggcggttggtcagtttgcacag

SEQ ID NO: 2022 - DNA, 33 bp, Artificial Sequence
  Synthetic Construct
gcccaagtcaacaaagtcagagacgtcgcacag

SEQ ID NO: 2023 - DNA, 33 bp, Artificial Sequence
  Synthetic Construct
gcccaaaagcctaatgctcagattcaggcacag

SEQ ID NO: 2024 - DNA, 33 bp, Artificial Sequence
  Synthetic Construct
gcccaaatgtctattggtacgggttcggcacag

SEQ ID NO: 2025 - DNA, 33 bp, Artificial Sequence
  Synthetic Construct
gcccaagggctgcaggcgacgtattctgcacag

SEQ ID NO: 2026 - DNA, 33 bp, Artificial Sequence
  Synthetic Construct
gcccaacaaaccctcagcgccagcagcgcacag

SEQ ID NO: 2027 - DNA, 33 bp, Artificial Sequence
  Synthetic Construct
gcccaagacccccccaacaaattccccgcacag

SEQ ID NO: 2028 - DNA, 33 bp, Artificial Sequence
  Synthetic Construct
gcccaaagaatcagcaccctcggcctcgcacag

SEQ ID NO: 2029 - DNA, 33 bp, Artificial Sequence
  Synthetic Construct
gcccaaaattcggatcgttcggttagtgcacag

SEQ ID NO: 2030 - DNA, 33 bp, Artificial Sequence
  Synthetic Construct
gcccaatataatctgcgtcttgggggggcacag

SEQ ID NO: 2031 - DNA, 33 bp, Artificial Sequence
  Synthetic Construct
gcccaagttcaggatcgggcgatgactgcacag

SEQ ID NO: 2032 - DNA, 33 bp, Artificial Sequence
  Synthetic Construct
gcccaaagcagcagcaccctccccagagcacag

SEQ ID NO: 2033 - DNA, 33 bp, Artificial Sequence
  Synthetic Construct
gcccaaggcggcgtccaaaccgacagcgcacag

SEQ ID NO: 2034 - DNA, 33 bp, Artificial Sequence
  Synthetic Construct
gcccaattgttgtctaataatactcgggcacag

SEQ ID NO: 2035 - DNA, 33 bp, Artificial Sequence
  Synthetic Construct
gcccaatatcatgctgctcaggctgttgcacag

SEQ ID NO: 2036 - DNA, 33 bp, Artificial Sequence
  Synthetic Construct
gcccaaatgagtggtgtgggtagttcggcacag

SEQ ID NO: 2037 - DNA, 33 bp, Artificial Sequence
  Synthetic Construct
gcccaactcaccggccaagtcctcgtcgcacag

SEQ ID NO: 2038 - DNA, 33 bp, Artificial Sequence
  Synthetic Construct
gcccaagcggttaataggctgcctattgcacag

SEQ ID NO: 2039 - DNA, 33 bp, Artificial Sequence
  Synthetic Construct
gcccaaagttctcagatgccgttgcgggcacag

SEQ ID NO: 2040 - DNA, 33 bp, Artificial Sequence
  Synthetic Construct
gcccaaagcagcaacatcgccgacagcgcacag

SEQ ID NO: 2041 - DNA, 33 bp, Artificial Sequence
  Synthetic Construct
gcccaagttgttacgccgcagattagtgcacag

SEQ ID NO: 2042 - DNA, 33 bp, Artificial Sequence
  Synthetic Construct
gcccaagattctaagaagatgagttgggcacag

SEQ ID NO: 2043 - DNA, 33 bp, Artificial Sequence
  Synthetic Construct
gcccaagagacgtataagactactctggcacag

SEQ ID NO: 2044 - DNA, 33 bp, Artificial Sequence
  Synthetic Construct
gcccaacttactatgggtaattctctggcacag

SEQ ID NO: 2045 - DNA, 33 bp, Artificial Sequence
  Synthetic Construct
gcccaatttaaggttagtattcagcaggcacag

SEQ ID NO: 2046 - DNA, 33 bp, Artificial Sequence
  Synthetic Construct
gcccaagatggtcatgctcatcttccggcacag

SEQ ID NO: 2047 - DNA, 33 bp, Artificial Sequence
  Synthetic Construct
gcccaaaccgccgtcagcctcagcaacgcacag

SEQ ID NO: 2048 - DNA, 33 bp, Artificial Sequence
  Synthetic Construct
gcccaaagccaaaaccaaatgcaaaccgcacag

SEQ ID NO: 2049 - DNA, 33 bp, Artificial Sequence
  Synthetic Construct
gcccaacagagtgtgactacgcagcatgcacag

SEQ ID NO: 2050 - DNA, 33 bp, Artificial Sequence
  Synthetic Construct
gcccaactcagcaccgccctcaccgtcgcacag

SEQ ID NO: 2051 - DNA, 33 bp, Artificial Sequence
  Synthetic Construct
gcccaactcgccaacgccgtcaccaaagcacag

SEQ ID NO: 2052 - DNA, 33 bp, Artificial Sequence
  Synthetic Construct
gcccaaaccggccacgtccacgaaaacgcacag

SEQ ID NO: 2053 - DNA, 33 bp, Artificial Sequence
  Synthetic Construct
gcccaatcgatttcggatacggcttctgcacag

SEQ ID NO: 2054 - DNA, 33 bp, Artificial Sequence
  Synthetic Construct
gcccaacccgtcgtccaaagcgtcggcgcacag

SEQ ID NO: 2055 - DNA, 33 bp, Artificial Sequence
  Synthetic Construct
gcccaacaacacctcagcaccgtcaacgcacag

SEQ ID NO: 2056 - DNA, 33 bp, Artificial Sequence
  Synthetic Construct
gcccaactgagtcataatacgacgcatgcacag

SEQ ID NO: 2057 - DNA, 33 bp, Artificial Sequence
  Synthetic Construct
gcccaaccttcgaatttttcgaattctgcacag

SEQ ID NO: 2058 - DNA, 33 bp, Artificial Sequence
  Synthetic Construct
gcccaatttgataagtctgttcctagtgcacag

SEQ ID NO: 2059 - DNA, 33 bp, Artificial Sequence
  Synthetic Construct
gcccaaacccaagccaccgaaaaagacgcacag

SEQ ID NO: 2060 - DNA, 33 bp, Artificial Sequence
  Synthetic Construct
gcccaattgagtgcgaaggctagtcaggcacag

SEQ ID NO: 2061 - DNA, 33 bp, Artificial Sequence
  Synthetic Construct
gcccaatcggttcagcctgcggtgtcggcacag

SEQ ID NO: 2062 - DNA, 33 bp, Artificial Sequence
  Synthetic Construct
gcccaaagtttgatgcatgggacgcctgcacag

SEQ ID NO: 2063 - DNA, 33 bp, Artificial Sequence
  Synthetic Construct
gcccaacccaccatcagaaccaacaccgcacag

SEQ ID NO: 2064 - DNA, 33 bp, Artificial Sequence
  Synthetic Construct
gcccaaaatgattcgcttaaggttaatgcacag

SEQ ID NO: 2065 - DNA, 33 bp, Artificial Sequence
  Synthetic Construct
gcccaaagcacccaacccgtcaacagagcacag

SEQ ID NO: 2066 - DNA, 33 bp, Artificial Sequence
  Synthetic Construct
gcccaatcttcggataagcataatcctgcacag

SEQ ID NO: 2067 - DNA, 33 bp, Artificial Sequence
  Synthetic Construct
gcccaattcctcgaaaacgccaaaatcgcacag

SEQ ID NO: 2068 - DNA, 33 bp, Artificial Sequence
  Synthetic Construct
gcccaagtgtctactggtactcttaaggcacag

SEQ ID NO: 2069 - DNA, 33 bp, Artificial Sequence
  Synthetic Construct
gcccaacgtgatgcgtctttgagtactgcacag

SEQ ID NO: 2070 - DNA, 33 bp, Artificial Sequence
  Synthetic Construct
gcccaaaagggtactgagattaagcttgcacag

SEQ ID NO: 2071 - DNA, 33 bp, Artificial Sequence
  Synthetic Construct
gcccaaattatgaatcagctgggtgatgcacag

SEQ ID NO: 2072 - DNA, 33 bp, Artificial Sequence
  Synthetic Construct
gcccaacctagtaataatactcagattgcacag

SEQ ID NO: 2073 - DNA, 33 bp, Artificial Sequence
  Synthetic Construct
gcccaaacttcgagtagtattacgactgcacag

SEQ ID NO: 2074 - DNA, 33 bp, Artificial Sequence
  Synthetic Construct
gcccaaagggatctgaatgcgcataatgcacag

SEQ ID NO: 2075 - DNA, 33 bp, Artificial Sequence
  Synthetic Construct
gcccaaaccggcttcgccagaagcgaagcacag

SEQ ID NO: 2076 - DNA, 33 bp, Artificial Sequence
  Synthetic Construct
gcccaactcgaacaactcgcccccaaagcacag

SEQ ID NO: 2077 - DNA, 33 bp, Artificial Sequence
  Synthetic Construct
gcccaagccgccatgcaaagcgaaagagcacag

SEQ ID NO: 2078 - DNA, 33 bp, Artificial Sequence
  Synthetic Construct
gcccaacagcttaattatgaggcgcatgcacag

SEQ ID NO: 2079 - DNA, 33 bp, Artificial Sequence
  Synthetic Construct
gcccaagccaaccccggcagcctcctcgcacag

SEQ ID NO: 2080 - DNA, 33 bp, Artificial Sequence
  Synthetic Construct
gcccaacttaggcatattgagacgcctgcacag

SEQ ID NO: 2081 - DNA, 33 bp, Artificial Sequence
  Synthetic Construct
gcccaacttcctcagaattcggcgaaggcacag

SEQ ID NO: 2082 - DNA, 33 bp, Artificial Sequence
  Synthetic Construct
gcccaagccggcagccccatcagcagagcacag

SEQ ID NO: 2083 - DNA, 33 bp, Artificial Sequence
  Synthetic Construct
gcccaaagagccaccaacgtcgaagtcgcacag

SEQ ID NO: 2084 - DNA, 33 bp, Artificial Sequence
  Synthetic Construct
gcccaaccccaacccaacaacagaggcgcacag

SEQ ID NO: 2085 - DNA, 33 bp, Artificial Sequence
  Synthetic Construct
gcccaatctccttcgacgcctcatcttgcacag

SEQ ID NO: 2086 - DNA, 33 bp, Artificial Sequence
  Synthetic Construct
gcccaactttcgaatactttgactaatgcacag

SEQ ID NO: 2087 - DNA, 33 bp, Artificial Sequence
  Synthetic Construct
gcccaatcgaatagggagggtttgatggcacag

SEQ ID NO: 2088 - DNA, 33 bp, Artificial Sequence
  Synthetic Construct
gcccaagtcgcccacagcccccccagcgcacag

SEQ ID NO: 2089 - DNA, 33 bp, Artificial Sequence
  Synthetic Construct
gcccaaagcgtcaaaaacatgctcaccgcacag

SEQ ID NO: 2090 - DNA, 33 bp, Artificial Sequence
  Synthetic Construct
gcccaagggctttcgactggtcttgctgcacag

SEQ ID NO: 2091 - DNA, 33 bp, Artificial Sequence
  Synthetic Construct
gcccaagccatgagcagacccgaactcgcacag

SEQ ID NO: 2092 - DNA, 33 bp, Artificial Sequence
  Synthetic Construct
gcccaagccatggacctcaaactccaagcacag

SEQ ID NO: 2093 - DNA, 33 bp, Artificial Sequence
  Synthetic Construct
gcccaagccgtcgccggccccaccaaagcacag

SEQ ID NO: 2094 - DNA, 33 bp, Artificial Sequence
  Synthetic Construct
gcccaacctactcttgggtcgcgtactgcacag

SEQ ID NO: 2095 - DNA, 33 bp, Artificial Sequence
  Synthetic Construct
gcccaaagtgagaatcctattgatccggcacag

SEQ ID NO: 2096 - DNA, 33 bp, Artificial Sequence
  Synthetic Construct
gcccaaaccaacaacagccccggcaccgcacag

SEQ ID NO: 2097 - DNA, 33 bp, Artificial Sequence
  Synthetic Construct
gcccaacacaccagccccaccagcctcgcacag

SEQ ID NO: 2098 - DNA, 33 bp, Artificial Sequence
  Synthetic Construct
gcccaaaacaacgccggcatcagcatggcacag

SEQ ID NO: 2099 - DNA, 33 bp, Artificial Sequence
  Synthetic Construct
gcccaactcgtctacagcaacaacaccgcacag

SEQ ID NO: 2100 - DNA, 33 bp, Artificial Sequence
  Synthetic Construct
gcccaaccggcgagtcagtctacgactgcacag

SEQ ID NO: 2101 - DNA, 33 bp, Artificial Sequence
  Synthetic Construct
gcccaagttcaggttgggcatcctcttgcacag

SEQ ID NO: 2102 - DNA, 33 bp, Artificial Sequence
  Synthetic Construct
gcccaagacgccagctacaccggcaccgcacag

SEQ ID NO: 2103 - DNA, 33 bp, Artificial Sequence
  Synthetic Construct
gcccaagggattactactgaggcgcgggcacag

SEQ ID NO: 2104 - DNA, 33 bp, Artificial Sequence
  Synthetic Construct
gcccaatctatgcctcagcatgctattgcacag

SEQ ID NO: 2105 - DNA, 33 bp, Artificial Sequence
  Synthetic Construct
gcccaactccaaagcgccctccaaaacgcacag

SEQ ID NO: 2106 - DNA, 33 bp, Artificial Sequence
  Synthetic Construct
gcccaaaaaagcagcgacagcaccagcgcacag

SEQ ID NO: 2107 - DNA, 33 bp, Artificial Sequence
  Synthetic Construct
gcccaaaaaagccccgccggcgccctcgcacag

SEQ ID NO: 2108 - DNA, 33 bp, Artificial Sequence
  Synthetic Construct
gcccaaaccgaaatgagcctcaccagcgcacag

SEQ ID NO: 2109 - DNA, 33 bp, Artificial Sequence
  Synthetic Construct
gcccaattgaatagtgagacttttcctgcacag

SEQ ID NO: 2110 - DNA, 33 bp, Artificial Sequence
  Synthetic Construct
gcccaaagcgccctcagccaacaatacgcacag

SEQ ID NO: 2111 - DNA, 33 bp, Artificial Sequence
  Synthetic Construct
gcccaacgttcggtggctaatgtgccggcacag

SEQ ID NO: 2112 - DNA, 33 bp, Artificial Sequence
  Synthetic Construct
gcccaaagcagcggcgccaccctccaagcacag

SEQ ID NO: 2113 - DNA, 33 bp, Artificial Sequence
  Synthetic Construct
gcccaactcaacggcggcgccgccagcgcacag

SEQ ID NO: 2114 - DNA, 33 bp, Artificial Sequence
  Synthetic Construct
gcccaaagccaccaaaccacccccaccgcacag

SEQ ID NO: 2115 - DNA, 33 bp, Artificial Sequence
  Synthetic Construct
gcccaatatgagaatagtagtagtttggcacag

SEQ ID NO: 2116 - DNA, 33 bp, Artificial Sequence
  Synthetic Construct
gcccaaattcagacttctgctcatactgcacag

SEQ ID NO: 2117 - DNA, 33 bp, Artificial Sequence
  Synthetic Construct
gcccaaagagaaatccaaaaaatgagcgcacag

SEQ ID NO: 2118 - DNA, 33 bp, Artificial Sequence
  Synthetic Construct
gcccaaagcgccggcatgatcagccacgcacag

SEQ ID NO: 2119 - DNA, 33 bp, Artificial Sequence
  Synthetic Construct
gcccaaatgagaagcaccgacagcgaagcacag

SEQ ID NO: 2120 - DNA, 33 bp, Artificial Sequence
  Synthetic Construct
gcccaaagccacccccaaggcgacagcgcacag

SEQ ID NO: 2121 - DNA, 33 bp, Artificial Sequence
  Synthetic Construct
gcccaactcatcgacaccaaaatcagcgcacag

SEQ ID NO: 2122 - DNA, 33 bp, Artificial Sequence
  Synthetic Construct
gcccaaacccacctcaaagacctcctcgcacag

SEQ ID NO: 2123 - DNA, 33 bp, Artificial Sequence
  Synthetic Construct
gcccaaggtacttcgagtgtgctgattgcacag

SEQ ID NO: 2124 - DNA, 33 bp, Artificial Sequence
  Synthetic Construct
gcccaacctttggttacgaatgagcctgcacag

SEQ ID NO: 2125 - DNA, 33 bp, Artificial Sequence
  Synthetic Construct
gcccaaagagacctcagccacaacagcgcacag

SEQ ID NO: 2126 - DNA, 33 bp, Artificial Sequence
  Synthetic Construct
gcccaatatgataatgagcataggccggcacag

SEQ ID NO: 2127 - DNA, 33 bp, Artificial Sequence
  Synthetic Construct
gcccaagttgggagtcatactatgacggcacag

SEQ ID NO: 2128 - DNA, 33 bp, Artificial Sequence
  Synthetic Construct
gcccaagggcatacgagtgtgtctctggcacag

SEQ ID NO: 2129 - DNA, 33 bp, Artificial Sequence
  Synthetic Construct
gcccaactcgacctcaaaaaccaaagagcacag

SEQ ID NO: 2130 - DNA, 33 bp, Artificial Sequence
  Synthetic Construct
gcccaacccgtcgccaaaatcaccagcgcacag

SEQ ID NO: 2131 - DNA, 33 bp, Artificial Sequence
  Synthetic Construct
gcccaacttgagaatgggaagcctaaggcacag

SEQ ID NO: 2132 - DNA, 33 bp, Artificial Sequence
  Synthetic Construct
gcccaagacctcgccagagccaccctcgcacag

SEQ ID NO: 2133 - DNA, 33 bp, Artificial Sequence
  Synthetic Construct
gcccaaaaggttcgtgatgataagcctgcacag

SEQ ID NO: 2134 - DNA, 33 bp, Artificial Sequence
  Synthetic Construct
gcccaacacaacgtcgccatcacccccgcacag

SEQ ID NO: 2135 - DNA, 33 bp, Artificial Sequence
  Synthetic Construct
gcccaaaccttcaacgccacctacgccgcacag

SEQ ID NO: 2136 - DNA, 33 bp, Artificial Sequence
  Synthetic Construct
gcccaaggcagccaaggcaccatcagagcacag

SEQ ID NO: 2137 - DNA, 33 bp, Artificial Sequence
  Synthetic Construct
gcccaaagcctcggccacgacgccagagcacag

SEQ ID NO: 2138 - DNA, 33 bp, Artificial Sequence
  Synthetic Construct
gcccaacgtagtgggccggattcttctgcacag

SEQ ID NO: 2139 - DNA, 33 bp, Artificial Sequence
  Synthetic Construct
gcccaagctatgaatcttcagaatttggcacag

SEQ ID NO: 2140 - DNA, 33 bp, Artificial Sequence
  Synthetic Construct
gcccaacttcgggctggtccgggtgtggcacag

SEQ ID NO: 2141 - DNA, 33 bp, Artificial Sequence
  Synthetic Construct
gcccaaaccgtcatgagcagcagcagcgcacag

SEQ ID NO: 2142 - DNA, 33 bp, Artificial Sequence
  Synthetic Construct
gcccaacatacttctcctgtgggttatgcacag

SEQ ID NO: 2143 - DNA, 33 bp, Artificial Sequence
  Synthetic Construct
gcccaatggacttctcaggctacggcggcacag

SEQ ID NO: 2144 - DNA, 33 bp, Artificial Sequence
  Synthetic Construct
gcccaaacgatgaattctgttcctcgtgcacag

SEQ ID NO: 2145 - DNA, 33 bp, Artificial Sequence
  Synthetic Construct
gcccaagtcaacggcggcatggtcaacgcacag

SEQ ID NO: 2146 - DNA, 33 bp, Artificial Sequence
  Synthetic Construct
gcccaaactaatgctaggatgaatactgcacag

SEQ ID NO: 2147 - DNA, 33 bp, Artificial Sequence
  Synthetic Construct
gcccaaatcagcggcaacatgcacagcgcacag

SEQ ID NO: 2148 - DNA, 33 bp, Artificial Sequence
  Synthetic Construct
gcccaaagcgtcggcggcgccagcttcgcacag

SEQ ID NO: 2149 - DNA, 33 bp, Artificial Sequence
  Synthetic Construct
gcccaaaccagcgaaagcccctacaaagcacag

SEQ ID NO: 2150 - DNA, 33 bp, Artificial Sequence
  Synthetic Construct
gcccaaggtcattttggtactatgtcggcacag

SEQ ID NO: 2151 - DNA, 33 bp, Artificial Sequence
  Synthetic Construct
gcccaacttacgactagtggtctgaaggcacag

SEQ ID NO: 2152 - DNA, 33 bp, Artificial Sequence
  Synthetic Construct
gcccaaaggattaattcgtctacgtatgcacag

SEQ ID NO: 2153 - DNA, 33 bp, Artificial Sequence
  Synthetic Construct
gcccaactgactggtagttcgttgactgcacag

SEQ ID NO: 2154 - DNA, 33 bp, Artificial Sequence
  Synthetic Construct
gcccaaccgattcggggtactatttatgcacag

SEQ ID NO: 2155 - DNA, 33 bp, Artificial Sequence
  Synthetic Construct
gcccaaaccaccagcaacaacacccacgcacag

SEQ ID NO: 2156 - DNA, 33 bp, Artificial Sequence
  Synthetic Construct
gcccaacaggtgactactaatttggatgcacag

SEQ ID NO: 2157 - DNA, 33 bp, Artificial Sequence
  Synthetic Construct
gcccaagctttggattctagtgagccggcacag

SEQ ID NO: 2158 - DNA, 33 bp, Artificial Sequence
  Synthetic Construct
gcccaataccccaaaaacgtcgcctgggcacag

SEQ ID NO: 2159 - DNA, 33 bp, Artificial Sequence
  Synthetic Construct
gcccaatctactactgggcggaatctggcacag

SEQ ID NO: 2160 - DNA, 33 bp, Artificial Sequence
  Synthetic Construct
gcccaaacgaagcttatgcagtctaatgcacag

SEQ ID NO: 2161 - DNA, 33 bp, Artificial Sequence
  Synthetic Construct
gcccaaaacagctacggcgacgccgccgcacag

SEQ ID NO: 2162 - DNA, 33 bp, Artificial Sequence
  Synthetic Construct
gcccaagagcatacgggtgcgcctgctgcacag

SEQ ID NO: 2163 - DNA, 33 bp, Artificial Sequence
  Synthetic Construct
gcccaactgcggactgagacggcgaatgcacag

SEQ ID NO: 2164 - DNA, 33 bp, Artificial Sequence
  Synthetic Construct
gcccaagtcctcgacgtcaacaccctcgcacag

SEQ ID NO: 2165 - DNA, 33 bp, Artificial Sequence
  Synthetic Construct
gcccaagacagaggcaacgacaaactcgcacag

SEQ ID NO: 2166 - DNA, 33 bp, Artificial Sequence
  Synthetic Construct
gcccaaagcttcaccaacagcacccacgcacag

SEQ ID NO: 2167 - DNA, 33 bp, Artificial Sequence
  Synthetic Construct
gcccaactcgcccacagcagcctcagcgcacag

SEQ ID NO: 2168 - DNA, 33 bp, Artificial Sequence
  Synthetic Construct
gcccaaagactcgtcgaccccatccccgcacag

SEQ ID NO: 2169 - DNA, 33 bp, Artificial Sequence
  Synthetic Construct
gcccaatggggcgacaaagaaaccttcgcacag

SEQ ID NO: 2170 - DNA, 33 bp, Artificial Sequence
  Synthetic Construct
gcccaaagagacgacaacctcagcaccgcacag

SEQ ID NO: 2171 - DNA, 33 bp, Artificial Sequence
  Synthetic Construct
gcccaatctaagcagttgattgatactgcacag

SEQ ID NO: 2172 - DNA, 33 bp, Artificial Sequence
  Synthetic Construct
gcccaatttcagaatcagactgttggtgcacag

SEQ ID NO: 2173 - DNA, 33 bp, Artificial Sequence
  Synthetic Construct
gcccaagtcttcagcagcgacagcctcgcacag

SEQ ID NO: 2174 - DNA, 33 bp, Artificial Sequence
  Synthetic Construct
gcccaatatgcgcagcagttgcctgtggcacag

SEQ ID NO: 2175 - DNA, 33 bp, Artificial Sequence
  Synthetic Construct
gcccaaattgtgactggtactacgcaggcacag

SEQ ID NO: 2176 - DNA, 33 bp, Artificial Sequence
  Synthetic Construct
gcccaaagcaaaatcaccgaaagcaacgcacag

SEQ ID NO: 2177 - DNA, 33 bp, Artificial Sequence
  Synthetic Construct
gcccaaattgctgggcaggtgggggcggcacag

SEQ ID NO: 2178 - DNA, 33 bp, Artificial Sequence
  Synthetic Construct
gcccaaggttatagtcagacgcctcatgcacag

SEQ ID NO: 2179 - DNA, 33 bp, Artificial Sequence
  Synthetic Construct
gcccaaggtttggcgttgcgtcctgatgcacag

SEQ ID NO: 2180 - DNA, 33 bp, Artificial Sequence
  Synthetic Construct
gcccaaaacgccgtcagcaacaacaccgcacag

SEQ ID NO: 2181 - DNA, 33 bp, Artificial Sequence
  Synthetic Construct
gcccaaaaccaaagcaccctccccaccgcacag

SEQ ID NO: 2182 - DNA, 33 bp, Artificial Sequence
  Synthetic Construct
gcccaaaccagcatccccgacaaacccgcacag

SEQ ID NO: 2183 - DNA, 33 bp, Artificial Sequence
  Synthetic Construct
gcccaaggcagcagcaccgccagcctcgcacag

SEQ ID NO: 2184 - DNA, 33 bp, Artificial Sequence
  Synthetic Construct
gcccaaagaatcatcggcaccgccaccgcacag

SEQ ID NO: 2185 - DNA, 33 bp, Artificial Sequence
  Synthetic Construct
gcccaaagtttgaatgggggtcggacggcacag

SEQ ID NO: 2186 - DNA, 33 bp, Artificial Sequence
  Synthetic Construct
gcccaaccggtgaagactgttgggattgcacag

SEQ ID NO: 2187 - DNA, 33 bp, Artificial Sequence
  Synthetic Construct
gcccaacagccgtctgcgattccgaatgcacag

SEQ ID NO: 2188 - DNA, 33 bp, Artificial Sequence
  Synthetic Construct
gcccaattcgccagcagcgtcagcgccgcacag

SEQ ID NO: 2189 - DNA, 33 bp, Artificial Sequence
  Synthetic Construct
gcccaagaaggcaacctcaccaaactcgcacag

SEQ ID NO: 2190 - DNA, 33 bp, Artificial Sequence
  Synthetic Construct
gcccaattggggactaggactacttctgcacag

SEQ ID NO: 2191 - DNA, 33 bp, Artificial Sequence
  Synthetic Construct
gcccaaactcatcgtgatttttctcctgcacag

SEQ ID NO: 2192 - DNA, 33 bp, Artificial Sequence
  Synthetic Construct
gcccaaaccggcgtcagcaccggcgtcgcacag

SEQ ID NO: 2193 - DNA, 33 bp, Artificial Sequence
  Synthetic Construct
gcccaagtgccgaataattcgcagcgggcacag

SEQ ID NO: 2194 - DNA, 33 bp, Artificial Sequence
  Synthetic Construct
gcccaaatgcccagcggcgtccccgtcgcacag

SEQ ID NO: 2195 - DNA, 33 bp, Artificial Sequence
  Synthetic Construct
gcccaaaacgccctccccagacccaacgcacag

SEQ ID NO: 2196 - DNA, 33 bp, Artificial Sequence
  Synthetic Construct
gcccaacggacggatcattctcagattgcacag

SEQ ID NO: 2197 - DNA, 33 bp, Artificial Sequence
  Synthetic Construct
gcccaacaaaccctcaaaagcgcctacgcacag

SEQ ID NO: 2198 - DNA, 33 bp, Artificial Sequence
  Synthetic Construct
gcccaaaaggaggagcatacgcggggggcacag

SEQ ID NO: 2199 - DNA, 33 bp, Artificial Sequence
  Synthetic Construct
gcccaactccccgccgcccccagatacgcacag

SEQ ID NO: 2200 - DNA, 33 bp, Artificial Sequence
  Synthetic Construct
gcccaactggataaggcgcattttgctgcacag

SEQ ID NO: 2201 - DNA, 33 bp, Artificial Sequence
  Synthetic Construct
gcccaacacgccatcgacgccgtcaaagcacag

SEQ ID NO: 2202 - DNA, 33 bp, Artificial Sequence
  Synthetic Construct
gcccaaccgattcttacggctgtgccggcacag

SEQ ID NO: 2203 - DNA, 33 bp, Artificial Sequence
  Synthetic Construct
gcccaaaccgtccaacaaagcgccatggcacag

SEQ ID NO: 2204 - DNA, 33 bp, Artificial Sequence
  Synthetic Construct
gcccaatcggaggggattggtggtcgtgcacag

SEQ ID NO: 2205 - DNA, 33 bp, Artificial Sequence
  Synthetic Construct
gcccaaatgggttctactgttactcgtgcacag

SEQ ID NO: 2206 - DNA, 33 bp, Artificial Sequence
  Synthetic Construct
gcccaaagcgtcagaagccccaccaaagcacag

SEQ ID NO: 2207 - DNA, 33 bp, Artificial Sequence
  Synthetic Construct
gcccaaactacgcgtgatgttactacggcacag

SEQ ID NO: 2208 - DNA, 33 bp, Artificial Sequence
  Synthetic Construct
gcccaatcggcggctgggaagacttatgcacag

SEQ ID NO: 2209 - DNA, 33 bp, Artificial Sequence
  Synthetic Construct
gcccaaacgacgccgagtactgttcgtgcacag

SEQ ID NO: 2210 - DNA, 33 bp, Artificial Sequence
  Synthetic Construct
gcccaagttgctctgacgacgacggttgcacag

SEQ ID NO: 2211 - DNA, 33 bp, Artificial Sequence
  Synthetic Construct
gcccaagatacgcagcttccgctgagtgcacag

SEQ ID NO: 2212 - DNA, 33 bp, Artificial Sequence
  Synthetic Construct
gcccaaaacgccgtcagcaaccccctcgcacag

SEQ ID NO: 2213 - DNA, 33 bp, Artificial Sequence
  Synthetic Construct
gcccaaatggaactcaaataccaaagagcacag

SEQ ID NO: 2214 - DNA, 33 bp, Artificial Sequence
  Synthetic Construct
gcccaaaacagcctccacggccacgccgcacag

SEQ ID NO: 2215 - DNA, 33 bp, Artificial Sequence
  Synthetic Construct
gcccaacacagccccagcctcagcgacgcacag

SEQ ID NO: 2216 - DNA, 33 bp, Artificial Sequence
  Synthetic Construct
gcccaaggcagcgtcaccagcctcggcgcacag

SEQ ID NO: 2217 - DNA, 33 bp, Artificial Sequence
  Synthetic Construct
gcccaaagagaagtcagcagcaccaccgcacag

SEQ ID NO: 2218 - DNA, 33 bp, Artificial Sequence
  Synthetic Construct
gcccaaggtaaggcgacgcttgatactgcacag

SEQ ID NO: 2219 - DNA, 33 bp, Artificial Sequence
  Synthetic Construct
gcccaacttaatcctcctttgaataatgcacag

SEQ ID NO: 2220 - DNA, 33 bp, Artificial Sequence
  Synthetic Construct
gcccaaacttctgggcattcgccgtcggcacag

SEQ ID NO: 2221 - DNA, 33 bp, Artificial Sequence
  Synthetic Construct
gcccaagacgtcaccgccaccgcccccgcacag

SEQ ID NO: 2222 - DNA, 33 bp, Artificial Sequence
  Synthetic Construct
gcccaacaccaaaacaccggcagcgtcgcacag

SEQ ID NO: 2223 - DNA, 33 bp, Artificial Sequence
  Synthetic Construct
gcccaagatcttacgcatacttttgatgcacag

SEQ ID NO: 2224 - DNA, 33 bp, Artificial Sequence
  Synthetic Construct
gcccaatacctccccaacaaagaaagagcacag

SEQ ID NO: 2225 - DNA, 33 bp, Artificial Sequence
  Synthetic Construct
gcccaagtggatggtacgtatacggtggcacag

SEQ ID NO: 2226 - DNA, 33 bp, Artificial Sequence
  Synthetic Construct
gcccaatacctcaccagcggcggctacgcacag

SEQ ID NO: 2227 - DNA, 33 bp, Artificial Sequence
  Synthetic Construct
gcccaagccagcctcgtcgtcgtcgccgcacag

SEQ ID NO: 2228 - DNA, 33 bp, Artificial Sequence
  Synthetic Construct
gcccaatttgatgctaattcgaagattgcacag

SEQ ID NO: 2229 - DNA, 33 bp, Artificial Sequence
  Synthetic Construct
gcccaatacctcaccgaaagccccggcgcacag

SEQ ID NO: 2230 - DNA, 33 bp, Artificial Sequence
  Synthetic Construct
gcccaaagaaacgccagcctcgaccccgcacag

SEQ ID NO: 2231 - DNA, 33 bp, Artificial Sequence
  Synthetic Construct
gcccaagcggggagtcctcgtgcgggtgcacag

SEQ ID NO: 2232 - DNA, 33 bp, Artificial Sequence
  Synthetic Construct
gcccaaagagtcgaaaaactcacccccgcacag

SEQ ID NO: 2233 - DNA, 33 bp, Artificial Sequence
  Synthetic Construct
gcccaaagaaccaccggcgacaacaccgcacag

SEQ ID NO: 2234 - DNA, 33 bp, Artificial Sequence
  Synthetic Construct
gcccaacccgccgccaccagcggcttcgcacag

SEQ ID NO: 2235 - DNA, 33 bp, Artificial Sequence
  Synthetic Construct
gcccaaattcttacgattcatacgcatgcacag

SEQ ID NO: 2236 - DNA, 33 bp, Artificial Sequence
  Synthetic Construct
gcccaaatcaacatcagcagccacgtcgcacag

SEQ ID NO: 2237 - DNA, 33 bp, Artificial Sequence
  Synthetic Construct
gcccaacccagcggcagcgccagaagcgcacag

SEQ ID NO: 2238 - DNA, 33 bp, Artificial Sequence
  Synthetic Construct
gcccaaagtacgatgccgactaggctggcacag

SEQ ID NO: 2239 - DNA, 33 bp, Artificial Sequence
  Synthetic Construct
gcccaactctacgccagcgccggcgtcgcacag

SEQ ID NO: 2240 - DNA, 33 bp, Artificial Sequence
  Synthetic Construct
gcccaattggttcagacggggctgctggcacag

SEQ ID NO: 2241 - DNA, 33 bp, Artificial Sequence
  Synthetic Construct
gcccaagtcagcctcaacagaaccgaagcacag

SEQ ID NO: 2242 - DNA, 33 bp, Artificial Sequence
  Synthetic Construct
gcccaaggtgggagggagagttctttggcacag

SEQ ID NO: 2243 - DNA, 33 bp, Artificial Sequence
  Synthetic Construct
gcccaagtggagaggatgccgaggatggcacag

SEQ ID NO: 2244 - DNA, 33 bp, Artificial Sequence
  Synthetic Construct
gcccaaccccaaatcggcatccccgacgcacag

SEQ ID NO: 2245 - DNA, 33 bp, Artificial Sequence
  Synthetic Construct
gcccaagctacggtgaagtcgagtactgcacag

SEQ ID NO: 2246 - DNA, 33 bp, Artificial Sequence
  Synthetic Construct
gcccaaggcggcaacgtccaagccatcgcacag

SEQ ID NO: 2247 - DNA, 33 bp, Artificial Sequence
  Synthetic Construct
gcccaaactattgttaatgttactagtgcacag

SEQ ID NO: 2248 - DNA, 33 bp, Artificial Sequence
  Synthetic Construct
gcccaaggcgaccccgcccaaagcagcgcacag

SEQ ID NO: 2249 - DNA, 33 bp, Artificial Sequence
  Synthetic Construct
gcccaaactaagaatactgattttcaggcacag

SEQ ID NO: 2250 - DNA, 33 bp, Artificial Sequence
  Synthetic Construct
gcccaaagacacaccgacgccgtcatcgcacag

SEQ ID NO: 2251 - DNA, 33 bp, Artificial Sequence
  Synthetic Construct
gcccaaagcgtccacaccgccgtcagagcacag

SEQ ID NO: 2252 - DNA, 33 bp, Artificial Sequence
  Synthetic Construct
gcccaaatcaccagcctcatgagcggcgcacag

SEQ ID NO: 2253 - DNA, 33 bp, Artificial Sequence
  Synthetic Construct
gcccaagaccacaaccaaatcagcctcgcacag

SEQ ID NO: 2254 - DNA, 33 bp, Artificial Sequence
  Synthetic Construct
gcccaacaaggccaaagcgccctcaaagcacag

SEQ ID NO: 2255 - DNA, 33 bp, Artificial Sequence
  Synthetic Construct
gcccaaaacaacgccaccagatacaccgcacag

SEQ ID NO: 2256 - DNA, 33 bp, Artificial Sequence
  Synthetic Construct
gcccaatcgcgtaatacgacttcgtgggcacag

SEQ ID NO: 2257 - DNA, 33 bp, Artificial Sequence
  Synthetic Construct
gcccaacctagtaattcgaagctgattgcacag

SEQ ID NO: 2258 - DNA, 33 bp, Artificial Sequence
  Synthetic Construct
gcccaaaaaaccgtcagcctcaacgacgcacag

SEQ ID NO: 2259 - DNA, 33 bp, Artificial Sequence
  Synthetic Construct
gcccaaacccccctccccagagtcagcgcacag

SEQ ID NO: 2260 - DNA, 33 bp, Artificial Sequence
  Synthetic Construct
gcccaacagactattgcgagtgctttggcacag

SEQ ID NO: 2261 - DNA, 33 bp, Artificial Sequence
  Synthetic Construct
gcccaacctattatgaagacgacggttgcacag

SEQ ID NO: 2262 - DNA, 33 bp, Artificial Sequence
  Synthetic Construct
gcccaaagtgcggttattcaggggcatgcacag

SEQ ID NO: 2263 - DNA, 33 bp, Artificial Sequence
  Synthetic Construct
gcccaaccgctgtatggtacgatgtctgcacag

SEQ ID NO: 2264 - DNA, 33 bp, Artificial Sequence
  Synthetic Construct
gcccaagcgaatcggactaaggattatgcacag

SEQ ID NO: 2265 - DNA, 33 bp, Artificial Sequence
  Synthetic Construct
gcccaagttattccgcagacggagagggcacag

SEQ ID NO: 2266 - DNA, 33 bp, Artificial Sequence
  Synthetic Construct
gcccaaatcgtcaacggccacatcagagcacag

SEQ ID NO: 2267 - DNA, 33 bp, Artificial Sequence
  Synthetic Construct
gcccaaagcagacccaacgaaaccaccgcacag

SEQ ID NO: 2268 - DNA, 33 bp, Artificial Sequence
  Synthetic Construct
gcccaagggtatactccggtttcgagggcacag

SEQ ID NO: 2269 - DNA, 33 bp, Artificial Sequence
  Synthetic Construct
gcccaacctctgcagaggactattggggcacag

SEQ ID NO: 2270 - DNA, 33 bp, Artificial Sequence
  Synthetic Construct
gcccaaagcaccggcagccccaccatcgcacag

SEQ ID NO: 2271 - DNA, 33 bp, Artificial Sequence
  Synthetic Construct
gcccaaagtactatgacggggctgattgcacag

SEQ ID NO: 2272 - DNA, 33 bp, Artificial Sequence
  Synthetic Construct
gcccaaatccacgccgtcggcgccgaagcacag

SEQ ID NO: 2273 - DNA, 33 bp, Artificial Sequence
  Synthetic Construct
gcccaaaccgccaacgtcagcgaactcgcacag

SEQ ID NO: 2274 - DNA, 33 bp, Artificial Sequence
  Synthetic Construct
gcccaaaacaaaagcgacatgccccacgcacag

SEQ ID NO: 2275 - DNA, 33 bp, Artificial Sequence
  Synthetic Construct
gcccaaagcaactacaacacccacgacgcacag

SEQ ID NO: 2276 - DNA, 33 bp, Artificial Sequence
  Synthetic Construct
gcccaaccgagtgttactcatcatccggcacag

SEQ ID NO: 2277 - DNA, 33 bp, Artificial Sequence
  Synthetic Construct
gcccaaaatttgagtcttaagccgctggcacag

SEQ ID NO: 2278 - DNA, 33 bp, Artificial Sequence
  Synthetic Construct
gcccaactttattcgaataagagtaatgcacag

SEQ ID NO: 2279 - DNA, 33 bp, Artificial Sequence
  Synthetic Construct
gcccaagataatggtctggttcatagggcacag

SEQ ID NO: 2280 - DNA, 33 bp, Artificial Sequence
  Synthetic Construct
gcccaaatgggcaccctcaccatcagcgcacag

SEQ ID NO: 2281 - DNA, 33 bp, Artificial Sequence
  Synthetic Construct
gcccaaacttttcagtctgatgagagggcacag

SEQ ID NO: 2282 - DNA, 33 bp, Artificial Sequence
  Synthetic Construct
gcccaaatcgtcaccggcgcctacagagcacag

SEQ ID NO: 2283 - DNA, 33 bp, Artificial Sequence
  Synthetic Construct
gcccaaaccgtcgtcaaccccagcagcgcacag

SEQ ID NO: 2284 - DNA, 33 bp, Artificial Sequence
  Synthetic Construct
gcccaagataataatgttaggcatacggcacag

SEQ ID NO: 2285 - DNA, 33 bp, Artificial Sequence
  Synthetic Construct
gcccaagatcgttcgcagaattcgttggcacag

SEQ ID NO: 2286 - DNA, 33 bp, Artificial Sequence
  Synthetic Construct
gcccaacatcctcctgtgccggcgtctgcacag

SEQ ID NO: 2287 - DNA, 33 bp, Artificial Sequence
  Synthetic Construct
gcccaaaaatacatcacccccagcagcgcacag

SEQ ID NO: 2288 - DNA, 33 bp, Artificial Sequence
  Synthetic Construct
gcccaagtgccggataagcaggcgatggcacag

SEQ ID NO: 2289 - DNA, 33 bp, Artificial Sequence
  Synthetic Construct
gcccaagttattgcgaagactgagtatgcacag

SEQ ID NO: 2290 - DNA, 33 bp, Artificial Sequence
  Synthetic Construct
gcccaaggggggcaggcggaggcgcgggcacag

SEQ ID NO: 2291 - DNA, 33 bp, Artificial Sequence
  Synthetic Construct
gcccaacaacccgtcctcaaccaacccgcacag

SEQ ID NO: 2292 - DNA, 33 bp, Artificial Sequence
  Synthetic Construct
gcccaaaataatactaatgagaatcttgcacag

SEQ ID NO: 2293 - DNA, 33 bp, Artificial Sequence
  Synthetic Construct
gcccaaactaatctgtctctgtcgtcggcacag

SEQ ID NO: 2294 - DNA, 33 bp, Artificial Sequence
  Synthetic Construct
gcccaaggtcagtcgagtgatgagcgggcacag

SEQ ID NO: 2295 - DNA, 33 bp, Artificial Sequence
  Synthetic Construct
gcccaaacccacgccaccaccttcgccgcacag

SEQ ID NO: 2296 - DNA, 33 bp, Artificial Sequence
  Synthetic Construct
gcccaaaccagccaacaagacagaagcgcacag

SEQ ID NO: 2297 - DNA, 33 bp, Artificial Sequence
  Synthetic Construct
gcccaagcgttgttgcatcgtgaggcggcacag

SEQ ID NO: 2298 - DNA, 33 bp, Artificial Sequence
  Synthetic Construct
gcccaaaatccgagtgttactgctcttgcacag

SEQ ID NO: 2299 - DNA, 33 bp, Artificial Sequence
  Synthetic Construct
gcccaagtcgccaacctcaacagcagagcacag

SEQ ID NO: 2300 - DNA, 33 bp, Artificial Sequence
  Synthetic Construct
gcccaaaccatgctcctcgaacccaaagcacag

SEQ ID NO: 2301 - DNA, 33 bp, Artificial Sequence
  Synthetic Construct
gcccaaaatgttaggccttcgacttatgcacag

SEQ ID NO: 2302 - DNA, 33 bp, Artificial Sequence
  Synthetic Construct
gcccaagtgattcatattacgaatacggcacag

SEQ ID NO: 2303 - DNA, 33 bp, Artificial Sequence
  Synthetic Construct
gcccaaagcaaccccagcctcctcaccgcacag

SEQ ID NO: 2304 - DNA, 33 bp, Artificial Sequence
  Synthetic Construct
gcccaatatcaggataatgctaggcttgcacag

SEQ ID NO: 2305 - DNA, 33 bp, Artificial Sequence
  Synthetic Construct
gcccaaatccaaggcctcaccagccacgcacag

SEQ ID NO: 2306 - DNA, 33 bp, Artificial Sequence
  Synthetic Construct
gcccaaacttataatcagggtaagcaggcacag

SEQ ID NO: 2307 - DNA, 33 bp, Artificial Sequence
  Synthetic Construct
gcccaagctcctacggggatgaagcatgcacag

SEQ ID NO: 2308 - DNA, 33 bp, Artificial Sequence
  Synthetic Construct
gcccaaatgagtggtgagcttattcgtgcacag

SEQ ID NO: 2309 - DNA, 33 bp, Artificial Sequence
  Synthetic Construct
gcccaaagactcaacaccagccacctcgcacag

SEQ ID NO: 2310 - DNA, 33 bp, Artificial Sequence
  Synthetic Construct
gcccaagcgacggctctggcggcgggtgcacag

SEQ ID NO: 2311 - DNA, 33 bp, Artificial Sequence
  Synthetic Construct
gcccaacctatttcggggcttaagtcggcacag

SEQ ID NO: 2312 - DNA, 33 bp, Artificial Sequence
  Synthetic Construct
gcccaagagcgtacttttaatccggctgcacag

SEQ ID NO: 2313 - DNA, 33 bp, Artificial Sequence
  Synthetic Construct
gcccaaatgagtaatatttctagtgtggcacag

SEQ ID NO: 2314 - DNA, 33 bp, Artificial Sequence
  Synthetic Construct
gcccaaagagacgccagactcagccccgcacag

SEQ ID NO: 2315 - DNA, 33 bp, Artificial Sequence
  Synthetic Construct
gcccaagaccactacgtcaacaccagagcacag

SEQ ID NO: 2316 - DNA, 33 bp, Artificial Sequence
  Synthetic Construct
gcccaacctgggactgctgttcgtctggcacag

SEQ ID NO: 2317 - DNA, 33 bp, Artificial Sequence
  Synthetic Construct
gcccaagacaaaggcaccctcagcgaagcacag

SEQ ID NO: 2318 - DNA, 33 bp, Artificial Sequence
  Synthetic Construct
gcccaatcgattcctaggacggataatgcacag

SEQ ID NO: 2319 - DNA, 33 bp, Artificial Sequence
  Synthetic Construct
gcccaagagccggttcttcatactgttgcacag

SEQ ID NO: 2320 - DNA, 33 bp, Artificial Sequence
  Synthetic Construct
gcccaagacagagccatcctcaacagcgcacag

SEQ ID NO: 2321 - DNA, 33 bp, Artificial Sequence
  Synthetic Construct
gcccaagaaatcggcagcctcagacaagcacag

SEQ ID NO: 2322 - DNA, 33 bp, Artificial Sequence
  Synthetic Construct
gcccaagccttcgtcggcgccacccccgcacag

SEQ ID NO: 2323 - DNA, 33 bp, Artificial Sequence
  Synthetic Construct
gcccaattcgtccaaaacaaagacgccgcacag

SEQ ID NO: 2324 - DNA, 33 bp, Artificial Sequence
  Synthetic Construct
gcccaaagggataaggcggggcctacggcacag

SEQ ID NO: 2325 - DNA, 33 bp, Artificial Sequence
  Synthetic Construct
gcccaactcctccccaccgcccacaacgcacag

SEQ ID NO: 2326 - DNA, 33 bp, Artificial Sequence
  Synthetic Construct
gcccaacccaacggcatcaccagcaccgcacag

SEQ ID NO: 2327 - DNA, 33 bp, Artificial Sequence
  Synthetic Construct
gcccaatcgggtgtgacgaagggtagtgcacag

SEQ ID NO: 2328 - DNA, 33 bp, Artificial Sequence
  Synthetic Construct
gcccaaatgaacagcaccatcagccacgcacag

SEQ ID NO: 2329 - DNA, 33 bp, Artificial Sequence
  Synthetic Construct
gcccaatacaaaagcgacgtcggcagcgcacag

SEQ ID NO: 2330 - DNA, 33 bp, Artificial Sequence
  Synthetic Construct
gcccaaccggtgacgcgtgttaatcttgcacag

SEQ ID NO: 2331 - DNA, 33 bp, Artificial Sequence
  Synthetic Construct
gcccaaagaaacgtcgccgacggcctcgcacag

SEQ ID NO: 2332 - DNA, 33 bp, Artificial Sequence
  Synthetic Construct
gcccaagcttcggctacttcgattactgcacag

SEQ ID NO: 2333 - DNA, 33 bp, Artificial Sequence
  Synthetic Construct
gcccaaagcggcaccgccagcaacgtcgcacag

SEQ ID NO: 2334 - DNA, 33 bp, Artificial Sequence
  Synthetic Construct
gcccaacggcaggatcttggtagtactgcacag

SEQ ID NO: 2335 - DNA, 33 bp, Artificial Sequence
  Synthetic Construct
gcccaagacagcgccctcatcagcaaagcacag

SEQ ID NO: 2336 - DNA, 33 bp, Artificial Sequence
  Synthetic Construct
gcccaaaacaacggcctcaacagcgccgcacag

SEQ ID NO: 2337 - DNA, 33 bp, Artificial Sequence
  Synthetic Construct
gcccaagctgcgagtgagcgtcggatggcacag

SEQ ID NO: 2338 - DNA, 33 bp, Artificial Sequence
  Synthetic Construct
gcccaacgtcattctgctgtgcctgaggcacag

SEQ ID NO: 2339 - DNA, 33 bp, Artificial Sequence
  Synthetic Construct
gcccaatatcaggatacgaaggggcaggcacag

SEQ ID NO: 2340 - DNA, 33 bp, Artificial Sequence
  Synthetic Construct
gcccaaaagactgggtcgctgcctgtggcacag

SEQ ID NO: 2341 - DNA, 33 bp, Artificial Sequence
  Synthetic Construct
gcccaaattgcgcggagtgtgtctatggcacag

SEQ ID NO: 2342 - DNA, 33 bp, Artificial Sequence
  Synthetic Construct
gcccaacccagcagcaaactccccctcgcacag

SEQ ID NO: 2343 - DNA, 33 bp, Artificial Sequence
  Synthetic Construct
gcccaaatcaacgaccaaagaatcagcgcacag

SEQ ID NO: 2344 - DNA, 33 bp, Artificial Sequence
  Synthetic Construct
gcccaaggtatttctgagaagacttctgcacag

SEQ ID NO: 2345 - DNA, 33 bp, Artificial Sequence
  Synthetic Construct
gcccaaactagtgcttatacttcggtggcacag

SEQ ID NO: 2346 - DNA, 33 bp, Artificial Sequence
  Synthetic Construct
gcccaaggcaccctccacagcagcgccgcacag

SEQ ID NO: 2347 - DNA, 33 bp, Artificial Sequence
  Synthetic Construct
gcccaagcccccagagacgccgccagcgcacag

SEQ ID NO: 2348 - DNA, 33 bp, Artificial Sequence
  Synthetic Construct
gcccaaaataatactgctatgagtcttgcacag

SEQ ID NO: 2349 - DNA, 33 bp, Artificial Sequence
  Synthetic Construct
gcccaaatcctcagagtcgccgacgccgcacag

SEQ ID NO: 2350 - DNA, 33 bp, Artificial Sequence
  Synthetic Construct
gcccaagccagcgtcgccggcgccagcgcacag

SEQ ID NO: 2351 - DNA, 33 bp, Artificial Sequence
  Synthetic Construct
gcccaaagcgtcctcaacggcagcaaagcacag

SEQ ID NO: 2352 - DNA, 33 bp, Artificial Sequence
  Synthetic Construct
gcccaaatttatcagacggcttctgcggcacag

SEQ ID NO: 2353 - DNA, 33 bp, Artificial Sequence
  Synthetic Construct
gcccaaaccagcgaaagaacccaattcgcacag

SEQ ID NO: 2354 - DNA, 33 bp, Artificial Sequence
  Synthetic Construct
gcccaaagcaccgtcgccctcaccagcgcacag

SEQ ID NO: 2355 - DNA, 33 bp, Artificial Sequence
  Synthetic Construct
gcccaagggaatacggtgattaatgcggcacag

SEQ ID NO: 2356 - DNA, 33 bp, Artificial Sequence
  Synthetic Construct
gcccaacccctcggcagcatcgtcaccgcacag

SEQ ID NO: 2357 - DNA, 33 bp, Artificial Sequence
  Synthetic Construct
gcccaactcagaatgagcgacagcttcgcacag

SEQ ID NO: 2358 - DNA, 33 bp, Artificial Sequence
  Synthetic Construct
gcccaaaccagcgaaagcggcaccctcgcacag

SEQ ID NO: 2359 - DNA, 33 bp, Artificial Sequence
  Synthetic Construct
gcccaagaggcgacgcggcctgttcgggcacag

SEQ ID NO: 2360 - DNA, 33 bp, Artificial Sequence
  Synthetic Construct
gcccaaaataagcagtttttggctgatgcacag

SEQ ID NO: 2361 - DNA, 33 bp, Artificial Sequence
  Synthetic Construct
gcccaactcaccatcagagacaacgtcgcacag

SEQ ID NO: 2362 - DNA, 33 bp, Artificial Sequence
  Synthetic Construct
gcccaagttgggtctgggcttgctaaggcacag

SEQ ID NO: 2363 - DNA, 33 bp, Artificial Sequence
  Synthetic Construct
gcccaacaaaacgccaccaacctcatggcacag

SEQ ID NO: 2364 - DNA, 33 bp, Artificial Sequence
  Synthetic Construct
gcccaatctatgtatgctgggcatgaggcacag

SEQ ID NO: 2365 - DNA, 33 bp, Artificial Sequence
  Synthetic Construct
gcccaaatggtcaacagcgaaaaagccgcacag

SEQ ID NO: 2366 - DNA, 33 bp, Artificial Sequence
  Synthetic Construct
gcccaacgtatgagtatgcggtctgatgcacag

SEQ ID NO: 2367 - DNA, 33 bp, Artificial Sequence
  Synthetic Construct
gcccaaagcagcagcggcctcaacaaagcacag

SEQ ID NO: 2368 - DNA, 33 bp, Artificial Sequence
  Synthetic Construct
gcccaacaaagcagcgtcctcacccccgcacag

SEQ ID NO: 2369 - DNA, 33 bp, Artificial Sequence
  Synthetic Construct
gcccaaactcctaatttggagactagtgcacag

SEQ ID NO: 2370 - DNA, 33 bp, Artificial Sequence
  Synthetic Construct
gcccaaatgcgtggtactctttcgatggcacag

SEQ ID NO: 2371 - DNA, 33 bp, Artificial Sequence
  Synthetic Construct
gcccaagatcatggtgctagtcttcctgcacag

SEQ ID NO: 2372 - DNA, 33 bp, Artificial Sequence
  Synthetic Construct
gcccaatctcatttggcgacgccgaaggcacag

SEQ ID NO: 2373 - DNA, 33 bp, Artificial Sequence
  Synthetic Construct
gcccaatctgatgcgtcgcatcggcaggcacag

SEQ ID NO: 2374 - DNA, 33 bp, Artificial Sequence
  Synthetic Construct
gcccaaaccggcaccgaaagactcagcgcacag

SEQ ID NO: 2375 - DNA, 33 bp, Artificial Sequence
  Synthetic Construct
gcccaagccgtcggccacgtcggccccgcacag

SEQ ID NO: 2376 - DNA, 33 bp, Artificial Sequence
  Synthetic Construct
gcccaacaaagccaacaaggcgtcaaagcacag

SEQ ID NO: 2377 - DNA, 33 bp, Artificial Sequence
  Synthetic Construct
gcccaaaatcttacgattagtaatcgggcacag

SEQ ID NO: 2378 - DNA, 33 bp, Artificial Sequence
  Synthetic Construct
gcccaagtcagcagcggctacgaaaccgcacag

SEQ ID NO: 2379 - DNA, 33 bp, Artificial Sequence
  Synthetic Construct
gcccaatcgatttctcctcctcgtacggcacag

SEQ ID NO: 2380 - DNA, 33 bp, Artificial Sequence
  Synthetic Construct
gcccaaccctacaaccaaagccccagcgcacag

SEQ ID NO: 2381 - DNA, 33 bp, Artificial Sequence
  Synthetic Construct
gcccaaacgatgtcgtataatactaatgcacag

SEQ ID NO: 2382 - DNA, 33 bp, Artificial Sequence
  Synthetic Construct
gcccaaggcgcctacaacaccgtcagcgcacag

SEQ ID NO: 2383 - DNA, 33 bp, Artificial Sequence
  Synthetic Construct
gcccaatcgaaggttacgcctcctctggcacag

SEQ ID NO: 2384 - DNA, 33 bp, Artificial Sequence
  Synthetic Construct
gcccaaagattcagagaaaacgaccacgcacag

SEQ ID NO: 2385 - DNA, 33 bp, Artificial Sequence
  Synthetic Construct
gcccaattggatactgggcagccgacggcacag

SEQ ID NO: 2386 - DNA, 33 bp, Artificial Sequence
  Synthetic Construct
gcccaacttccgtcgactccgcagaatgcacag

SEQ ID NO: 2387 - DNA, 33 bp, Artificial Sequence
  Synthetic Construct
gcccaaaccctcagctacgtcaccagcgcacag

SEQ ID NO: 2388 - DNA, 33 bp, Artificial Sequence
  Synthetic Construct
gcccaaagcaccaccgtcctccccgtcgcacag

SEQ ID NO: 2389 - DNA, 33 bp, Artificial Sequence
  Synthetic Construct
gcccaaatgacgcatacgcttttgagtgcacag

SEQ ID NO: 2390 - DNA, 33 bp, Artificial Sequence
  Synthetic Construct
gcccaaagcacctacaacaaaaccttcgcacag

SEQ ID NO: 2391 - DNA, 33 bp, Artificial Sequence
  Synthetic Construct
gcccaagcgacgtcgagtcatacgctggcacag

SEQ ID NO: 2392 - DNA, 33 bp, Artificial Sequence
  Synthetic Construct
gcccaaagactcaacggcaccgaacccgcacag

SEQ ID NO: 2393 - DNA, 33 bp, Artificial Sequence
  Synthetic Construct
gcccaacaagccaacacccccaccaaagcacag

SEQ ID NO: 2394 - DNA, 33 bp, Artificial Sequence
  Synthetic Construct
gcccaaagcgccgtcatcaacagcagcgcacag

SEQ ID NO: 2395 - DNA, 33 bp, Artificial Sequence
  Synthetic Construct
gcccaaaaccacggcaacgaagtcaaagcacag

SEQ ID NO: 2396 - DNA, 33 bp, Artificial Sequence
  Synthetic Construct
gcccaaaagcatctgtcgcatgatccggcacag

SEQ ID NO: 2397 - DNA, 33 bp, Artificial Sequence
  Synthetic Construct
gcccaattggggtcgggtaggatggctgcacag

SEQ ID NO: 2398 - DNA, 33 bp, Artificial Sequence
  Synthetic Construct
gcccaaagcaaccaaatcaccatcgtcgcacag

SEQ ID NO: 2399 - DNA, 33 bp, Artificial Sequence
  Synthetic Construct
gcccaaggtggtaggggtgtgggtatggcacag

SEQ ID NO: 2400 - DNA, 33 bp, Artificial Sequence
  Synthetic Construct
gcccaattcgtcaccgaaagcaaaagcgcacag

SEQ ID NO: 2401 - DNA, 33 bp, Artificial Sequence
  Synthetic Construct
gcccaaaacagcgtccacaacgacctcgcacag

SEQ ID NO: 2402 - DNA, 33 bp, Artificial Sequence
  Synthetic Construct
gcccaaagcccccaacaaagcagatacgcacag

SEQ ID NO: 2403 - DNA, 33 bp, Artificial Sequence
  Synthetic Construct
gcccaaactcagcctaatcatgattctgcacag

SEQ ID NO: 2404 - DNA, 33 bp, Artificial Sequence
  Synthetic Construct
gcccaaacgaggctgaatgaggtgactgcacag

SEQ ID NO: 2405 - DNA, 33 bp, Artificial Sequence
  Synthetic Construct
gcccaaacggcgcagcgtactaatgttgcacag

SEQ ID NO: 2406 - DNA, 33 bp, Artificial Sequence
  Synthetic Construct
gcccaacccggcagaagccccaccaccgcacag

SEQ ID NO: 2407 - DNA, 33 bp, Artificial Sequence
  Synthetic Construct
gcccaagcctacagcgtcgtcagaggcgcacag

SEQ ID NO: 2408 - DNA, 33 bp, Artificial Sequence
  Synthetic Construct
gcccaagttggtccggtgctttctagggcacag

SEQ ID NO: 2409 - DNA, 33 bp, Artificial Sequence
  Synthetic Construct
gcccaaaccaaaatgggcacccccaacgcacag

SEQ ID NO: 2410 - DNA, 33 bp, Artificial Sequence
  Synthetic Construct
gcccaaaccacccccaacctcaaccccgcacag

SEQ ID NO: 2411 - DNA, 33 bp, Artificial Sequence
  Synthetic Construct
gcccaaaccagcggcaccgacggcatcgcacag

SEQ ID NO: 2412 - DNA, 33 bp, Artificial Sequence
  Synthetic Construct
gcccaaccgatgcctaatatgccgtcggcacag

SEQ ID NO: 2413 - DNA, 33 bp, Artificial Sequence
  Synthetic Construct
gcccaagccgacgccctcagcaacagagcacag

SEQ ID NO: 2414 - DNA, 33 bp, Artificial Sequence
  Synthetic Construct
gcccaactccaaaccagcagccacaccgcacag

SEQ ID NO: 2415 - DNA, 33 bp, Artificial Sequence
  Synthetic Construct
gcccaaaccagcatgcaaggcgtctacgcacag

SEQ ID NO: 2416 - DNA, 33 bp, Artificial Sequence
  Synthetic Construct
gcccaacagactactgttttgaataaggcacag

SEQ ID NO: 2417 - DNA, 33 bp, Artificial Sequence
  Synthetic Construct
gcccaaatcatccccgtcaacagcaccgcacag

SEQ ID NO: 2418 - DNA, 33 bp, Artificial Sequence
  Synthetic Construct
gcccaaattgctactgttacttctagtgcacag

SEQ ID NO: 2419 - DNA, 33 bp, Artificial Sequence
  Synthetic Construct
gcccaattggagacgccgggtcgtatggcacag

SEQ ID NO: 2420 - DNA, 33 bp, Artificial Sequence
  Synthetic Construct
gcccaaatcgccaccagcgtcggcagcgcacag

SEQ ID NO: 2421 - DNA, 33 bp, Artificial Sequence
  Synthetic Construct
gcccaagtcagagaacacgaagccctcgcacag

SEQ ID NO: 2422 - DNA, 33 bp, Artificial Sequence
  Synthetic Construct
gcccaacccctcaccaacgtccaaggcgcacag

SEQ ID NO: 2423 - DNA, 33 bp, Artificial Sequence
  Synthetic Construct
gcccaacgtgatatggtgcagactatggcacag

SEQ ID NO: 2424 - DNA, 33 bp, Artificial Sequence
  Synthetic Construct
gcccaaagactcggcttcgccaccaacgcacag

SEQ ID NO: 2425 - DNA, 33 bp, Artificial Sequence
  Synthetic Construct
gcccaaatgtctcaggtgacgactgaggcacag

SEQ ID NO: 2426 - DNA, 33 bp, Artificial Sequence
  Synthetic Construct
gcccaaagtgtgcttccgaatgctattgcacag

SEQ ID NO: 2427 - DNA, 33 bp, Artificial Sequence
  Synthetic Construct
gcccaaaaattcagccccaccctcgccgcacag

SEQ ID NO: 2428 - DNA, 33 bp, Artificial Sequence
  Synthetic Construct
gcccaaaacatcggcaacatggtcctcgcacag

SEQ ID NO: 2429 - DNA, 33 bp, Artificial Sequence
  Synthetic Construct
gcccaaagtcttcttactgttttgagtgcacag

SEQ ID NO: 2430 - DNA, 33 bp, Artificial Sequence
  Synthetic Construct
gcccaaaacagcaaccccagcatgctcgcacag

SEQ ID NO: 2431 - DNA, 33 bp, Artificial Sequence
  Synthetic Construct
gcccaaattactgcggctgtgcgtgatgcacag

SEQ ID NO: 2432 - DNA, 33 bp, Artificial Sequence
  Synthetic Construct
gcccaagcctacaccagcaacgacagagcacag

SEQ ID NO: 2433 - DNA, 33 bp, Artificial Sequence
  Synthetic Construct
gcccaaaacagcgtcggcagcatgaaagcacag

SEQ ID NO: 2434 - DNA, 33 bp, Artificial Sequence
  Synthetic Construct
gcccaaagactcgacaccacctgggtcgcacag

SEQ ID NO: 2435 - DNA, 33 bp, Artificial Sequence
  Synthetic Construct
gcccaaattgctgaggcggggggtcgtgcacag

SEQ ID NO: 2436 - DNA, 33 bp, Artificial Sequence
  Synthetic Construct
gcccaaagcaaaaccaacctccaactcgcacag

SEQ ID NO: 2437 - DNA, 33 bp, Artificial Sequence
  Synthetic Construct
gcccaattttcgaaggatgatgctgttgcacag

SEQ ID NO: 2438 - DNA, 33 bp, Artificial Sequence
  Synthetic Construct
gcccaactcaccagccacagcctcaccgcacag

SEQ ID NO: 2439 - DNA, 33 bp, Artificial Sequence
  Synthetic Construct
gcccaacacgtccaactccaataccccgcacag

SEQ ID NO: 2440 - DNA, 33 bp, Artificial Sequence
  Synthetic Construct
gcccaaaaccacaaccaacccagcgccgcacag

SEQ ID NO: 2441 - DNA, 33 bp, Artificial Sequence
  Synthetic Construct
gcccaaactgagggtgcgcggagtttggcacag

SEQ ID NO: 2442 - DNA, 33 bp, Artificial Sequence
  Synthetic Construct
gcccaaaaccaaagcgacagcaaagtcgcacag

SEQ ID NO: 2443 - DNA, 33 bp, Artificial Sequence
  Synthetic Construct
gcccaagtgagtcttccgctggctccggcacag

SEQ ID NO: 2444 - DNA, 33 bp, Artificial Sequence
  Synthetic Construct
gcccaaaacaacaccaacctcagcagagcacag

SEQ ID NO: 2445 - DNA, 33 bp, Artificial Sequence
  Synthetic Construct
gcccaatattcgaatagtaataatcatgcacag

SEQ ID NO: 2446 - DNA, 33 bp, Artificial Sequence
  Synthetic Construct
gcccaaggcctcgaaaccagactccacgcacag

SEQ ID NO: 2447 - DNA, 33 bp, Artificial Sequence
  Synthetic Construct
gcccaactgactactactgagtctaaggcacag

SEQ ID NO: 2448 - DNA, 33 bp, Artificial Sequence
  Synthetic Construct
gcccaaatgggcgccagaatgcccctcgcacag

SEQ ID NO: 2449 - DNA, 33 bp, Artificial Sequence
  Synthetic Construct
gcccaaagtcatgatcatatgcttattgcacag

SEQ ID NO: 2450 - DNA, 33 bp, Artificial Sequence
  Synthetic Construct
gcccaacgtactgagggttcggataatgcacag

SEQ ID NO: 2451 - DNA, 33 bp, Artificial Sequence
  Synthetic Construct
gcccaaaattttcagcgtgatgggccggcacag

SEQ ID NO: 2452 - DNA, 33 bp, Artificial Sequence
  Synthetic Construct
gcccaactttcgaatattaatccgcatgcacag

SEQ ID NO: 2453 - DNA, 33 bp, Artificial Sequence
  Synthetic Construct
gcccaaagcagcaaccacaccagcagagcacag

SEQ ID NO: 2454 - DNA, 33 bp, Artificial Sequence
  Synthetic Construct
gcccaaatgcacgtcaacgccagccccgcacag

SEQ ID NO: 2455 - DNA, 33 bp, Artificial Sequence
  Synthetic Construct
gcccaatgggattcgttggctgcgccggcacag

SEQ ID NO: 2456 - DNA, 33 bp, Artificial Sequence
  Synthetic Construct
gcccaactggatggtgcgcataatgcggcacag

SEQ ID NO: 2457 - DNA, 33 bp, Artificial Sequence
  Synthetic Construct
gcccaatcgattaggagtccgcctcctgcacag

SEQ ID NO: 2458 - DNA, 33 bp, Artificial Sequence
  Synthetic Construct
gcccaaaatgggacgctgaaggggttggcacag

SEQ ID NO: 2459 - DNA, 33 bp, Artificial Sequence
  Synthetic Construct
gcccaattttatcaggagcagtctttggcacag

SEQ ID NO: 2460 - DNA, 33 bp, Artificial Sequence
  Synthetic Construct
gcccaatacgaccaaaaaagcctcgccgcacag

SEQ ID NO: 2461 - DNA, 33 bp, Artificial Sequence
  Synthetic Construct
gcccaactgtcgacgaatcgtacttttgcacag

SEQ ID NO: 2462 - DNA, 33 bp, Artificial Sequence
  Synthetic Construct
gcccaaaaacaaacccaagacagcagcgcacag

SEQ ID NO: 2463 - DNA, 33 bp, Artificial Sequence
  Synthetic Construct
gcccaatatgagcgggggcctcagatggcacag

SEQ ID NO: 2464 - DNA, 33 bp, Artificial Sequence
  Synthetic Construct
gcccaaacccacgccaacagcgtcagagcacag

SEQ ID NO: 2465 - DNA, 33 bp, Artificial Sequence
  Synthetic Construct
gcccaaagtatgaatactaatgcttctgcacag

SEQ ID NO: 2466 - DNA, 33 bp, Artificial Sequence
  Synthetic Construct
gcccaacttgataatgagaaggggagggcacag

SEQ ID NO: 2467 - DNA, 33 bp, Artificial Sequence
  Synthetic Construct
gcccaactcggccaactcctccaaagcgcacag

SEQ ID NO: 2468 - DNA, 33 bp, Artificial Sequence
  Synthetic Construct
gcccaaatgcggatgcctgttaatatggcacag

SEQ ID NO: 2469 - DNA, 33 bp, Artificial Sequence
  Synthetic Construct
gcccaaggcaccagcaacctccccagcgcacag

SEQ ID NO: 2470 - DNA, 33 bp, Artificial Sequence
  Synthetic Construct
gcccaagagggggagatgaagtctccggcacag

SEQ ID NO: 2471 - DNA, 33 bp, Artificial Sequence
  Synthetic Construct
gcccaacagctggggcatgataatcgggcacag

SEQ ID NO: 2472 - DNA, 33 bp, Artificial Sequence
  Synthetic Construct
gcccaactggatgattctgcggggagggcacag

SEQ ID NO: 2473 - DNA, 33 bp, Artificial Sequence
  Synthetic Construct
gcccaaactggtgctggtaatgggcgggcacag

SEQ ID NO: 2474 - DNA, 33 bp, Artificial Sequence
  Synthetic Construct
gcccaaaacaccggcgccgccatgatggcacag

SEQ ID NO: 2475 - DNA, 33 bp, Artificial Sequence
  Synthetic Construct
gcccaaatgggggcgaatacgtctgttgcacag

SEQ ID NO: 2476 - DNA, 33 bp, Artificial Sequence
  Synthetic Construct
gcccaacccagcacccacggcggcagcgcacag

SEQ ID NO: 2477 - DNA, 33 bp, Artificial Sequence
  Synthetic Construct
gcccaaatgcctcagtcgcagccgaatgcacag

SEQ ID NO: 2478 - DNA, 33 bp, Artificial Sequence
  Synthetic Construct
gcccaatctactcaggctaggctgacggcacag

SEQ ID NO: 2479 - DNA, 33 bp, Artificial Sequence
  Synthetic Construct
gcccaaagcgaatacctcctcaaccccgcacag

SEQ ID NO: 2480 - DNA, 33 bp, Artificial Sequence
  Synthetic Construct
gcccaaactactggtcctgggctgaatgcacag

SEQ ID NO: 2481 - DNA, 33 bp, Artificial Sequence
  Synthetic Construct
gcccaacctgggagttctgtgtcttatgcacag

SEQ ID NO: 2482 - DNA, 33 bp, Artificial Sequence
  Synthetic Construct
gcccaatattttgggtcggcgcaggaggcacag

SEQ ID NO: 2483 - DNA, 33 bp, Artificial Sequence
  Synthetic Construct
gcccaagccgtcatcaacaacgccaccgcacag

SEQ ID NO: 2484 - DNA, 33 bp, Artificial Sequence
  Synthetic Construct
gcccaagtcgccatgcaagacaaaaaagcacag

SEQ ID NO: 2485 - DNA, 33 bp, Artificial Sequence
  Synthetic Construct
gcccaagcggataatatgaatattaaggcacag

SEQ ID NO: 2486 - DNA, 33 bp, Artificial Sequence
  Synthetic Construct
gcccaagggcgggcgacgactgattctgcacag

SEQ ID NO: 2487 - DNA, 33 bp, Artificial Sequence
  Synthetic Construct
gcccaaatgaacctccacctcaaaggcgcacag

SEQ ID NO: 2488 - DNA, 33 bp, Artificial Sequence
  Synthetic Construct
gcccaatcgaatcagattcgtgattcggcacag

SEQ ID NO: 2489 - DNA, 33 bp, Artificial Sequence
  Synthetic Construct
gcccaagttaatggtcagagtacgcctgcacag

SEQ ID NO: 2490 - DNA, 33 bp, Artificial Sequence
  Synthetic Construct
gcccaaattcttcctcagttgaattcggcacag

SEQ ID NO: 2491 - DNA, 33 bp, Artificial Sequence
  Synthetic Construct
gcccaagtccaagacagcctccacttcgcacag

SEQ ID NO: 2492 - DNA, 33 bp, Artificial Sequence
  Synthetic Construct
gcccaagacgtcagcaacagaaacaacgcacag

SEQ ID NO: 2493 - DNA, 33 bp, Artificial Sequence
  Synthetic Construct
gcccaagatgctagtcatggttctagtgcacag

SEQ ID NO: 2494 - DNA, 33 bp, Artificial Sequence
  Synthetic Construct
gcccaacgggcgagtgctcatccgccggcacag

SEQ ID NO: 2495 - DNA, 33 bp, Artificial Sequence
  Synthetic Construct
gcccaacccagcctcagagccctcgacgcacag

SEQ ID NO: 2496 - DNA, 33 bp, Artificial Sequence
  Synthetic Construct
gcccaagataagacgcctccggttgctgcacag

SEQ ID NO: 2497 - DNA, 33 bp, Artificial Sequence
  Synthetic Construct
gcccaacttaatgatgttacgactagggcacag

SEQ ID NO: 2498 - DNA, 33 bp, Artificial Sequence
  Synthetic Construct
gcccaaggcgccagcaacgcccaagccgcacag

SEQ ID NO: 2499 - DNA, 33 bp, Artificial Sequence
  Synthetic Construct
gcccaaaatgggtcgcgggatgcgttggcacag

SEQ ID NO: 2500 - DNA, 33 bp, Artificial Sequence
  Synthetic Construct
gcccaatacggcgtcgaaagaatgagcgcacag

SEQ ID NO: 2501 - DNA, 33 bp, Artificial Sequence
  Synthetic Construct
gcccaagccaaagtcgccagcagcttcgcacag

SEQ ID NO: 2502 - DNA, 33 bp, Artificial Sequence
  Synthetic Construct
gcccaacataagcagattctgttggatgcacag

SEQ ID NO: 2503 - DNA, 33 bp, Artificial Sequence
  Synthetic Construct
gcccaagacagagccaacgacagaatcgcacag

SEQ ID NO: 2504 - DNA, 33 bp, Artificial Sequence
  Synthetic Construct
gcccaaaaaatgagcaccaccatgctcgcacag

SEQ ID NO: 2505 - DNA, 33 bp, Artificial Sequence
  Synthetic Construct
gcccaaggcggcgaaaacggcgtcatcgcacag

SEQ ID NO: 2506 - DNA, 33 bp, Artificial Sequence
  Synthetic Construct
gcccaagttacgcagactctgatttcggcacag

SEQ ID NO: 2507 - DNA, 33 bp, Artificial Sequence
  Synthetic Construct
gcccaactgtatactaaggctctgattgcacag

SEQ ID NO: 2508 - DNA, 33 bp, Artificial Sequence
  Synthetic Construct
gcccaaaccctccccggccacaacagagcacag

SEQ ID NO: 2509 - DNA, 33 bp, Artificial Sequence
  Synthetic Construct
gcccaaagtaagtctgggcttgtgggtgcacag

SEQ ID NO: 2510 - DNA, 33 bp, Artificial Sequence
  Synthetic Construct
gcccaacttactttgaaggatactagtgcacag

SEQ ID NO: 2511 - DNA, 33 bp, Artificial Sequence
  Synthetic Construct
gcccaatggaacggcaccggcgtcagcgcacag

SEQ ID NO: 2512 - DNA, 33 bp, Artificial Sequence
  Synthetic Construct
gcccaactcgtccaaaacaacaccatggcacag

SEQ ID NO: 2513 - DNA, 33 bp, Artificial Sequence
  Synthetic Construct
gcccaactcgccgacagaggcagcgccgcacag

SEQ ID NO: 2514 - DNA, 33 bp, Artificial Sequence
  Synthetic Construct
gcccaattggcttcgacgggtgcgaatgcacag

SEQ ID NO: 2515 - DNA, 33 bp, Artificial Sequence
  Synthetic Construct
gcccaacttgggcggaatgatactcttgcacag

SEQ ID NO: 2516 - DNA, 33 bp, Artificial Sequence
  Synthetic Construct
gcccaaagaagcaccaacggcgaagccgcacag

SEQ ID NO: 2517 - DNA, 33 bp, Artificial Sequence
  Synthetic Construct
gcccaaggcgccacctaccaaagaaccgcacag

SEQ ID NO: 2518 - DNA, 33 bp, Artificial Sequence
  Synthetic Construct
gcccaaggcaaaagccaactcctcatggcacag

SEQ ID NO: 2519 - DNA, 33 bp, Artificial Sequence
  Synthetic Construct
gcccaaaatactgctacgttttcttcggcacag

SEQ ID NO: 2520 - DNA, 33 bp, Artificial Sequence
  Synthetic Construct
gcccaatattcgacgacgatttctccggcacag

SEQ ID NO: 2521 - DNA, 33 bp, Artificial Sequence
  Synthetic Construct
gcccaacccagacacagcgtccaagacgcacag

SEQ ID NO: 2522 - DNA, 33 bp, Artificial Sequence
  Synthetic Construct
gcccaaaataataatacgaagatgaatgcacag

SEQ ID NO: 2523 - DNA, 33 bp, Artificial Sequence
  Synthetic Construct
gcccaactcaccggccaccacaccaaagcacag

SEQ ID NO: 2524 - DNA, 33 bp, Artificial Sequence
  Synthetic Construct
gcccaaaacgtcagcagcggccaaagagcacag

SEQ ID NO: 2525 - DNA, 33 bp, Artificial Sequence
  Synthetic Construct
gcccaaagcctccaagacgccagactcgcacag

SEQ ID NO: 2526 - DNA, 33 bp, Artificial Sequence
  Synthetic Construct
gcccaacttaatagggatgggtcggtggcacag

SEQ ID NO: 2527 - DNA, 33 bp, Artificial Sequence
  Synthetic Construct
gcccaaaacagcaccgaaaacagcaccgcacag

SEQ ID NO: 2528 - DNA, 33 bp, Artificial Sequence
  Synthetic Construct
gcccaaagcctcgtcgcccaacccgtcgcacag

SEQ ID NO: 2529 - DNA, 33 bp, Artificial Sequence
  Synthetic Construct
gcccaacatgctgctacggtgagtcatgcacag

SEQ ID NO: 2530 - DNA, 33 bp, Artificial Sequence
  Synthetic Construct
gcccaaaatgtgtctggtgcgcgtttggcacag

SEQ ID NO: 2531 - DNA, 33 bp, Artificial Sequence
  Synthetic Construct
gcccaaagagccgacaaattcgactacgcacag

SEQ ID NO: 2532 - DNA, 33 bp, Artificial Sequence
  Synthetic Construct
gcccaaagccaacccgacgtcacctacgcacag

SEQ ID NO: 2533 - DNA, 33 bp, Artificial Sequence
  Synthetic Construct
gcccaagttcttactcagcagactcatgcacag

SEQ ID NO: 2534 - DNA, 33 bp, Artificial Sequence
  Synthetic Construct
gcccaaaccgacaacagcaccaccagagcacag

SEQ ID NO: 2535 - DNA, 33 bp, Artificial Sequence
  Synthetic Construct
gcccaatataatactcggtatgatgctgcacag

SEQ ID NO: 2536 - DNA, 33 bp, Artificial Sequence
  Synthetic Construct
gcccaaagcgccaacgacgccagagtcgcacag

SEQ ID NO: 2537 - DNA, 33 bp, Artificial Sequence
  Synthetic Construct
gcccaaatcctcacccccgacctcagagcacag

SEQ ID NO: 2538 - DNA, 33 bp, Artificial Sequence
  Synthetic Construct
gcccaacctaatgtgggtgcgagttcggcacag

SEQ ID NO: 2539 - DNA, 33 bp, Artificial Sequence
  Synthetic Construct
gcccaactcagcgccagccacaccatcgcacag

SEQ ID NO: 2540 - DNA, 33 bp, Artificial Sequence
  Synthetic Construct
gcccaaaccaaagtcctcatcgaaaaagcacag

SEQ ID NO: 2541 - DNA, 33 bp, Artificial Sequence
  Synthetic Construct
gcccaaatgaatactcttattcctgcggcacag

SEQ ID NO: 2542 - DNA, 33 bp, Artificial Sequence
  Synthetic Construct
gcccaatcttcgaatgttgtgactactgcacag

SEQ ID NO: 2543 - DNA, 33 bp, Artificial Sequence
  Synthetic Construct
gcccaaatgaacgtcagacccaccaccgcacag

SEQ ID NO: 2544 - DNA, 33 bp, Artificial Sequence
  Synthetic Construct
gcccaagatactggtcttaataatagggcacag

SEQ ID NO: 2545 - DNA, 33 bp, Artificial Sequence
  Synthetic Construct
gcccaaaccctcaacagagaccacatggcacag

SEQ ID NO: 2546 - DNA, 33 bp, Artificial Sequence
  Synthetic Construct
gcccaactcctcctcagccaccacgccgcacag

SEQ ID NO: 2547 - DNA, 33 bp, Artificial Sequence
  Synthetic Construct
gcccaaaaccccgccatggccaccttcgcacag

SEQ ID NO: 2548 - DNA, 33 bp, Artificial Sequence
  Synthetic Construct
gcccaaatttctcagcggatttatgcggcacag

SEQ ID NO: 2549 - DNA, 33 bp, Artificial Sequence
  Synthetic Construct
gcccaaacgactggggttgctggtagtgcacag

SEQ ID NO: 2550 - DNA, 33 bp, Artificial Sequence
  Synthetic Construct
gcccaatttgggacgtttccgacgcctgcacag

SEQ ID NO: 2551 - DNA, 33 bp, Artificial Sequence
  Synthetic Construct
gcccaaagaggcagcgacttcgacagcgcacag

SEQ ID NO: 2552 - DNA, 33 bp, Artificial Sequence
  Synthetic Construct
gcccaaagcaaagccagcctcgacagcgcacag

SEQ ID NO: 2553 - DNA, 33 bp, Artificial Sequence
  Synthetic Construct
gcccaacttcttaatagtcattctgctgcacag

SEQ ID NO: 2554 - DNA, 33 bp, Artificial Sequence
  Synthetic Construct
gcccaagctagtattcataaggatattgcacag

SEQ ID NO: 2555 - DNA, 33 bp, Artificial Sequence
  Synthetic Construct
gcccaaagcgaccccggcaaattcatggcacag

SEQ ID NO: 2556 - DNA, 33 bp, Artificial Sequence
  Synthetic Construct
gcccaaggcaccagcagcgcccaaagagcacag

SEQ ID NO: 2557 - DNA, 33 bp, Artificial Sequence
  Synthetic Construct
gcccaaagtacgaatagtaagctggaggcacag

SEQ ID NO: 2558 - DNA, 33 bp, Artificial Sequence
  Synthetic Construct
gcccaaaatttgcagactgttccgaatgcacag

SEQ ID NO: 2559 - DNA, 33 bp, Artificial Sequence
  Synthetic Construct
gcccaagtcgtcacccacctcaacgccgcacag

SEQ ID NO: 2560 - DNA, 33 bp, Artificial Sequence
  Synthetic Construct
gcccaactcagcaccagcaacaacttcgcacag

SEQ ID NO: 2561 - DNA, 33 bp, Artificial Sequence
  Synthetic Construct
gcccaaaacaacagcggccacatcagcgcacag

SEQ ID NO: 2562 - DNA, 33 bp, Artificial Sequence
  Synthetic Construct
gcccaagcctaccaagtcaacagcgacgcacag

SEQ ID NO: 2563 - DNA, 33 bp, Artificial Sequence
  Synthetic Construct
gcccaacagcagaattatttgaatcatgcacag

SEQ ID NO: 2564 - DNA, 33 bp, Artificial Sequence
  Synthetic Construct
gcccaatttgcgactacgaatactggggcacag

SEQ ID NO: 2565 - DNA, 33 bp, Artificial Sequence
  Synthetic Construct
gcccaacttgcgaataagattgcgaatgcacag

SEQ ID NO: 2566 - DNA, 33 bp, Artificial Sequence
  Synthetic Construct
gcccaacaaagcttccaaagagaagtcgcacag

SEQ ID NO: 2567 - DNA, 33 bp, Artificial Sequence
  Synthetic Construct
gcccaactgcatatttcggagccgagggcacag

SEQ ID NO: 2568 - DNA, 33 bp, Artificial Sequence
  Synthetic Construct
gcccaacgtgtgggtgagcgggagcaggcacag

SEQ ID NO: 2569 - DNA, 33 bp, Artificial Sequence
  Synthetic Construct
gcccaagttaatattattcaggcgtcggcacag

SEQ ID NO: 2570 - DNA, 33 bp, Artificial Sequence
  Synthetic Construct
gcccaaggcgtcggcctccacaacaaagcacag

SEQ ID NO: 2571 - DNA, 33 bp, Artificial Sequence
  Synthetic Construct
gcccaaaataatcctgcgattccgattgcacag

SEQ ID NO: 2572 - DNA, 33 bp, Artificial Sequence
  Synthetic Construct
gcccaacggctgtcgagtcaggctgtggcacag

SEQ ID NO: 2573 - DNA, 33 bp, Artificial Sequence
  Synthetic Construct
gcccaacacagcaacgaactcagacccgcacag

SEQ ID NO: 2574 - DNA, 33 bp, Artificial Sequence
  Synthetic Construct
gcccaaagcctcggccccaccaccaacgcacag

SEQ ID NO: 2575 - DNA, 33 bp, Artificial Sequence
  Synthetic Construct
gcccaaggtaatcagacgaatcgttcggcacag

SEQ ID NO: 2576 - DNA, 33 bp, Artificial Sequence
  Synthetic Construct
gcccaaagtaatccggtgggtaatccggcacag

SEQ ID NO: 2577 - DNA, 33 bp, Artificial Sequence
  Synthetic Construct
gcccaacaagtcccccccctcgtccccgcacag

SEQ ID NO: 2578 - DNA, 33 bp, Artificial Sequence
  Synthetic Construct
gcccaactcagcaccccccccacccaagcacag

SEQ ID NO: 2579 - DNA, 33 bp, Artificial Sequence
  Synthetic Construct
gcccaagtgggtacggagccgctttctgcacag

SEQ ID NO: 2580 - DNA, 33 bp, Artificial Sequence
  Synthetic Construct
gcccaaagacccgacgccaccagccacgcacag

SEQ ID NO: 2581 - DNA, 33 bp, Artificial Sequence
  Synthetic Construct
gcccaagttgagaagcagatgcttaatgcacag

SEQ ID NO: 2582 - DNA, 33 bp, Artificial Sequence
  Synthetic Construct
gcccaattcaaaagcgcccaagccaccgcacag

SEQ ID NO: 2583 - DNA, 33 bp, Artificial Sequence
  Synthetic Construct
gcccaatgggctttgtctacggatggggcacag

SEQ ID NO: 2584 - DNA, 33 bp, Artificial Sequence
  Synthetic Construct
gcccaacttgctggtctggctactaatgcacag

SEQ ID NO: 2585 - DNA, 33 bp, Artificial Sequence
  Synthetic Construct
gcccaaaccctcaccgccggcacccccgcacag

SEQ ID NO: 2586 - DNA, 33 bp, Artificial Sequence
  Synthetic Construct
gcccaaatccccgtcaccagcagaatggcacag

SEQ ID NO: 2587 - DNA, 33 bp, Artificial Sequence
  Synthetic Construct
gcccaagggacggattatcctaggtctgcacag

SEQ ID NO: 2588 - DNA, 33 bp, Artificial Sequence
  Synthetic Construct
gcccaagttacggagcatagtaagttggcacag

SEQ ID NO: 2589 - DNA, 33 bp, Artificial Sequence
  Synthetic Construct
gcccaaaacatgagcatgcccgtcaaagcacag

SEQ ID NO: 2590 - DNA, 33 bp, Artificial Sequence
  Synthetic Construct
gcccaaagcgtcggcgtcggcatgagcgcacag

SEQ ID NO: 2591 - DNA, 33 bp, Artificial Sequence
  Synthetic Construct
gcccaacccagaaccgacaacgaaggcgcacag

SEQ ID NO: 2592 - DNA, 33 bp, Artificial Sequence
  Synthetic Construct
gcccaattcagcaaccccgacagaaccgcacag

SEQ ID NO: 2593 - DNA, 33 bp, Artificial Sequence
  Synthetic Construct
gcccaaatgcacctcgtccccaccaccgcacag

SEQ ID NO: 2594 - DNA, 33 bp, Artificial Sequence
  Synthetic Construct
gcccaaaatgctcctccggtttcttctgcacag

SEQ ID NO: 2595 - DNA, 33 bp, Artificial Sequence
  Synthetic Construct
gcccaatcgaatttgcctactttggcggcacag

SEQ ID NO: 2596 - DNA, 33 bp, Artificial Sequence
  Synthetic Construct
gcccaaatcatgcaaggcatgaccaccgcacag

SEQ ID NO: 2597 - DNA, 33 bp, Artificial Sequence
  Synthetic Construct
gcccaaagtcgtgagacgacgagtcctgcacag

SEQ ID NO: 2598 - DNA, 33 bp, Artificial Sequence
  Synthetic Construct
gcccaaaaccccaccagcttcagcaccgcacag

SEQ ID NO: 2599 - DNA, 33 bp, Artificial Sequence
  Synthetic Construct
gcccaaaatttgcagcatggttcgactgcacag

SEQ ID NO: 2600 - DNA, 33 bp, Artificial Sequence
  Synthetic Construct
gcccaaaattttcattctggtcatacggcacag

SEQ ID NO: 2601 - DNA, 33 bp, Artificial Sequence
  Synthetic Construct
gcccaaactgagagtgtgtatgcgagggcacag

SEQ ID NO: 2602 - DNA, 33 bp, Artificial Sequence
  Synthetic Construct
gcccaaactaagtctgagattcctaatgcacag

SEQ ID NO: 2603 - DNA, 33 bp, Artificial Sequence
  Synthetic Construct
gcccaaaccagcctcgccgacatgagagcacag

SEQ ID NO: 2604 - DNA, 33 bp, Artificial Sequence
  Synthetic Construct
gcccaaagactcaaagccgacatcaccgcacag

SEQ ID NO: 2605 - DNA, 33 bp, Artificial Sequence
  Synthetic Construct
gcccaactgaatatgaatgttctggctgcacag

SEQ ID NO: 2606 - DNA, 33 bp, Artificial Sequence
  Synthetic Construct
gcccaaagcctcagacccatcagcgtcgcacag

SEQ ID NO: 2607 - DNA, 33 bp, Artificial Sequence
  Synthetic Construct
gcccaactcagcgtccaactcgtcgaagcacag

SEQ ID NO: 2608 - DNA, 33 bp, Artificial Sequence
  Synthetic Construct
gcccaaagttttgagggtgttcttccggcacag

SEQ ID NO: 2609 - DNA, 33 bp, Artificial Sequence
  Synthetic Construct
gcccaaatcatcgtcggcctccaacccgcacag

SEQ ID NO: 2610 - DNA, 33 bp, Artificial Sequence
  Synthetic Construct
gcccaagtcagcagctacgaaagactcgcacag

SEQ ID NO: 2611 - DNA, 33 bp, Artificial Sequence
  Synthetic Construct
gcccaaagaaccaacgacgccatcgtcgcacag

SEQ ID NO: 2612 - DNA, 33 bp, Artificial Sequence
  Synthetic Construct
gcccaattcagcgaacacagagaactcgcacag

SEQ ID NO: 2613 - DNA, 33 bp, Artificial Sequence
  Synthetic Construct
gcccaaaaagaagccaccgccaacaccgcacag

SEQ ID NO: 2614 - DNA, 33 bp, Artificial Sequence
  Synthetic Construct
gcccaactcagagccagcatcaccgtcgcacag

SEQ ID NO: 2615 - DNA, 33 bp, Artificial Sequence
  Synthetic Construct
gcccaatggttgggtattactgaggcggcacag

SEQ ID NO: 2616 - DNA, 33 bp, Artificial Sequence
  Synthetic Construct
gcccaaagcagccaaaaagccgccgaagcacag

SEQ ID NO: 2617 - DNA, 33 bp, Artificial Sequence
  Synthetic Construct
gcccaagggtcgactcctggtcttgctgcacag

SEQ ID NO: 2618 - DNA, 33 bp, Artificial Sequence
  Synthetic Construct
gcccaaaaggggaatgctaatgatcttgcacag

SEQ ID NO: 2619 - DNA, 33 bp, Artificial Sequence
  Synthetic Construct
gcccaaaccagcgcccccctcaaactcgcacag

SEQ ID NO: 2620 - DNA, 33 bp, Artificial Sequence
  Synthetic Construct
gcccaacctgtgcagacgaatgggcatgcacag

SEQ ID NO: 2621 - DNA, 33 bp, Artificial Sequence
  Synthetic Construct
gcccaaaggccggctgtggattcggctgcacag

SEQ ID NO: 2622 - DNA, 33 bp, Artificial Sequence
  Synthetic Construct
gcccaaaccaccctcagccaaaacagagcacag

SEQ ID NO: 2623 - DNA, 33 bp, Artificial Sequence
  Synthetic Construct
gcccaagtcatgaccgtcggcagcctcgcacag

SEQ ID NO: 2624 - DNA, 33 bp, Artificial Sequence
  Synthetic Construct
gcccaagccctcaacaaagaaaactgggcacag

SEQ ID NO: 2625 - DNA, 33 bp, Artificial Sequence
  Synthetic Construct
gcccaacatcatcatttgacggggaatgcacag

SEQ ID NO: 2626 - DNA, 33 bp, Artificial Sequence
  Synthetic Construct
gcccaagggatgcggactgtgaatattgcacag

SEQ ID NO: 2627 - DNA, 33 bp, Artificial Sequence
  Synthetic Construct
gcccaaactctgaatagttcggtggctgcacag

SEQ ID NO: 2628 - DNA, 33 bp, Artificial Sequence
  Synthetic Construct
gcccaatctgcttcgacgattcttgttgcacag

SEQ ID NO: 2629 - DNA, 33 bp, Artificial Sequence
  Synthetic Construct
gcccaagagatgattaggcctcgtgcggcacag

SEQ ID NO: 2630 - DNA, 33 bp, Artificial Sequence
  Synthetic Construct
gcccaaatgtcggcggcgagttataaggcacag

SEQ ID NO: 2631 - DNA, 33 bp, Artificial Sequence
  Synthetic Construct
gcccaacattttacgactgggtctgttgcacag

SEQ ID NO: 2632 - DNA, 33 bp, Artificial Sequence
  Synthetic Construct
gcccaagcttctcatactattgggcttgcacag

SEQ ID NO: 2633 - DNA, 33 bp, Artificial Sequence
  Synthetic Construct
gcccaaagtcgggagcatcagctgtatgcacag

SEQ ID NO: 2634 - DNA, 33 bp, Artificial Sequence
  Synthetic Construct
gcccaagctggtacgacggctccgcttgcacag

SEQ ID NO: 2635 - DNA, 33 bp, Artificial Sequence
  Synthetic Construct
gcccaaggcaaagtcagcggcgccatggcacag

SEQ ID NO: 2636 - DNA, 33 bp, Artificial Sequence
  Synthetic Construct
gcccaaaaactcagcggcatgagcgtcgcacag

SEQ ID NO: 2637 - DNA, 33 bp, Artificial Sequence
  Synthetic Construct
gcccaagtcctccccaaagacgacgccgcacag

SEQ ID NO: 2638 - DNA, 33 bp, Artificial Sequence
  Synthetic Construct
gcccaactcgccggcatcctcaccaccgcacag

SEQ ID NO: 2639 - DNA, 33 bp, Artificial Sequence
  Synthetic Construct
gcccaagtcgtccccggcgcccaaaccgcacag

SEQ ID NO: 2640 - DNA, 33 bp, Artificial Sequence
  Synthetic Construct
gcccaaggtcagcattcttatgcgcatgcacag

SEQ ID NO: 2641 - DNA, 33 bp, Artificial Sequence
  Synthetic Construct
gcccaacatcatctgagtacgtcgattgcacag

SEQ ID NO: 2642 - DNA, 33 bp, Artificial Sequence
  Synthetic Construct
gcccaaaccctcatcccccccaaccccgcacag

SEQ ID NO: 2643 - DNA, 33 bp, Artificial Sequence
  Synthetic Construct
gcccaagagatgcataatcctagggcggcacag

SEQ ID NO: 2644 - DNA, 33 bp, Artificial Sequence
  Synthetic Construct
gcccaaatcgaaaacccccccagaggcgcacag

SEQ ID NO: 2645 - DNA, 33 bp, Artificial Sequence
  Synthetic Construct
gcccaaggccaattcagcgacgccagagcacag

SEQ ID NO: 2646 - DNA, 33 bp, Artificial Sequence
  Synthetic Construct
gcccaagccgaagccagcgccagcagagcacag

SEQ ID NO: 2647 - DNA, 33 bp, Artificial Sequence
  Synthetic Construct
gcccaacttgttaagggggatgcgagggcacag

SEQ ID NO: 2648 - DNA, 33 bp, Artificial Sequence
  Synthetic Construct
gcccaacagggtcatacgcatgggaatgcacag

SEQ ID NO: 2649 - DNA, 33 bp, Artificial Sequence
  Synthetic Construct
gcccaacagaagcctacgtctacttttgcacag

SEQ ID NO: 2650 - DNA, 33 bp, Artificial Sequence
  Synthetic Construct
gcccaaaagcttgctgctttgggtgctgcacag

SEQ ID NO: 2651 - DNA, 33 bp, Artificial Sequence
  Synthetic Construct
gcccaatcgtctgtggatcagatgaaggcacag

SEQ ID NO: 2652 - DNA, 33 bp, Artificial Sequence
  Synthetic Construct
gcccaaggcatcgtcaccgcccccctcgcacag

SEQ ID NO: 2653 - DNA, 33 bp, Artificial Sequence
  Synthetic Construct
gcccaacttttgaagatgccttctcctgcacag

SEQ ID NO: 2654 - DNA, 33 bp, Artificial Sequence
  Synthetic Construct
gcccaaaatgttgctcatacggtgcgtgcacag

SEQ ID NO: 2655 - DNA, 33 bp, Artificial Sequence
  Synthetic Construct
gcccaactgatgagtacgaatgtgagtgcacag

SEQ ID NO: 2656 - DNA, 33 bp, Artificial Sequence
  Synthetic Construct
gcccaactgtctaataataatgcgcttgcacag

SEQ ID NO: 2657 - DNA, 33 bp, Artificial Sequence
  Synthetic Construct
gcccaactcctcatcggccccaccggcgcacag

SEQ ID NO: 2658 - DNA, 33 bp, Artificial Sequence
  Synthetic Construct
gcccaagtcagaaacaccatgatcagcgcacag

SEQ ID NO: 2659 - DNA, 33 bp, Artificial Sequence
  Synthetic Construct
gcccaaggcgccaccggccacctcaccgcacag

SEQ ID NO: 2660 - DNA, 33 bp, Artificial Sequence
  Synthetic Construct
gcccaaatgaccgtcggcaacctcggcgcacag

SEQ ID NO: 2661 - DNA, 33 bp, Artificial Sequence
  Synthetic Construct
gcccaaagtaatggtctgaatggtttggcacag

SEQ ID NO: 2662 - DNA, 33 bp, Artificial Sequence
  Synthetic Construct
gcccaacggaatgagaatgagagtcgtgcacag

SEQ ID NO: 2663 - DNA, 33 bp, Artificial Sequence
  Synthetic Construct
gcccaagggaatgctcgggatgcgagtgcacag

SEQ ID NO: 2664 - DNA, 33 bp, Artificial Sequence
  Synthetic Construct
gcccaaatcagcaaactcctcctcagcgcacag

SEQ ID NO: 2665 - DNA, 33 bp, Artificial Sequence
  Synthetic Construct
gcccaaaacgacaccaccaacatgagcgcacag

SEQ ID NO: 2666 - DNA, 33 bp, Artificial Sequence
  Synthetic Construct
gcccaaggcctcgaagccaacaaaagcgcacag

SEQ ID NO: 2667 - DNA, 33 bp, Artificial Sequence
  Synthetic Construct
gcccaacattatagtactgttggggtggcacag

SEQ ID NO: 2668 - DNA, 33 bp, Artificial Sequence
  Synthetic Construct
gcccaacctacgatttcggttctgcctgcacag

SEQ ID NO: 2669 - DNA, 33 bp, Artificial Sequence
  Synthetic Construct
gcccaagtccaaaccatcggccacgaagcacag

SEQ ID NO: 2670 - DNA, 33 bp, Artificial Sequence
  Synthetic Construct
gcccaaaaacccgaaaccgccagcgacgcacag

SEQ ID NO: 2671 - DNA, 33 bp, Artificial Sequence
  Synthetic Construct
gcccaaaccaacacccccaccagcagagcacag

SEQ ID NO: 2672 - DNA, 33 bp, Artificial Sequence
  Synthetic Construct
gcccaaagtttgacgcttagttcgcatgcacag

SEQ ID NO: 2673 - DNA, 33 bp, Artificial Sequence
  Synthetic Construct
gcccaacattatcatagtattcaggctgcacag

SEQ ID NO: 2674 - DNA, 33 bp, Artificial Sequence
  Synthetic Construct
gcccaataccacggcgaaaacgaaagagcacag

SEQ ID NO: 2675 - DNA, 33 bp, Artificial Sequence
  Synthetic Construct
gcccaactgcctcatactgcgcgtgtggcacag

SEQ ID NO: 2676 - DNA, 33 bp, Artificial Sequence
  Synthetic Construct
gcccaaaccagagaaggcagcaccggcgcacag

SEQ ID NO: 2677 - DNA, 33 bp, Artificial Sequence
  Synthetic Construct
gcccaagttgatcgtagggcgatgcttgcacag

SEQ ID NO: 2678 - DNA, 33 bp, Artificial Sequence
  Synthetic Construct
gcccaaaccagcgtcagcgccgtcatggcacag

SEQ ID NO: 2679 - DNA, 33 bp, Artificial Sequence
  Synthetic Construct
gcccaaagccaaaaactcaccgaaaaagcacag

SEQ ID NO: 2680 - DNA, 33 bp, Artificial Sequence
  Synthetic Construct
gcccaaagactccccagcctcagcgtcgcacag

SEQ ID NO: 2681 - DNA, 33 bp, Artificial Sequence
  Synthetic Construct
gcccaaagtgttagtgagggtagtagggcacag

SEQ ID NO: 2682 - DNA, 33 bp, Artificial Sequence
  Synthetic Construct
gcccaaagcatccccagcgtcagcgccgcacag

SEQ ID NO: 2683 - DNA, 33 bp, Artificial Sequence
  Synthetic Construct
gcccaaactactaataatgctaagagtgcacag

SEQ ID NO: 2684 - DNA, 33 bp, Artificial Sequence
  Synthetic Construct
gcccaagcgagtggggaggcttcgactgcacag

SEQ ID NO: 2685 - DNA, 33 bp, Artificial Sequence
  Synthetic Construct
gcccaagataataattcgagtattgctgcacag

SEQ ID NO: 2686 - DNA, 33 bp, Artificial Sequence
  Synthetic Construct
gcccaagtccacgacaacagcaaactcgcacag

SEQ ID NO: 2687 - DNA, 33 bp, Artificial Sequence
  Synthetic Construct
gcccaatctactttggcgggttcggaggcacag

SEQ ID NO: 2688 - DNA, 33 bp, Artificial Sequence
  Synthetic Construct
gcccaacctgagaagagtcattcgtcggcacag

SEQ ID NO: 2689 - DNA, 33 bp, Artificial Sequence
  Synthetic Construct
gcccaacaaatgctcagagccagcgtcgcacag

SEQ ID NO: 2690 - DNA, 33 bp, Artificial Sequence
  Synthetic Construct
gcccaagccctcagcaacaacatcaccgcacag

SEQ ID NO: 2691 - DNA, 33 bp, Artificial Sequence
  Synthetic Construct
gcccaaagtttggcgaatcagttgcctgcacag

SEQ ID NO: 2692 - DNA, 33 bp, Artificial Sequence
  Synthetic Construct
gcccaagaacaaagcagactccaaaccgcacag

SEQ ID NO: 2693 - DNA, 33 bp, Artificial Sequence
  Synthetic Construct
gcccaaaatttgtctcagaatgttatggcacag

SEQ ID NO: 2694 - DNA, 33 bp, Artificial Sequence
  Synthetic Construct
gcccaaagccacaaactcagcagcagcgcacag

SEQ ID NO: 2695 - DNA, 33 bp, Artificial Sequence
  Synthetic Construct
gcccaacctactaatactaagacggcggcacag

SEQ ID NO: 2696 - DNA, 33 bp, Artificial Sequence
  Synthetic Construct
gcccaaatgaatccggctactgtggctgcacag

SEQ ID NO: 2697 - DNA, 33 bp, Artificial Sequence
  Synthetic Construct
gcccaaaagattgagcgtacgaattttgcacag

SEQ ID NO: 2698 - DNA, 33 bp, Artificial Sequence
  Synthetic Construct
gcccaaactagtcctacgtataagttggcacag

SEQ ID NO: 2699 - DNA, 33 bp, Artificial Sequence
  Synthetic Construct
gcccaaaggagtgatcatattgattatgcacag

SEQ ID NO: 2700 - DNA, 33 bp, Artificial Sequence
  Synthetic Construct
gcccaaactcttggtctgaatactaatgcacag

SEQ ID NO: 2701 - DNA, 33 bp, Artificial Sequence
  Synthetic Construct
gcccaacccctcagcaaccacggcaccgcacag

SEQ ID NO: 2702 - DNA, 33 bp, Artificial Sequence
  Synthetic Construct
gcccaagccgtcagcagactccccatggcacag

SEQ ID NO: 2703 - DNA, 33 bp, Artificial Sequence
  Synthetic Construct
gcccaactcctcaccgaaagcaaaatggcacag

SEQ ID NO: 2704 - DNA, 33 bp, Artificial Sequence
  Synthetic Construct
gcccaacatatgaggacggatactgctgcacag

SEQ ID NO: 2705 - DNA, 33 bp, Artificial Sequence
  Synthetic Construct
gcccaaagtcttacggttaatgcggctgcacag

SEQ ID NO: 2706 - DNA, 33 bp, Artificial Sequence
  Synthetic Construct
gcccaaaaccccaacggcgtcaccgtcgcacag

SEQ ID NO: 2707 - DNA, 33 bp, Artificial Sequence
  Synthetic Construct
gcccaaactactaagttgccgactcttgcacag

SEQ ID NO: 2708 - DNA, 33 bp, Artificial Sequence
  Synthetic Construct
gcccaaaattctacgtcgaagcagctggcacag

SEQ ID NO: 2709 - DNA, 33 bp, Artificial Sequence
  Synthetic Construct
gcccaaactttggggtcgtctaatactgcacag

SEQ ID NO: 2710 - DNA, 33 bp, Artificial Sequence
  Synthetic Construct
gcccaaccgcgtgcgactgatccgcaggcacag

SEQ ID NO: 2711 - DNA, 33 bp, Artificial Sequence
  Synthetic Construct
gcccaaagcctcctcaacaaaaccaccgcacag

SEQ ID NO: 2712 - DNA, 33 bp, Artificial Sequence
  Synthetic Construct
gcccaacaaaaaagcgacggcagccccgcacag

SEQ ID NO: 2713 - DNA, 33 bp, Artificial Sequence
  Synthetic Construct
gcccaaaccgtcagcggcttcaccaaagcacag

SEQ ID NO: 2714 - DNA, 33 bp, Artificial Sequence
  Synthetic Construct
gcccaaaccgtcctcgtcaaaagcaccgcacag

SEQ ID NO: 2715 - DNA, 33 bp, Artificial Sequence
  Synthetic Construct
gcccaaggggctcatatttctaatcctgcacag

SEQ ID NO: 2716 - DNA, 33 bp, Artificial Sequence
  Synthetic Construct
gcccaagaacccagcatccccagacccgcacag

SEQ ID NO: 2717 - DNA, 33 bp, Artificial Sequence
  Synthetic Construct
gcccaaggcaccgtccaagccagacaagcacag

SEQ ID NO: 2718 - DNA, 33 bp, Artificial Sequence
  Synthetic Construct
gcccaaaataatcataattatgtggatgcacag

SEQ ID NO: 2719 - DNA, 33 bp, Artificial Sequence
  Synthetic Construct
gcccaaaggacggcgagtgttagtttggcacag

SEQ ID NO: 2720 - DNA, 33 bp, Artificial Sequence
  Synthetic Construct
gcccaaatcagcatggacaaccacagagcacag

SEQ ID NO: 2721 - DNA, 33 bp, Artificial Sequence
  Synthetic Construct
gcccaaagtgatgggcataatcattctgcacag

SEQ ID NO: 2722 - DNA, 33 bp, Artificial Sequence
  Synthetic Construct
gcccaaagcgccggcagcggcatcggcgcacag

SEQ ID NO: 2723 - DNA, 33 bp, Artificial Sequence
  Synthetic Construct
gcccaaaaagccaccctcagcgaaaaagcacag

SEQ ID NO: 2724 - DNA, 33 bp, Artificial Sequence
  Synthetic Construct
gcccaaatccacgccggcggccaaagagcacag

SEQ ID NO: 2725 - DNA, 33 bp, Artificial Sequence
  Synthetic Construct
gcccaactgactcctagtagtgcgaatgcacag

SEQ ID NO: 2726 - DNA, 33 bp, Artificial Sequence
  Synthetic Construct
gcccaagacggcaaagcctacaaccacgcacag

SEQ ID NO: 2727 - DNA, 33 bp, Artificial Sequence
  Synthetic Construct
gcccaatggtcggcgcagacgatgaatgcacag

SEQ ID NO: 2728 - DNA, 33 bp, Artificial Sequence
  Synthetic Construct
gcccaaaatagtacgcggattattgttgcacag

SEQ ID NO: 2729 - DNA, 33 bp, Artificial Sequence
  Synthetic Construct
gcccaaaaaaacagcagcatgctcctcgcacag

SEQ ID NO: 2730 - DNA, 33 bp, Artificial Sequence
  Synthetic Construct
gcccaaagacaagtcagcggcaccagcgcacag

SEQ ID NO: 2731 - DNA, 33 bp, Artificial Sequence
  Synthetic Construct
gcccaacccgtcaccggcaacagcgacgcacag

SEQ ID NO: 2732 - DNA, 33 bp, Artificial Sequence
  Synthetic Construct
gcccaaatgtaccccgacagacacagcgcacag

SEQ ID NO: 2733 - DNA, 33 bp, Artificial Sequence
  Synthetic Construct
gcccaaacctaccaaatcggcgccgtcgcacag

SEQ ID NO: 2734 - DNA, 33 bp, Artificial Sequence
  Synthetic Construct
gcccaaaaaaccggcagcctcagcgccgcacag

SEQ ID NO: 2735 - DNA, 33 bp, Artificial Sequence
  Synthetic Construct
gcccaaatcatccccgccagcagccccgcacag

SEQ ID NO: 2736 - DNA, 33 bp, Artificial Sequence
  Synthetic Construct
gcccaagacaaccaaggcaccaaacacgcacag

SEQ ID NO: 2737 - DNA, 33 bp, Artificial Sequence
  Synthetic Construct
gcccaaagctacaaagaaagccccagcgcacag

SEQ ID NO: 2738 - DNA, 33 bp, Artificial Sequence
  Synthetic Construct
gcccaagccatcatcagcaacaacagagcacag

SEQ ID NO: 2739 - DNA, 33 bp, Artificial Sequence
  Synthetic Construct
gcccaaaccgaccaaatcagaacctacgcacag

SEQ ID NO: 2740 - DNA, 33 bp, Artificial Sequence
  Synthetic Construct
gcccaacacagcgccaccaacatcgacgcacag

SEQ ID NO: 2741 - DNA, 33 bp, Artificial Sequence
  Synthetic Construct
gcccaaggcaccgtcaacatcagcgccgcacag

SEQ ID NO: 2742 - DNA, 33 bp, Artificial Sequence
  Synthetic Construct
gcccaagctgttgttccggctatgcaggcacag

SEQ ID NO: 2743 - DNA, 33 bp, Artificial Sequence
  Synthetic Construct
gcccaaatccccagaagcgaccccagcgcacag

SEQ ID NO: 2744 - DNA, 33 bp, Artificial Sequence
  Synthetic Construct
gcccaaactaagtatacgttgcagagtgcacag

SEQ ID NO: 2745 - DNA, 33 bp, Artificial Sequence
  Synthetic Construct
gcccaatctctgcgtgagacgagtattgcacag

SEQ ID NO: 2746 - DNA, 33 bp, Artificial Sequence
  Synthetic Construct
gcccaagagggtgataataagcggttggcacag

SEQ ID NO: 2747 - DNA, 33 bp, Artificial Sequence
  Synthetic Construct
gcccaaatcgtcagcagcaccagcagcgcacag

SEQ ID NO: 2748 - DNA, 33 bp, Artificial Sequence
  Synthetic Construct
gcccaattggtgaattctggggcgcatgcacag

SEQ ID NO: 2749 - DNA, 33 bp, Artificial Sequence
  Synthetic Construct
gcccaacgtacgtcggataatcagacggcacag

SEQ ID NO: 2750 - DNA, 33 bp, Artificial Sequence
  Synthetic Construct
gcccaacccgacggcaaaagcctcgccgcacag

SEQ ID NO: 2751 - DNA, 33 bp, Artificial Sequence
  Synthetic Construct
gcccaacacaaaaacatgctcgaaaccgcacag

SEQ ID NO: 2752 - DNA, 33 bp, Artificial Sequence
  Synthetic Construct
gcccaactcagccccggcgtcaccgccgcacag

SEQ ID NO: 2753 - DNA, 33 bp, Artificial Sequence
  Synthetic Construct
gcccaaaccaaccacaccagaaacaccgcacag

SEQ ID NO: 2754 - DNA, 33 bp, Artificial Sequence
  Synthetic Construct
gcccaactcggcgacagcgaaagaaacgcacag

SEQ ID NO: 2755 - DNA, 33 bp, Artificial Sequence
  Synthetic Construct
gcccaactcctcaaaatcgaacaaatggcacag

SEQ ID NO: 2756 - DNA, 33 bp, Artificial Sequence
  Synthetic Construct
gcccaaagccacctcaaagaacaccccgcacag

SEQ ID NO: 2757 - DNA, 33 bp, Artificial Sequence
  Synthetic Construct
gcccaacccatcgacaacagacaatacgcacag

SEQ ID NO: 2758 - DNA, 33 bp, Artificial Sequence
  Synthetic Construct
gcccaagatatgcattcgggggtgaaggcacag

SEQ ID NO: 2759 - DNA, 33 bp, Artificial Sequence
  Synthetic Construct
gcccaaccttcgtcgcctattccgaatgcacag

SEQ ID NO: 2760 - DNA, 33 bp, Artificial Sequence
  Synthetic Construct
gcccaactcagcagcaccctcgacgacgcacag

SEQ ID NO: 2761 - DNA, 33 bp, Artificial Sequence
  Synthetic Construct
gcccaacccaacaccgcccacagcagcgcacag

SEQ ID NO: 2762 - DNA, 33 bp, Artificial Sequence
  Synthetic Construct
gcccaagccaccagagtcgacgtcatcgcacag

SEQ ID NO: 2763 - DNA, 33 bp, Artificial Sequence
  Synthetic Construct
gcccaaagcaccaacgtcaccaccgtcgcacag

SEQ ID NO: 2764 - DNA, 33 bp, Artificial Sequence
  Synthetic Construct
gcccaatatggtaataatagttttagtgcacag

SEQ ID NO: 2765 - DNA, 33 bp, Artificial Sequence
  Synthetic Construct
gcccaacccaccgccaaacccatgtacgcacag

SEQ ID NO: 2766 - DNA, 33 bp, Artificial Sequence
  Synthetic Construct
gcccaactccccaacctccccaccatcgcacag

SEQ ID NO: 2767 - DNA, 33 bp, Artificial Sequence
  Synthetic Construct
gcccaaactaggttgccgaatattagtgcacag

SEQ ID NO: 2768 - DNA, 33 bp, Artificial Sequence
  Synthetic Construct
gcccaacataagcattctacgcagggtgcacag

SEQ ID NO: 2769 - DNA, 33 bp, Artificial Sequence
  Synthetic Construct
gcccaaaatggtacgaatggttttactgcacag

SEQ ID NO: 2770 - DNA, 33 bp, Artificial Sequence
  Synthetic Construct
gcccaaagcaccgacgccatcagattcgcacag

SEQ ID NO: 2771 - DNA, 33 bp, Artificial Sequence
  Synthetic Construct
gcccaactggttcgtgatcatacggcggcacag

SEQ ID NO: 2772 - DNA, 33 bp, Artificial Sequence
  Synthetic Construct
gcccaaatcagcctcggctacagcaaagcacag

SEQ ID NO: 2773 - DNA, 33 bp, Artificial Sequence
  Synthetic Construct
gcccaactttttggttcttcgcatacggcacag

SEQ ID NO: 2774 - DNA, 33 bp, Artificial Sequence
  Synthetic Construct
gcccaaagcaccatcacccccagactcgcacag

SEQ ID NO: 2775 - DNA, 33 bp, Artificial Sequence
  Synthetic Construct
gcccaacagattactaatgggctgcgtgcacag

SEQ ID NO: 2776 - DNA, 33 bp, Artificial Sequence
  Synthetic Construct
gcccaaacgacggagtataatattcgtgcacag

SEQ ID NO: 2777 - DNA, 33 bp, Artificial Sequence
  Synthetic Construct
gcccaaaccgacctcggcagaggcaccgcacag

SEQ ID NO: 2778 - DNA, 33 bp, Artificial Sequence
  Synthetic Construct
gcccaagaaagaagccccaccatcctcgcacag

SEQ ID NO: 2779 - DNA, 33 bp, Artificial Sequence
  Synthetic Construct
gcccaacatggggattctgcgaggactgcacag

SEQ ID NO: 2780 - DNA, 33 bp, Artificial Sequence
  Synthetic Construct
gcccaattgagtgtgcctaatcagcaggcacag

SEQ ID NO: 2781 - DNA, 33 bp, Artificial Sequence
  Synthetic Construct
gcccaaagcgacggccccgtccccagagcacag

SEQ ID NO: 2782 - DNA, 33 bp, Artificial Sequence
  Synthetic Construct
gcccaaaatatgaatcatattgcttctgcacag

SEQ ID NO: 2783 - DNA, 33 bp, Artificial Sequence
  Synthetic Construct
gcccaagtccccaacagcccccaaagagcacag

SEQ ID NO: 2784 - DNA, 33 bp, Artificial Sequence
  Synthetic Construct
gcccaagacagaatggccagcagcagagcacag

SEQ ID NO: 2785 - DNA, 33 bp, Artificial Sequence
  Synthetic Construct
gcccaattgctgtcgaattcgagtcaggcacag

SEQ ID NO: 2786 - DNA, 33 bp, Artificial Sequence
  Synthetic Construct
gcccaagagacggcggtgttgaatcatgcacag

SEQ ID NO: 2787 - DNA, 33 bp, Artificial Sequence
  Synthetic Construct
gcccaagaacaaagaacccccagccccgcacag

SEQ ID NO: 2788 - DNA, 33 bp, Artificial Sequence
  Synthetic Construct
gcccaacaacacctcaacggcagcatcgcacag

SEQ ID NO: 2789 - DNA, 33 bp, Artificial Sequence
  Synthetic Construct
gcccaaagcgtcctccaagtcgaaggcgcacag

SEQ ID NO: 2790 - DNA, 33 bp, Artificial Sequence
  Synthetic Construct
gcccaatttctgtcgggtacgactaaggcacag

SEQ ID NO: 2791 - DNA, 33 bp, Artificial Sequence
  Synthetic Construct
gcccaaggtaatccgaatgatcggcaggcacag

SEQ ID NO: 2792 - DNA, 33 bp, Artificial Sequence
  Synthetic Construct
gcccaaaccgacaaagccgtccaaatcgcacag

SEQ ID NO: 2793 - DNA, 33 bp, Artificial Sequence
  Synthetic Construct
gcccaagagaagtatacgggttcgcctgcacag

SEQ ID NO: 2794 - DNA, 33 bp, Artificial Sequence
  Synthetic Construct
gcccaactcgccggcagcagaaacctcgcacag

SEQ ID NO: 2795 - DNA, 33 bp, Artificial Sequence
  Synthetic Construct
gcccaaatgatccccagcaccaacttcgcacag

SEQ ID NO: 2796 - DNA, 33 bp, Artificial Sequence
  Synthetic Construct
gcccaacctttgacgggttctagtgctgcacag

SEQ ID NO: 2797 - DNA, 33 bp, Artificial Sequence
  Synthetic Construct
gcccaaagcgtcagcaacgccttcagcgcacag

SEQ ID NO: 2798 - DNA, 33 bp, Artificial Sequence
  Synthetic Construct
gcccaacaggggggtcaggcgcttagggcacag

SEQ ID NO: 2799 - DNA, 33 bp, Artificial Sequence
  Synthetic Construct
gcccaacaccccggccaaaccctcagcgcacag

SEQ ID NO: 2800 - DNA, 33 bp, Artificial Sequence
  Synthetic Construct
gcccaaaaggagtataatacgtatagtgcacag

SEQ ID NO: 2801 - DNA, 33 bp, Artificial Sequence
  Synthetic Construct
gcccaaacccacaccgcccaacccagcgcacag

SEQ ID NO: 2802 - DNA, 33 bp, Artificial Sequence
  Synthetic Construct
gcccaaatgacgccgcaggttcctcgtgcacag

SEQ ID NO: 2803 - DNA, 33 bp, Artificial Sequence
  Synthetic Construct
gcccaaactcgggtttctagtcttgcggcacag

SEQ ID NO: 2804 - DNA, 33 bp, Artificial Sequence
  Synthetic Construct
gcccaacacgccgacctcaaaatcgtcgcacag

SEQ ID NO: 2805 - DNA, 33 bp, Artificial Sequence
  Synthetic Construct
gcccaaaacagaaacaccgacaccgtcgcacag

SEQ ID NO: 2806 - DNA, 33 bp, Artificial Sequence
  Synthetic Construct
gcccaagcccacaaagacaaccacctcgcacag

SEQ ID NO: 2807 - DNA, 33 bp, Artificial Sequence
  Synthetic Construct
gcccaatctgttcctgtgcctgctgctgcacag

SEQ ID NO: 2808 - DNA, 33 bp, Artificial Sequence
  Synthetic Construct
gcccaacaaaccaacagcgccctcatggcacag

SEQ ID NO: 2809 - DNA, 33 bp, Artificial Sequence
  Synthetic Construct
gcccaactcggcagagacaccgcctacgcacag

SEQ ID NO: 2810 - DNA, 33 bp, Artificial Sequence
  Synthetic Construct
gcccaaagttctgttgctcttgttgttgcacag

SEQ ID NO: 2811 - DNA, 33 bp, Artificial Sequence
  Synthetic Construct
gcccaaatgaacgccgccaccacccaagcacag

SEQ ID NO: 2812 - DNA, 33 bp, Artificial Sequence
  Synthetic Construct
gcccaaatggtttctacggctaaggatgcacag

SEQ ID NO: 2813 - DNA, 33 bp, Artificial Sequence
  Synthetic Construct
gcccaactgggtcagatgtattctccggcacag

SEQ ID NO: 2814 - DNA, 33 bp, Artificial Sequence
  Synthetic Construct
gcccaagattcgaaggagaagcctaatgcacag

SEQ ID NO: 2815 - DNA, 33 bp, Artificial Sequence
  Synthetic Construct
gcccaaagcccccccgtccaaggcctcgcacag

SEQ ID NO: 2816 - DNA, 33 bp, Artificial Sequence
  Synthetic Construct
gcccaaactgcgtcggatcgtttgccggcacag

SEQ ID NO: 2817 - DNA, 33 bp, Artificial Sequence
  Synthetic Construct
gcccaaatctacagccccaccaccgtcgcacag

SEQ ID NO: 2818 - DNA, 33 bp, Artificial Sequence
  Synthetic Construct
gcccaaagtcagtctaaggagctgcgggcacag

SEQ ID NO: 2819 - DNA, 33 bp, Artificial Sequence
  Synthetic Construct
gcccaaggcgccctcaacggcggcgtcgcacag

SEQ ID NO: 2820 - DNA, 33 bp, Artificial Sequence
  Synthetic Construct
gcccaaactattattaattcgagtaaggcacag

SEQ ID NO: 2821 - DNA, 33 bp, Artificial Sequence
  Synthetic Construct
gcccaacctgtgagtgctcagcctgttgcacag

SEQ ID NO: 2822 - DNA, 33 bp, Artificial Sequence
  Synthetic Construct
gcccaatctaatgaggcggtgactaatgcacag

SEQ ID NO: 2823 - DNA, 33 bp, Artificial Sequence
  Synthetic Construct
gcccaagcgagtatgcagatgaatcgtgcacag

SEQ ID NO: 2824 - DNA, 33 bp, Artificial Sequence
  Synthetic Construct
gcccaaagcgtcggcaaaagcgaactcgcacag

SEQ ID NO: 2825 - DNA, 33 bp, Artificial Sequence
  Synthetic Construct
gcccaatctcaggttaatccttctagtgcacag

SEQ ID NO: 2826 - DNA, 33 bp, Artificial Sequence
  Synthetic Construct
gcccaaattacgactgatcagccttttgcacag

SEQ ID NO: 2827 - DNA, 33 bp, Artificial Sequence
  Synthetic Construct
gcccaaaataatgggtctggttcttatgcacag

SEQ ID NO: 2828 - DNA, 33 bp, Artificial Sequence
  Synthetic Construct
gcccaaaccctcgccagaagcagcgtcgcacag

SEQ ID NO: 2829 - DNA, 33 bp, Artificial Sequence
  Synthetic Construct
gcccaaaacgccagcaccatgaccagagcacag

SEQ ID NO: 2830 - DNA, 33 bp, Artificial Sequence
  Synthetic Construct
gcccaaacgaatcaggtgaggtatgttgcacag

SEQ ID NO: 2831 - DNA, 33 bp, Artificial Sequence
  Synthetic Construct
gcccaaagcacccaaagccccaacagagcacag

SEQ ID NO: 2832 - DNA, 33 bp, Artificial Sequence
  Synthetic Construct
gcccaagatacgggggcgagggggttggcacag

SEQ ID NO: 2833 - DNA, 33 bp, Artificial Sequence
  Synthetic Construct
gcccaacctggttctcatgtggtggctgcacag

SEQ ID NO: 2834 - DNA, 33 bp, Artificial Sequence
  Synthetic Construct
gcccaagccaacggcatcgaaaccaaagcacag

SEQ ID NO: 2835 - DNA, 33 bp, Artificial Sequence
  Synthetic Construct
gcccaagcgcatggtcaggtgcaggaggcacag

SEQ ID NO: 2836 - DNA, 33 bp, Artificial Sequence
  Synthetic Construct
gcccaagctctgagtcatgatctttcggcacag

SEQ ID NO: 2837 - DNA, 33 bp, Artificial Sequence
  Synthetic Construct
gcccaactcggcagcagcctcaccgccgcacag

SEQ ID NO: 2838 - DNA, 33 bp, Artificial Sequence
  Synthetic Construct
gcccaaggcaacaacaccgccaaactcgcacag

SEQ ID NO: 2839 - DNA, 33 bp, Artificial Sequence
  Synthetic Construct
gcccaaaattatgctcagtctgcgcttgcacag

SEQ ID NO: 2840 - DNA, 33 bp, Artificial Sequence
  Synthetic Construct
gcccaagattcgcagagtaagacttttgcacag

SEQ ID NO: 2841 - DNA, 33 bp, Artificial Sequence
  Synthetic Construct
gcccaaactaatcatgttaagtttacggcacag

SEQ ID NO: 2842 - DNA, 33 bp, Artificial Sequence
  Synthetic Construct
gcccaaagcacccccacccacggcctcgcacag

SEQ ID NO: 2843 - DNA, 33 bp, Artificial Sequence
  Synthetic Construct
gcccaaagtgtggggttgacgatggtggcacag

SEQ ID NO: 2844 - DNA, 33 bp, Artificial Sequence
  Synthetic Construct
gcccaaattccgaagggttctggggcggcacag

SEQ ID NO: 2845 - DNA, 33 bp, Artificial Sequence
  Synthetic Construct
gcccaaaccgcccaagccagagtcctcgcacag

SEQ ID NO: 2846 - DNA, 33 bp, Artificial Sequence
  Synthetic Construct
gcccaatggcacgccggcagcgtcggcgcacag

SEQ ID NO: 2847 - DNA, 33 bp, Artificial Sequence
  Synthetic Construct
gcccaatcgcagtctcttttggttgaggcacag

SEQ ID NO: 2848 - DNA, 33 bp, Artificial Sequence
  Synthetic Construct
gcccaaaataatagtgggcctttgaaggcacag

SEQ ID NO: 2849 - DNA, 33 bp, Artificial Sequence
  Synthetic Construct
gcccaaagggataatgctattgagcatgcacag

SEQ ID NO: 2850 - DNA, 33 bp, Artificial Sequence
  Synthetic Construct
gcccaaactatgtcgaatattacgagggcacag

SEQ ID NO: 2851 - DNA, 33 bp, Artificial Sequence
  Synthetic Construct
gcccaactcagcaccctcagccaaatggcacag

SEQ ID NO: 2852 - DNA, 33 bp, Artificial Sequence
  Synthetic Construct
gcccaagtcatgcaaaactacggcagcgcacag

SEQ ID NO: 2853 - DNA, 33 bp, Artificial Sequence
  Synthetic Construct
gcccaaactcattcggcgcagcagaatgcacag

SEQ ID NO: 2854 - DNA, 33 bp, Artificial Sequence
  Synthetic Construct
gcccaatcggttcctccgaataggaatgcacag

SEQ ID NO: 2855 - DNA, 33 bp, Artificial Sequence
  Synthetic Construct
gcccaatctgttgcggcgagtcctcgtgcacag

SEQ ID NO: 2856 - DNA, 33 bp, Artificial Sequence
  Synthetic Construct
gcccaaaataatacttcgacgctgcatgcacag

SEQ ID NO: 2857 - DNA, 33 bp, Artificial Sequence
  Synthetic Construct
gcccaaaatctttctgatcatatgccggcacag

SEQ ID NO: 2858 - DNA, 33 bp, Artificial Sequence
  Synthetic Construct
gcccaaggtctgtatgctacgacttctgcacag

SEQ ID NO: 2859 - DNA, 33 bp, Artificial Sequence
  Synthetic Construct
gcccaacgtaatggtggtgcgaatgttgcacag

SEQ ID NO: 2860 - DNA, 33 bp, Artificial Sequence
  Synthetic Construct
gcccaattccacaacctcaccctcagcgcacag

SEQ ID NO: 2861 - DNA, 33 bp, Artificial Sequence
  Synthetic Construct
gcccaatggaagagtcctgctgctattgcacag

SEQ ID NO: 2862 - DNA, 33 bp, Artificial Sequence
  Synthetic Construct
gcccaacccaaaggcctcagcggcgaagcacag

SEQ ID NO: 2863 - DNA, 33 bp, Artificial Sequence
  Synthetic Construct
gcccaatcgcattatcagttgcatccggcacag

SEQ ID NO: 2864 - DNA, 33 bp, Artificial Sequence
  Synthetic Construct
gcccaaaccaccttcagaagcgcccccgcacag

SEQ ID NO: 2865 - DNA, 33 bp, Artificial Sequence
  Synthetic Construct
gcccaatacgacgccacccacagcgccgcacag

SEQ ID NO: 2866 - DNA, 33 bp, Artificial Sequence
  Synthetic Construct
gcccaaaatcagtcgggtccgttgaaggcacag

SEQ ID NO: 2867 - DNA, 33 bp, Artificial Sequence
  Synthetic Construct
gcccaacacaccaacatgaccagcatggcacag

SEQ ID NO: 2868 - DNA, 33 bp, Artificial Sequence
  Synthetic Construct
gcccaacatatgaagagtcagctgccggcacag

SEQ ID NO: 2869 - DNA, 33 bp, Artificial Sequence
  Synthetic Construct
gcccaaaaactccccaccatggccaacgcacag

SEQ ID NO: 2870 - DNA, 33 bp, Artificial Sequence
  Synthetic Construct
gcccaagttgggactaatgcgaatcatgcacag

SEQ ID NO: 2871 - DNA, 33 bp, Artificial Sequence
  Synthetic Construct
gcccaattgaagactgatccttttctggcacag

SEQ ID NO: 2872 - DNA, 33 bp, Artificial Sequence
  Synthetic Construct
gcccaacacctccaacaaaacctcaccgcacag

SEQ ID NO: 2873 - DNA, 33 bp, Artificial Sequence
  Synthetic Construct
gcccaaactcagaataagaattctcatgcacag

SEQ ID NO: 2874 - DNA, 33 bp, Artificial Sequence
  Synthetic Construct
gcccaacccaacgcccaaagccaaagagcacag

SEQ ID NO: 2875 - DNA, 33 bp, Artificial Sequence
  Synthetic Construct
gcccaaggtagtggtcattcgactcttgcacag

SEQ ID NO: 2876 - DNA, 33 bp, Artificial Sequence
  Synthetic Construct
gcccaattgacgggtaggcttgagaaggcacag

SEQ ID NO: 2877 - DNA, 33 bp, Artificial Sequence
  Synthetic Construct
gcccaacccagcagaaacgccagcctcgcacag

SEQ ID NO: 2878 - DNA, 33 bp, Artificial Sequence
  Synthetic Construct
gcccaagtttttaggacgtcggatcttgcacag

SEQ ID NO: 2879 - DNA, 33 bp, Artificial Sequence
  Synthetic Construct
gcccaaatcgccagcacctacagcagcgcacag

SEQ ID NO: 2880 - DNA, 33 bp, Artificial Sequence
  Synthetic Construct
gcccaaaccatcaaccacgccaccagcgcacag

SEQ ID NO: 2881 - DNA, 33 bp, Artificial Sequence
  Synthetic Construct
gcccaagctatgaataatcgtgctcatgcacag

SEQ ID NO: 2882 - DNA, 33 bp, Artificial Sequence
  Synthetic Construct
gcccaatcgcatcatgagcaggtttctgcacag

SEQ ID NO: 2883 - DNA, 33 bp, Artificial Sequence
  Synthetic Construct
gcccaatcgggggttactagtaagcttgcacag

SEQ ID NO: 2884 - DNA, 33 bp, Artificial Sequence
  Synthetic Construct
gcccaagtgtttactaatgatgtgcctgcacag

SEQ ID NO: 2885 - DNA, 33 bp, Artificial Sequence
  Synthetic Construct
gcccaagctgcggtgttggtggctccggcacag

SEQ ID NO: 2886 - DNA, 33 bp, Artificial Sequence
  Synthetic Construct
gcccaacccaccgccggcagatacctcgcacag

SEQ ID NO: 2887 - DNA, 33 bp, Artificial Sequence
  Synthetic Construct
gcccaacatcttaattcgcagaatatggcacag

SEQ ID NO: 2888 - DNA, 33 bp, Artificial Sequence
  Synthetic Construct
gcccaacccaaccccaacgtcggcagagcacag

SEQ ID NO: 2889 - DNA, 33 bp, Artificial Sequence
  Synthetic Construct
gcccaagctagtgagaatcttcgttcggcacag

SEQ ID NO: 2890 - DNA, 33 bp, Artificial Sequence
  Synthetic Construct
gcccaaaatagtccgatgaggactgctgcacag

SEQ ID NO: 2891 - DNA, 33 bp, Artificial Sequence
  Synthetic Construct
gcccaagttgctggtacgaatcagccggcacag

SEQ ID NO: 2892 - DNA, 33 bp, Artificial Sequence
  Synthetic Construct
gcccaagggtcggagtctagtatgcgggcacag

SEQ ID NO: 2893 - DNA, 33 bp, Artificial Sequence
  Synthetic Construct
gcccaaacgttggcgtctgcttcgcgggcacag

SEQ ID NO: 2894 - DNA, 33 bp, Artificial Sequence
  Synthetic Construct
gcccaaatttcgcagtcttggactgctgcacag

SEQ ID NO: 2895 - DNA, 33 bp, Artificial Sequence
  Synthetic Construct
gcccaaagtggtgattcgaggtctactgcacag

SEQ ID NO: 2896 - DNA, 33 bp, Artificial Sequence
  Synthetic Construct
gcccaacccaacatcaaaaccgacctcgcacag

SEQ ID NO: 2897 - DNA, 33 bp, Artificial Sequence
  Synthetic Construct
gcccaatggcaagccaccgacaccgccgcacag

SEQ ID NO: 2898 - DNA, 33 bp, Artificial Sequence
  Synthetic Construct
gcccaaaacaacaacgtcgtcacctacgcacag

SEQ ID NO: 2899 - DNA, 33 bp, Artificial Sequence
  Synthetic Construct
gcccaaaaggctattagtacggctaatgcacag

SEQ ID NO: 2900 - DNA, 33 bp, Artificial Sequence
  Synthetic Construct
gcccaaaggcaggaggtgagtggtaatgcacag

SEQ ID NO: 2901 - DNA, 33 bp, Artificial Sequence
  Synthetic Construct
gcccaatggcaagacctcaacgtcgtcgcacag

SEQ ID NO: 2902 - DNA, 33 bp, Artificial Sequence
  Synthetic Construct
gcccaaagtcgttctgataatcctctggcacag

SEQ ID NO: 2903 - DNA, 33 bp, Artificial Sequence
  Synthetic Construct
gcccaaattggttcgtctactaagcctgcacag

SEQ ID NO: 2904 - DNA, 33 bp, Artificial Sequence
  Synthetic Construct
gcccaaagccccatcatcaacaccagcgcacag

SEQ ID NO: 2905 - DNA, 33 bp, Artificial Sequence
  Synthetic Construct
gcccaagataaggatactgctgctcctgcacag

SEQ ID NO: 2906 - DNA, 33 bp, Artificial Sequence
  Synthetic Construct
gcccaaagcaaagtcgacagcagctacgcacag

SEQ ID NO: 2907 - DNA, 33 bp, Artificial Sequence
  Synthetic Construct
gcccaaaccctcaccagaggcacccccgcacag

SEQ ID NO: 2908 - DNA, 33 bp, Artificial Sequence
  Synthetic Construct
gcccaaaccagaaccagccccatccaagcacag

SEQ ID NO: 2909 - DNA, 33 bp, Artificial Sequence
  Synthetic Construct
gcccaactgactagtgcgactactaatgcacag

SEQ ID NO: 2910 - DNA, 33 bp, Artificial Sequence
  Synthetic Construct
gcccaaacgattaatattcattcggctgcacag

SEQ ID NO: 2911 - DNA, 33 bp, Artificial Sequence
  Synthetic Construct
gcccaatcgttttcgcctgagaatcgtgcacag

SEQ ID NO: 2912 - DNA, 33 bp, Artificial Sequence
  Synthetic Construct
gcccaagggatggctctggggacgggggcacag

SEQ ID NO: 2913 - DNA, 33 bp, Artificial Sequence
  Synthetic Construct
gcccaatacaacggcacccaaggcagagcacag

SEQ ID NO: 2914 - DNA, 33 bp, Artificial Sequence
  Synthetic Construct
gcccaaaacaaactcctcgaacaccccgcacag

SEQ ID NO: 2915 - DNA, 33 bp, Artificial Sequence
  Synthetic Construct
gcccaatatgttaataatgttgctccggcacag

SEQ ID NO: 2916 - DNA, 33 bp, Artificial Sequence
  Synthetic Construct
gcccaatatagtgtggtgcatgataaggcacag

SEQ ID NO: 2917 - DNA, 33 bp, Artificial Sequence
  Synthetic Construct
gcccaaggcctcgaaaccagacacatggcacag

SEQ ID NO: 2918 - DNA, 33 bp, Artificial Sequence
  Synthetic Construct
gcccaagcgcctaatttgatggcggatgcacag

SEQ ID NO: 2919 - DNA, 33 bp, Artificial Sequence
  Synthetic Construct
gcccaaaacagcaacggcatggcccccgcacag

SEQ ID NO: 2920 - DNA, 33 bp, Artificial Sequence
  Synthetic Construct
gcccaaagtttgaattatagtcagaatgcacag

SEQ ID NO: 2921 - DNA, 33 bp, Artificial Sequence
  Synthetic Construct
gcccaaaccgaatacgccaacggcagagcacag

SEQ ID NO: 2922 - DNA, 33 bp, Artificial Sequence
  Synthetic Construct
gcccaacctcttgggcatgttaggtctgcacag

SEQ ID NO: 2923 - DNA, 33 bp, Artificial Sequence
  Synthetic Construct
gcccaacttcgggattcgccggggctggcacag

SEQ ID NO: 2924 - DNA, 33 bp, Artificial Sequence
  Synthetic Construct
gcccaagttattaggtcgaatactcatgcacag

SEQ ID NO: 2925 - DNA, 33 bp, Artificial Sequence
  Synthetic Construct
gcccaagcgtcggtgagtaatctttcggcacag

SEQ ID NO: 2926 - DNA, 33 bp, Artificial Sequence
  Synthetic Construct
gcccaatgggcccaaagaaccagccaagcacag

SEQ ID NO: 2927 - DNA, 33 bp, Artificial Sequence
  Synthetic Construct
gcccaaaacgacaaaggcatgagcagagcacag

SEQ ID NO: 2928 - DNA, 33 bp, Artificial Sequence
  Synthetic Construct
gcccaacagaatgatactcgtaattatgcacag

SEQ ID NO: 2929 - DNA, 33 bp, Artificial Sequence
  Synthetic Construct
gcccaaggcgaagtcgccggcagactcgcacag

SEQ ID NO: 2930 - DNA, 33 bp, Artificial Sequence
  Synthetic Construct
gcccaaaccaccaccaacaccgtcagcgcacag

SEQ ID NO: 2931 - DNA, 33 bp, Artificial Sequence
  Synthetic Construct
gcccaaccggttatgtcgaataaggatgcacag

SEQ ID NO: 2932 - DNA, 33 bp, Artificial Sequence
  Synthetic Construct
gcccaaaacggcggcaccaccttcatcgcacag

SEQ ID NO: 2933 - DNA, 33 bp, Artificial Sequence
  Synthetic Construct
gcccaagttttgaagactacggctattgcacag

SEQ ID NO: 2934 - DNA, 33 bp, Artificial Sequence
  Synthetic Construct
gcccaaccccacggcgtcggcagcgccgcacag

SEQ ID NO: 2935 - DNA, 33 bp, Artificial Sequence
  Synthetic Construct
gcccaatctaatgcgcatcctctggctgcacag

SEQ ID NO: 2936 - DNA, 33 bp, Artificial Sequence
  Synthetic Construct
gcccaaaaaagcaccagcctcgaccccgcacag

SEQ ID NO: 2937 - DNA, 33 bp, Artificial Sequence
  Synthetic Construct
gcccaattcaacaaaaccaacgacatggcacag

SEQ ID NO: 2938 - DNA, 33 bp, Artificial Sequence
  Synthetic Construct
gcccaacaccaaaccagcgaactcagagcacag

SEQ ID NO: 2939 - DNA, 33 bp, Artificial Sequence
  Synthetic Construct
gcccaatgggccaaagtcctcgacaaagcacag

SEQ ID NO: 2940 - DNA, 33 bp, Artificial Sequence
  Synthetic Construct
gcccaaatgagcagcaacaacaaaagcgcacag

SEQ ID NO: 2941 - DNA, 33 bp, Artificial Sequence
  Synthetic Construct
gcccaagatggtactcatttgaagctggcacag

SEQ ID NO: 2942 - DNA, 33 bp, Artificial Sequence
  Synthetic Construct
gcccaaacggttattagtgatcagagggcacag

SEQ ID NO: 2943 - DNA, 33 bp, Artificial Sequence
  Synthetic Construct
gcccaaatgcacagccaactcctccccgcacag

SEQ ID NO: 2944 - DNA, 33 bp, Artificial Sequence
  Synthetic Construct
gcccaatcgtcttatgggactgcggcggcacag

SEQ ID NO: 2945 - DNA, 33 bp, Artificial Sequence
  Synthetic Construct
gcccaagtgttgtctacgatggctgttgcacag

SEQ ID NO: 2946 - DNA, 33 bp, Artificial Sequence
  Synthetic Construct
gcccaatcggcttcgaattttgcgtctgcacag

SEQ ID NO: 2947 - DNA, 33 bp, Artificial Sequence
  Synthetic Construct
gcccaaagtaaggctggtctgagtgatgcacag

SEQ ID NO: 2948 - DNA, 33 bp, Artificial Sequence
  Synthetic Construct
gcccaaattaatcggattgttagtggggcacag

SEQ ID NO: 2949 - DNA, 33 bp, Artificial Sequence
  Synthetic Construct
gcccaaaaactcgacacccccggcaaagcacag

SEQ ID NO: 2950 - DNA, 33 bp, Artificial Sequence
  Synthetic Construct
gcccaaatggatcgtattgttaagatggcacag

SEQ ID NO: 2951 - DNA, 33 bp, Artificial Sequence
  Synthetic Construct
gcccaaagagaaagaagcaccgacgccgcacag

SEQ ID NO: 2952 - DNA, 33 bp, Artificial Sequence
  Synthetic Construct
gcccaactcagagacagcaccggccacgcacag

SEQ ID NO: 2953 - DNA, 33 bp, Artificial Sequence
  Synthetic Construct
gcccaaatgagaggccaaggcgtccacgcacag

SEQ ID NO: 2954 - DNA, 33 bp, Artificial Sequence
  Synthetic Construct
gcccaaagcgcccaaatgatcagccccgcacag

SEQ ID NO: 2955 - DNA, 33 bp, Artificial Sequence
  Synthetic Construct
gcccaatggacgaatggtgttgcgaaggcacag

SEQ ID NO: 2956 - DNA, 33 bp, Artificial Sequence
  Synthetic Construct
gcccaaaccgccatcagcatccaagtcgcacag

SEQ ID NO: 2957 - DNA, 33 bp, Artificial Sequence
  Synthetic Construct
gcccaaccgagtggttcgcagtcgcatgcacag

SEQ ID NO: 2958 - DNA, 33 bp, Artificial Sequence
  Synthetic Construct
gcccaaaacagactcacccccggcagcgcacag

SEQ ID NO: 2959 - DNA, 33 bp, Artificial Sequence
  Synthetic Construct
gcccaaattgctcttgagcataggaatgcacag

SEQ ID NO: 2960 - DNA, 33 bp, Artificial Sequence
  Synthetic Construct
gcccaacccgccagaacccccccccaagcacag

SEQ ID NO: 2961 - DNA, 33 bp, Artificial Sequence
  Synthetic Construct
gcccaaatgggcaaaagcaacggcgtcgcacag

SEQ ID NO: 2962 - DNA, 33 bp, Artificial Sequence
  Synthetic Construct
gcccaacccatcgtcagaagcaccagcgcacag

SEQ ID NO: 2963 - DNA, 33 bp, Artificial Sequence
  Synthetic Construct
gcccaagtcacccaactcagccccagagcacag

SEQ ID NO: 2964 - DNA, 33 bp, Artificial Sequence
  Synthetic Construct
gcccaaaaagccctcctccccctcaccgcacag

SEQ ID NO: 2965 - DNA, 33 bp, Artificial Sequence
  Synthetic Construct
gcccaaagcggcaacagcagactccaagcacag

SEQ ID NO: 2966 - DNA, 33 bp, Artificial Sequence
  Synthetic Construct
gcccaacgtaatcagagtgcgccgcttgcacag

SEQ ID NO: 2967 - DNA, 33 bp, Artificial Sequence
  Synthetic Construct
gcccaaaacctccaaaacatgatccaagcacag

SEQ ID NO: 2968 - DNA, 33 bp, Artificial Sequence
  Synthetic Construct
gcccaatcgtcgtatgataagagtcttgcacag

SEQ ID NO: 2969 - DNA, 33 bp, Artificial Sequence
  Synthetic Construct
gcccaagtcctcgccaaccaacaaatcgcacag

SEQ ID NO: 2970 - DNA, 33 bp, Artificial Sequence
  Synthetic Construct
gcccaacggactacgaatgagcctactgcacag

SEQ ID NO: 2971 - DNA, 33 bp, Artificial Sequence
  Synthetic Construct
gcccaaatcgtcagcaaccaaatgagcgcacag

SEQ ID NO: 2972 - DNA, 33 bp, Artificial Sequence
  Synthetic Construct
gcccaaaatgcgacgcatgctaatgttgcacag

SEQ ID NO: 2973 - DNA, 33 bp, Artificial Sequence
  Synthetic Construct
gcccaaaaggggaatgagccgttgcgggcacag

SEQ ID NO: 2974 - DNA, 33 bp, Artificial Sequence
  Synthetic Construct
gcccaactcggcacctacctcagccccgcacag

SEQ ID NO: 2975 - DNA, 33 bp, Artificial Sequence
  Synthetic Construct
gcccaaaccaacgtcctccccctccccgcacag

SEQ ID NO: 2976 - DNA, 33 bp, Artificial Sequence
  Synthetic Construct
gcccaaaagctgtcgcatgagcctagtgcacag

SEQ ID NO: 2977 - DNA, 33 bp, Artificial Sequence
  Synthetic Construct
gcccaattcgacaaacaaaaccccaccgcacag

SEQ ID NO: 2978 - DNA, 33 bp, Artificial Sequence
  Synthetic Construct
gcccaatttgggggtcgttatgagaaggcacag

SEQ ID NO: 2979 - DNA, 33 bp, Artificial Sequence
  Synthetic Construct
gcccaaaccgtccaaaaccacaccaacgcacag

SEQ ID NO: 2980 - DNA, 33 bp, Artificial Sequence
  Synthetic Construct
gcccaaccgctgaagccgatgcagacggcacag

SEQ ID NO: 2981 - DNA, 33 bp, Artificial Sequence
  Synthetic Construct
gcccaacaaggcgaaaccaaccacagagcacag

SEQ ID NO: 2982 - DNA, 33 bp, Artificial Sequence
  Synthetic Construct
gcccaagcccacagcaacatggtcaacgcacag

SEQ ID NO: 2983 - DNA, 33 bp, Artificial Sequence
  Synthetic Construct
gcccaagtgagtgcgagtagtaataaggcacag

SEQ ID NO: 2984 - DNA, 33 bp, Artificial Sequence
  Synthetic Construct
gcccaaactaatcagtcgaagaattttgcacag

SEQ ID NO: 2985 - DNA, 33 bp, Artificial Sequence
  Synthetic Construct
gcccaaaagatgaaggatatgagtattgcacag

SEQ ID NO: 2986 - DNA, 33 bp, Artificial Sequence
  Synthetic Construct
gcccaacaccccagcggcagcaccctcgcacag

SEQ ID NO: 2987 - DNA, 33 bp, Artificial Sequence
  Synthetic Construct
gcccaaattaaggatactgtttctggggcacag

SEQ ID NO: 2988 - DNA, 33 bp, Artificial Sequence
  Synthetic Construct
gcccaaatgaacaccctcaccaacgtcgcacag

SEQ ID NO: 2989 - DNA, 33 bp, Artificial Sequence
  Synthetic Construct
gcccaaactgatagtgctccgcatccggcacag

SEQ ID NO: 2990 - DNA, 33 bp, Artificial Sequence
  Synthetic Construct
gcccaacccagacccgtcagcaacggcgcacag

SEQ ID NO: 2991 - DNA, 33 bp, Artificial Sequence
  Synthetic Construct
gcccaatctgttgataggcggccgcaggcacag

SEQ ID NO: 2992 - DNA, 33 bp, Artificial Sequence
  Synthetic Construct
gcccaaatggattctcctattaggaatgcacag

SEQ ID NO: 2993 - DNA, 33 bp, Artificial Sequence
  Synthetic Construct
gcccaagctacgcgtatgagtattcctgcacag

SEQ ID NO: 2994 - DNA, 33 bp, Artificial Sequence
  Synthetic Construct
gcccaaaacgtccccaccagcctccccgcacag

SEQ ID NO: 2995 - DNA, 33 bp, Artificial Sequence
  Synthetic Construct
gcccaaagcctcagaatcgaaagcaaagcacag

SEQ ID NO: 2996 - DNA, 33 bp, Artificial Sequence
  Synthetic Construct
gcccaaaacagcggcaacaccctcggcgcacag

SEQ ID NO: 2997 - DNA, 33 bp, Artificial Sequence
  Synthetic Construct
gcccaacggttggatcatgctagtattgcacag

SEQ ID NO: 2998 - DNA, 33 bp, Artificial Sequence
  Synthetic Construct
gcccaaagccacctcgtcgtcagcgccgcacag

SEQ ID NO: 2999 - DNA, 33 bp, Artificial Sequence
  Synthetic Construct
gcccaacccgccagccccagaagccacgcacag

SEQ ID NO: 3000 - DNA, 33 bp, Artificial Sequence
  Synthetic Construct
gcccaaaaccacaccctcgtcccccccgcacag

SEQ ID NO: 3001 - DNA, 33 bp, Artificial Sequence
  Synthetic Construct
gcccaaatgcagatgacggggactgctgcacag

SEQ ID NO: 3002 - DNA, 33 bp, Artificial Sequence
  Synthetic Construct
gcccaaaatactcaggcgaatccgagggcacag

SEQ ID NO: 3003 - DNA, 33 bp, Artificial Sequence
  Synthetic Construct
gcccaaaccagagacctcaacgccatcgcacag

SEQ ID NO: 3004 - DNA, 33 bp, Artificial Sequence
  Synthetic Construct
gcccaaaccgacgccagcagccccttcgcacag

SEQ ID NO: 3005 - DNA, 33 bp, Artificial Sequence
  Synthetic Construct
gcccaagctgatcagaggcagccgaaggcacag

SEQ ID NO: 3006 - DNA, 33 bp, Artificial Sequence
  Synthetic Construct
gcccaagccgtcaaccccaactacgccgcacag

SEQ ID NO: 3007 - DNA, 33 bp, Artificial Sequence
  Synthetic Construct
gcccaactgactgctacgaatgttcgggcacag

SEQ ID NO: 3008 - DNA, 33 bp, Artificial Sequence
  Synthetic Construct
gcccaattgactgcgtctacttattcggcacag

SEQ ID NO: 3009 - DNA, 33 bp, Artificial Sequence
  Synthetic Construct
gcccaagggtcgcgtgataattctgtggcacag

SEQ ID NO: 3010 - DNA, 33 bp, Artificial Sequence
  Synthetic Construct
gcccaaactgatactcagaatcggcttgcacag

SEQ ID NO: 3011 - DNA, 33 bp, Artificial Sequence
  Synthetic Construct
gcccaaaatagtacggttaatacgggtgcacag

SEQ ID NO: 3012 - DNA, 33 bp, Artificial Sequence
  Synthetic Construct
gcccaattgtctcatgcgatgcgttctgcacag

SEQ ID NO: 3013 - DNA, 33 bp, Artificial Sequence
  Synthetic Construct
gcccaacggctgccgatgactactatggcacag

SEQ ID NO: 3014 - DNA, 33 bp, Artificial Sequence
  Synthetic Construct
gcccaactctaccacgaaagccaaaccgcacag

SEQ ID NO: 3015 - DNA, 33 bp, Artificial Sequence
  Synthetic Construct
gcccaaattttgcatcagagttcgactgcacag

SEQ ID NO: 3016 - DNA, 33 bp, Artificial Sequence
  Synthetic Construct
gcccaaaccagcctcgccacccaaaccgcacag

SEQ ID NO: 3017 - DNA, 33 bp, Artificial Sequence
  Synthetic Construct
gcccaaagaacccccaccctcaccgtcgcacag

SEQ ID NO: 3018 - DNA, 33 bp, Artificial Sequence
  Synthetic Construct
gcccaagctacgcgtgagagtcgtacggcacag

SEQ ID NO: 3019 - DNA, 33 bp, Artificial Sequence
  Synthetic Construct
gcccaattgtctgagagtctgcggattgcacag

SEQ ID NO: 3020 - DNA, 33 bp, Artificial Sequence
  Synthetic Construct
gcccaaagcgtcaccggcggcatggtcgcacag

SEQ ID NO: 3021 - DNA, 33 bp, Artificial Sequence
  Synthetic Construct
gcccaacccagaaccagcgacagcaacgcacag

SEQ ID NO: 3022 - DNA, 33 bp, Artificial Sequence
  Synthetic Construct
gcccaagttcattctacggttacgtcggcacag

SEQ ID NO: 3023 - DNA, 33 bp, Artificial Sequence
  Synthetic Construct
gcccaaggcaccaacatgaaccacctcgcacag

SEQ ID NO: 3024 - DNA, 33 bp, Artificial Sequence
  Synthetic Construct
gcccaaatgaaggctgagttgtatgcggcacag

SEQ ID NO: 3025 - DNA, 33 bp, Artificial Sequence
  Synthetic Construct
gcccaactcagaagccccagcgtcgacgcacag

SEQ ID NO: 3026 - DNA, 33 bp, Artificial Sequence
  Synthetic Construct
gcccaaaccaacagcccccaattccccgcacag

SEQ ID NO: 3027 - DNA, 33 bp, Artificial Sequence
  Synthetic Construct
gcccaaaataattcgcttaggtcgaatgcacag

SEQ ID NO: 3028 - DNA, 33 bp, Artificial Sequence
  Synthetic Construct
gcccaagacagccacatgggcaaatacgcacag

SEQ ID NO: 3029 - DNA, 33 bp, Artificial Sequence
  Synthetic Construct
gcccaagttaattcgatgacgccgcgggcacag

SEQ ID NO: 3030 - DNA, 33 bp, Artificial Sequence
  Synthetic Construct
gcccaactcgcccccatcagcctcaacgcacag

SEQ ID NO: 3031 - DNA, 33 bp, Artificial Sequence
  Synthetic Construct
gcccaaaatatgccgagtattatgcaggcacag

SEQ ID NO: 3032 - DNA, 33 bp, Artificial Sequence
  Synthetic Construct
gcccaagggaatatgattaaggtggcggcacag

SEQ ID NO: 3033 - DNA, 33 bp, Artificial Sequence
  Synthetic Construct
gcccaaaccggcgtcagcctccaagtcgcacag

SEQ ID NO: 3034 - DNA, 33 bp, Artificial Sequence
  Synthetic Construct
gcccaacctcagtttaatactgcgtcggcacag

SEQ ID NO: 3035 - DNA, 33 bp, Artificial Sequence
  Synthetic Construct
gcccaaacggaggcgtataggaatactgcacag

SEQ ID NO: 3036 - DNA, 33 bp, Artificial Sequence
  Synthetic Construct
gcccaacttatgaaggctgatactgtggcacag

SEQ ID NO: 3037 - DNA, 33 bp, Artificial Sequence
  Synthetic Construct
gcccaaaatcataaggagtttatgcttgcacag

SEQ ID NO: 3038 - DNA, 33 bp, Artificial Sequence
  Synthetic Construct
gcccaattgaatgggactttgactgtggcacag

SEQ ID NO: 3039 - DNA, 33 bp, Artificial Sequence
  Synthetic Construct
gcccaaactgcgaagattttgacgatggcacag

SEQ ID NO: 3040 - DNA, 33 bp, Artificial Sequence
  Synthetic Construct
gcccaactcagagacagcctccccgtcgcacag

SEQ ID NO: 3041 - DNA, 33 bp, Artificial Sequence
  Synthetic Construct
gcccaactcaaaggcggcgacagctgggcacag

SEQ ID NO: 3042 - DNA, 33 bp, Artificial Sequence
  Synthetic Construct
gcccaaaaaaccgtcgacatcatgggcgcacag

SEQ ID NO: 3043 - DNA, 33 bp, Artificial Sequence
  Synthetic Construct
gcccaactcaacatgggccaaatgaaagcacag

SEQ ID NO: 3044 - DNA, 33 bp, Artificial Sequence
  Synthetic Construct
gcccaaagcgtccccagcctcgacagagcacag

SEQ ID NO: 3045 - DNA, 33 bp, Artificial Sequence
  Synthetic Construct
gcccaacagctgttggggacgagtaaggcacag

SEQ ID NO: 3046 - DNA, 33 bp, Artificial Sequence
  Synthetic Construct
gcccaaatgaatcctaagcatggtctggcacag

SEQ ID NO: 3047 - DNA, 33 bp, Artificial Sequence
  Synthetic Construct
gcccaatctccggagggttctctgaaggcacag

SEQ ID NO: 3048 - DNA, 33 bp, Artificial Sequence
  Synthetic Construct
gcccaagcgaatatgccgaattctcgggcacag

SEQ ID NO: 3049 - DNA, 33 bp, Artificial Sequence
  Synthetic Construct
gcccaagcctacatcagcagcggcgtcgcacag

SEQ ID NO: 3050 - DNA, 33 bp, Artificial Sequence
  Synthetic Construct
gcccaagaaagaggcagccaagccaacgcacag

SEQ ID NO: 3051 - DNA, 33 bp, Artificial Sequence
  Synthetic Construct
gcccaaggtcatgataggctgagtccggcacag

SEQ ID NO: 3052 - DNA, 33 bp, Artificial Sequence
  Synthetic Construct
gcccaaacgagtaatgtgactggtactgcacag

SEQ ID NO: 3053 - DNA, 33 bp, Artificial Sequence
  Synthetic Construct
gcccaactcacccacaacgtcggcgtcgcacag

SEQ ID NO: 3054 - DNA, 33 bp, Artificial Sequence
  Synthetic Construct
gcccaaagggaggatggggtggctaaggcacag

SEQ ID NO: 3055 - DNA, 33 bp, Artificial Sequence
  Synthetic Construct
gcccaacccgccgacggctacaaactcgcacag

SEQ ID NO: 3056 - DNA, 33 bp, Artificial Sequence
  Synthetic Construct
gcccaacaactcgacgccaccagagccgcacag

SEQ ID NO: 3057 - DNA, 33 bp, Artificial Sequence
  Synthetic Construct
gcccaagtgactggtatgacgactcgtgcacag

SEQ ID NO: 3058 - DNA, 33 bp, Artificial Sequence
  Synthetic Construct
gcccaatcggatagtcggacgtatgaggcacag

SEQ ID NO: 3059 - DNA, 33 bp, Artificial Sequence
  Synthetic Construct
gcccaagttgagccgctgaagccggatgcacag

SEQ ID NO: 3060 - DNA, 33 bp, Artificial Sequence
  Synthetic Construct
gcccaaggcgtcctcgccagcaacagagcacag

SEQ ID NO: 3061 - DNA, 33 bp, Artificial Sequence
  Synthetic Construct
gcccaaatgggcgaaagaatgagcatcgcacag

SEQ ID NO: 3062 - DNA, 33 bp, Artificial Sequence
  Synthetic Construct
gcccaatttacgaagactgaggatttggcacag

SEQ ID NO: 3063 - DNA, 33 bp, Artificial Sequence
  Synthetic Construct
gcccaagtcaaaaacaccgaactcctcgcacag

SEQ ID NO: 3064 - DNA, 33 bp, Artificial Sequence
  Synthetic Construct
gcccaaactgttacgagtacggtggtggcacag

SEQ ID NO: 3065 - DNA, 33 bp, Artificial Sequence
  Synthetic Construct
gcccaagccaaatacggcgaccccaccgcacag

SEQ ID NO: 3066 - DNA, 33 bp, Artificial Sequence
  Synthetic Construct
gcccaaaccagcgacagactcctcggcgcacag

SEQ ID NO: 3067 - DNA, 33 bp, Artificial Sequence
  Synthetic Construct
gcccaagctgttgggaatactaagatggcacag

SEQ ID NO: 3068 - DNA, 33 bp, Artificial Sequence
  Synthetic Construct
gcccaacagacgtataataagatggatgcacag

SEQ ID NO: 3069 - DNA, 33 bp, Artificial Sequence
  Synthetic Construct
gcccaagcgtgggctagtcagtcttcggcacag

SEQ ID NO: 3070 - DNA, 33 bp, Artificial Sequence
  Synthetic Construct
gcccaaaatgcgtttcttactggtggggcacag

SEQ ID NO: 3071 - DNA, 33 bp, Artificial Sequence
  Synthetic Construct
gcccaaagcatcggcgacaaatacaccgcacag

SEQ ID NO: 3072 - DNA, 33 bp, Artificial Sequence
  Synthetic Construct
gcccaatcgaatcatcatcatactggggcacag

SEQ ID NO: 3073 - DNA, 33 bp, Artificial Sequence
  Synthetic Construct
gcccaaatcaccaacaaacccatgaccgcacag

SEQ ID NO: 3074 - DNA, 33 bp, Artificial Sequence
  Synthetic Construct
gcccaactcagcggccaagtcagcaacgcacag

SEQ ID NO: 3075 - DNA, 33 bp, Artificial Sequence
  Synthetic Construct
gcccaaaatagtatgtcggggcatttggcacag

SEQ ID NO: 3076 - DNA, 33 bp, Artificial Sequence
  Synthetic Construct
gcccaacctgcggtgcatggttatgctgcacag

SEQ ID NO: 3077 - DNA, 33 bp, Artificial Sequence
  Synthetic Construct
gcccaactcatgagaaccaaacaacccgcacag

SEQ ID NO: 3078 - DNA, 33 bp, Artificial Sequence
  Synthetic Construct
gcccaaagcagcctcgccgtcaacaaagcacag

SEQ ID NO: 3079 - DNA, 33 bp, Artificial Sequence
  Synthetic Construct
gcccaaaatacgcagtcggagcctcgtgcacag

SEQ ID NO: 3080 - DNA, 33 bp, Artificial Sequence
  Synthetic Construct
gcccaagatcatctggttagtgttcctgcacag

SEQ ID NO: 3081 - DNA, 33 bp, Artificial Sequence
  Synthetic Construct
gcccaatgggccaccagcacccacgacgcacag

SEQ ID NO: 3082 - DNA, 33 bp, Artificial Sequence
  Synthetic Construct
gcccaaccccaacaacaacccatcggcgcacag

SEQ ID NO: 3083 - DNA, 33 bp, Artificial Sequence
  Synthetic Construct
gcccaaagcctcagcacccacagcgacgcacag

SEQ ID NO: 3084 - DNA, 33 bp, Artificial Sequence
  Synthetic Construct
gcccaaggcagcatggccgccagaagcgcacag

SEQ ID NO: 3085 - DNA, 33 bp, Artificial Sequence
  Synthetic Construct
gcccaagcccccggcatgaccgccagagcacag

SEQ ID NO: 3086 - DNA, 33 bp, Artificial Sequence
  Synthetic Construct
gcccaagtcctcgccaacatgaccgccgcacag

SEQ ID NO: 3087 - DNA, 33 bp, Artificial Sequence
  Synthetic Construct
gcccaactcaccaaacaagaaagcgccgcacag

SEQ ID NO: 3088 - DNA, 33 bp, Artificial Sequence
  Synthetic Construct
gcccaaggcgccaacagcggcggcgtcgcacag

SEQ ID NO: 3089 - DNA, 33 bp, Artificial Sequence
  Synthetic Construct
gcccaacagagtgagccgaagcgtcctgcacag

SEQ ID NO: 3090 - DNA, 33 bp, Artificial Sequence
  Synthetic Construct
gcccaagtccacggcgaaagaagcgtcgcacag

SEQ ID NO: 3091 - DNA, 33 bp, Artificial Sequence
  Synthetic Construct
gcccaagcgcatcagactgctgcttctgcacag

SEQ ID NO: 3092 - DNA, 33 bp, Artificial Sequence
  Synthetic Construct
gcccaagttcgggagatgcagacggcggcacag

SEQ ID NO: 3093 - DNA, 33 bp, Artificial Sequence
  Synthetic Construct
gcccaagtcgcccccagcgccctccacgcacag

SEQ ID NO: 3094 - DNA, 33 bp, Artificial Sequence
  Synthetic Construct
gcccaaagtgttggtcatcataatatggcacag

SEQ ID NO: 3095 - DNA, 33 bp, Artificial Sequence
  Synthetic Construct
gcccaattcctcacccaaggcgacgtcgcacag

SEQ ID NO: 3096 - DNA, 33 bp, Artificial Sequence
  Synthetic Construct
gcccaattcagcacccaattccaacacgcacag

SEQ ID NO: 3097 - DNA, 33 bp, Artificial Sequence
  Synthetic Construct
gcccaacagaatacgacgcggtcgaatgcacag

SEQ ID NO: 3098 - DNA, 33 bp, Artificial Sequence
  Synthetic Construct
gcccaacccgccgtcaccagcatcgccgcacag

SEQ ID NO: 3099 - DNA, 33 bp, Artificial Sequence
  Synthetic Construct
gcccaagccagcaccaacacctacgtcgcacag

SEQ ID NO: 3100 - DNA, 33 bp, Artificial Sequence
  Synthetic Construct
gcccaatcgacggctacgcctacgtcggcacag

SEQ ID NO: 3101 - DNA, 33 bp, Artificial Sequence
  Synthetic Construct
gcccaacattttaataggacgtcgcctgcacag

SEQ ID NO: 3102 - DNA, 33 bp, Artificial Sequence
  Synthetic Construct
gcccaaagcgtcgccggcatgctccccgcacag

SEQ ID NO: 3103 - DNA, 33 bp, Artificial Sequence
  Synthetic Construct
gcccaacctatgagttctgagagtagtgcacag

SEQ ID NO: 3104 - DNA, 33 bp, Artificial Sequence
  Synthetic Construct
gcccaaagcctcgccagcaccaccgtcgcacag

SEQ ID NO: 3105 - DNA, 33 bp, Artificial Sequence
  Synthetic Construct
gcccaaacttctactcctgctcaggttgcacag

SEQ ID NO: 3106 - DNA, 33 bp, Artificial Sequence
  Synthetic Construct
gcccaaagtctgacggcgcagcagcctgcacag

SEQ ID NO: 3107 - DNA, 33 bp, Artificial Sequence
  Synthetic Construct
gcccaaagtggtcgtgtgcctgtggctgcacag

SEQ ID NO: 3108 - DNA, 33 bp, Artificial Sequence
  Synthetic Construct
gcccaactcgacgccgccaaaagcctcgcacag

SEQ ID NO: 3109 - DNA, 33 bp, Artificial Sequence
  Synthetic Construct
gcccaaaacttcgccaacaaaaacgtcgcacag

SEQ ID NO: 3110 - DNA, 33 bp, Artificial Sequence
  Synthetic Construct
gcccaaggccccgccagcgtcacccccgcacag

SEQ ID NO: 3111 - DNA, 33 bp, Artificial Sequence
  Synthetic Construct
gcccaatattctcgggaggcgacgaatgcacag

SEQ ID NO: 3112 - DNA, 33 bp, Artificial Sequence
  Synthetic Construct
gcccaaaccggcagcagcttcgccatggcacag

SEQ ID NO: 3113 - DNA, 33 bp, Artificial Sequence
  Synthetic Construct
gcccaagggattaagggggatccggttgcacag

SEQ ID NO: 3114 - DNA, 33 bp, Artificial Sequence
  Synthetic Construct
gcccaagtcaccagcaccagccacgccgcacag

SEQ ID NO: 3115 - DNA, 33 bp, Artificial Sequence
  Synthetic Construct
gcccaaaccagccaaaacaacctcagagcacag

SEQ ID NO: 3116 - DNA, 33 bp, Artificial Sequence
  Synthetic Construct
gcccaaatgagacaagaaggcctcagcgcacag

SEQ ID NO: 3117 - DNA, 33 bp, Artificial Sequence
  Synthetic Construct
gcccaactcaacctcaacgccatcgccgcacag

SEQ ID NO: 3118 - DNA, 33 bp, Artificial Sequence
  Synthetic Construct
gcccaaagtaagaatgaggggcctactgcacag

SEQ ID NO: 3119 - DNA, 33 bp, Artificial Sequence
  Synthetic Construct
gcccaagattctcgttctacgactaatgcacag

SEQ ID NO: 3120 - DNA, 33 bp, Artificial Sequence
  Synthetic Construct
gcccaaagcaccggcgacgccctcagagcacag

SEQ ID NO: 3121 - DNA, 33 bp, Artificial Sequence
  Synthetic Construct
gcccaaattaataagcctggtacgcctgcacag

SEQ ID NO: 3122 - DNA, 33 bp, Artificial Sequence
  Synthetic Construct
gcccaagtttcggctcctttgaatattgcacag

SEQ ID NO: 3123 - DNA, 33 bp, Artificial Sequence
  Synthetic Construct
gcccaagtttctttgggttcgcttgcggcacag

SEQ ID NO: 3124 - DNA, 33 bp, Artificial Sequence
  Synthetic Construct
gcccaactcaaccacatcaacgaaaaagcacag

SEQ ID NO: 3125 - DNA, 33 bp, Artificial Sequence
  Synthetic Construct
gcccaaaagtcggtgacgattctttcggcacag

SEQ ID NO: 3126 - DNA, 33 bp, Artificial Sequence
  Synthetic Construct
gcccaatctaatgtgtcgtcgcttgttgcacag

SEQ ID NO: 3127 - DNA, 33 bp, Artificial Sequence
  Synthetic Construct
gcccaattttcgcagactgttgggggggcacag

SEQ ID NO: 3128 - DNA, 33 bp, Artificial Sequence
  Synthetic Construct
gcccaacgtccgtctattacgcatgatgcacag

SEQ ID NO: 3129 - DNA, 33 bp, Artificial Sequence
  Synthetic Construct
gcccaaagacaagaaagcaccaccctcgcacag

SEQ ID NO: 3130 - DNA, 33 bp, Artificial Sequence
  Synthetic Construct
gcccaagggccttatgtgactcctcaggcacag

SEQ ID NO: 3131 - DNA, 33 bp, Artificial Sequence
  Synthetic Construct
gcccaaaacggcctcgtcaccaccgccgcacag

SEQ ID NO: 3132 - DNA, 33 bp, Artificial Sequence
  Synthetic Construct
gcccaacacgccggcaacgtccccggcgcacag

SEQ ID NO: 3133 - DNA, 33 bp, Artificial Sequence
  Synthetic Construct
gcccaacccatgggcaacaacctcgtcgcacag

SEQ ID NO: 3134 - DNA, 33 bp, Artificial Sequence
  Synthetic Construct
gcccaagtctacaacgacagaagccacgcacag

SEQ ID NO: 3135 - DNA, 33 bp, Artificial Sequence
  Synthetic Construct
gcccaaacccacaaagaaagcggctacgcacag

SEQ ID NO: 3136 - DNA, 33 bp, Artificial Sequence
  Synthetic Construct
gcccaaggcatgaacagcgtcctcctcgcacag

SEQ ID NO: 3137 - DNA, 33 bp, Artificial Sequence
  Synthetic Construct
gcccaatacctcgaaaaccaatacagcgcacag

SEQ ID NO: 3138 - DNA, 33 bp, Artificial Sequence
  Synthetic Construct
gcccaatctattacgtcgaggcctaatgcacag

SEQ ID NO: 3139 - DNA, 33 bp, Artificial Sequence
  Synthetic Construct
gcccaaagccaccaaaacaccgccagagcacag

SEQ ID NO: 3140 - DNA, 33 bp, Artificial Sequence
  Synthetic Construct
gcccaacgtttggttcagtctgcggaggcacag

SEQ ID NO: 3141 - DNA, 33 bp, Artificial Sequence
  Synthetic Construct
gcccaataccccaaaagcgccaccaacgcacag

SEQ ID NO: 3142 - DNA, 33 bp, Artificial Sequence
  Synthetic Construct
gcccaaattaattcttctccgccgctggcacag

SEQ ID NO: 3143 - DNA, 33 bp, Artificial Sequence
  Synthetic Construct
gcccaaactcagaatctggcgggtggtgcacag

SEQ ID NO: 3144 - DNA, 33 bp, Artificial Sequence
  Synthetic Construct
gcccaattccaagtcgccaaagacagagcacag

SEQ ID NO: 3145 - DNA, 33 bp, Artificial Sequence
  Synthetic Construct
gcccaacggctgagtggtaatcagaatgcacag

SEQ ID NO: 3146 - DNA, 33 bp, Artificial Sequence
  Synthetic Construct
gcccaaactacggatcgggtgtcgcatgcacag

SEQ ID NO: 3147 - DNA, 33 bp, Artificial Sequence
  Synthetic Construct
gcccaaactgctactgtgacggctcgggcacag

SEQ ID NO: 3148 - DNA, 33 bp, Artificial Sequence
  Synthetic Construct
gcccaactcagcatgatgagcgacaaagcacag

SEQ ID NO: 3149 - DNA, 33 bp, Artificial Sequence
  Synthetic Construct
gcccaaactctgattcagactagtccggcacag

SEQ ID NO: 3150 - DNA, 33 bp, Artificial Sequence
  Synthetic Construct
gcccaaccgatgcatattacgaatgctgcacag

SEQ ID NO: 3151 - DNA, 33 bp, Artificial Sequence
  Synthetic Construct
gcccaaaccgtcggccaacccgcccacgcacag

SEQ ID NO: 3152 - DNA, 33 bp, Artificial Sequence
  Synthetic Construct
gcccaagaagacaaagacgtcagactcgcacag

SEQ ID NO: 3153 - DNA, 33 bp, Artificial Sequence
  Synthetic Construct
gcccaaatgaaggttgcgcagcctatggcacag

SEQ ID NO: 3154 - DNA, 33 bp, Artificial Sequence
  Synthetic Construct
gcccaagtgggggtgcctaatctgccggcacag

SEQ ID NO: 3155 - DNA, 33 bp, Artificial Sequence
  Synthetic Construct
gcccaagcgccgctgagtagtgatccggcacag

SEQ ID NO: 3156 - DNA, 33 bp, Artificial Sequence
  Synthetic Construct
gcccaattcctccacgccagcgtcgacgcacag

SEQ ID NO: 3157 - DNA, 33 bp, Artificial Sequence
  Synthetic Construct
gcccaacctactgtggggacgtatattgcacag

SEQ ID NO: 3158 - DNA, 33 bp, Artificial Sequence
  Synthetic Construct
gcccaagagcctctgcataggaattctgcacag

SEQ ID NO: 3159 - DNA, 33 bp, Artificial Sequence
  Synthetic Construct
gcccaagccagcaccgtcaccgtcgaagcacag

SEQ ID NO: 3160 - DNA, 33 bp, Artificial Sequence
  Synthetic Construct
gcccaagcccccagaatcgacaacgccgcacag

SEQ ID NO: 3161 - DNA, 33 bp, Artificial Sequence
  Synthetic Construct
gcccaatatcgtgattcggctgctcctgcacag

SEQ ID NO: 3162 - DNA, 33 bp, Artificial Sequence
  Synthetic Construct
gcccaactcacccaaaacgccagcgtcgcacag

SEQ ID NO: 3163 - DNA, 33 bp, Artificial Sequence
  Synthetic Construct
gcccaattgagtgctcgtttgacgactgcacag

SEQ ID NO: 3164 - DNA, 33 bp, Artificial Sequence
  Synthetic Construct
gcccaaaacggcaaaagcagcgacaaagcacag

SEQ ID NO: 3165 - DNA, 33 bp, Artificial Sequence
  Synthetic Construct
gcccaagcgctggtgaaggatactactgcacag

SEQ ID NO: 3166 - DNA, 33 bp, Artificial Sequence
  Synthetic Construct
gcccaaatgctcgtcaccaccggcgaagcacag

SEQ ID NO: 3167 - DNA, 33 bp, Artificial Sequence
  Synthetic Construct
gcccaaagcggcaaccccagctacgccgcacag

SEQ ID NO: 3168 - DNA, 33 bp, Artificial Sequence
  Synthetic Construct
gcccaagtcatcaccggcggcatgagcgcacag

SEQ ID NO: 3169 - DNA, 33 bp, Artificial Sequence
  Synthetic Construct
gcccaactcgaacccaacgtccaaaccgcacag

SEQ ID NO: 3170 - DNA, 33 bp, Artificial Sequence
  Synthetic Construct
gcccaaagattcagcgaagtcacccccgcacag

SEQ ID NO: 3171 - DNA, 33 bp, Artificial Sequence
  Synthetic Construct
gcccaagatccggggaaggcgagtctggcacag

SEQ ID NO: 3172 - DNA, 33 bp, Artificial Sequence
  Synthetic Construct
gcccaaatcgcccacgaaagcaccgacgcacag

SEQ ID NO: 3173 - DNA, 33 bp, Artificial Sequence
  Synthetic Construct
gcccaatatcctagtaattctatgcatgcacag

SEQ ID NO: 3174 - DNA, 33 bp, Artificial Sequence
  Synthetic Construct
gcccaaagcaccaccccccccagcggcgcacag

SEQ ID NO: 3175 - DNA, 33 bp, Artificial Sequence
  Synthetic Construct
gcccaagttgagcagaattctaagaatgcacag

SEQ ID NO: 3176 - DNA, 33 bp, Artificial Sequence
  Synthetic Construct
gcccaaacgattgcgggtcggcttgtggcacag

SEQ ID NO: 3177 - DNA, 33 bp, Artificial Sequence
  Synthetic Construct
gcccaagctaggcatacgggtgagatggcacag

SEQ ID NO: 3178 - DNA, 33 bp, Artificial Sequence
  Synthetic Construct
gcccaacagcatctgccgaatcatattgcacag

SEQ ID NO: 3179 - DNA, 33 bp, Artificial Sequence
  Synthetic Construct
gcccaaactactatggggacttatcctgcacag

SEQ ID NO: 3180 - DNA, 33 bp, Artificial Sequence
  Synthetic Construct
gcccaaaccgaaagcgtcatgcccagagcacag

SEQ ID NO: 3181 - DNA, 33 bp, Artificial Sequence
  Synthetic Construct
gcccaaggcgccaaacccagcaacgacgcacag

SEQ ID NO: 3182 - DNA, 33 bp, Artificial Sequence
  Synthetic Construct
gcccaagccgtcagcagcgacatgagcgcacag

SEQ ID NO: 3183 - DNA, 33 bp, Artificial Sequence
  Synthetic Construct
gcccaacacagcccccaactcggcggcgcacag

SEQ ID NO: 3184 - DNA, 33 bp, Artificial Sequence
  Synthetic Construct
gcccaattgtatactaatcctaatactgcacag

SEQ ID NO: 3185 - DNA, 33 bp, Artificial Sequence
  Synthetic Construct
gcccaaaccgtcgccctcaacatggccgcacag

SEQ ID NO: 3186 - DNA, 33 bp, Artificial Sequence
  Synthetic Construct
gcccaacagcgggttcctgcttatcaggcacag

SEQ ID NO: 3187 - DNA, 33 bp, Artificial Sequence
  Synthetic Construct
gcccaaagtgatgtttctaaggtttatgcacag

SEQ ID NO: 3188 - DNA, 33 bp, Artificial Sequence
  Synthetic Construct
gcccaatcgaatacgggggagcaggttgcacag

SEQ ID NO: 3189 - DNA, 33 bp, Artificial Sequence
  Synthetic Construct
gcccaattcaccaccggcctcaaccacgcacag

SEQ ID NO: 3190 - DNA, 33 bp, Artificial Sequence
  Synthetic Construct
gcccaaaacgacacccaatacaaacacgcacag

SEQ ID NO: 3191 - DNA, 33 bp, Artificial Sequence
  Synthetic Construct
gcccaagtccacgacgtcaaaggcatcgcacag

SEQ ID NO: 3192 - DNA, 33 bp, Artificial Sequence
  Synthetic Construct
gcccaatatggtggtagggatagttatgcacag

SEQ ID NO: 3193 - DNA, 33 bp, Artificial Sequence
  Synthetic Construct
gcccaacatagtactgcgactactcatgcacag

SEQ ID NO: 3194 - DNA, 33 bp, Artificial Sequence
  Synthetic Construct
gcccaaccttcgcctactactcggactgcacag

SEQ ID NO: 3195 - DNA, 33 bp, Artificial Sequence
  Synthetic Construct
gcccaagggcatgcggaggcggcgatggcacag

SEQ ID NO: 3196 - DNA, 33 bp, Artificial Sequence
  Synthetic Construct
gcccaaagcctcagcaccagacccgtcgcacag

SEQ ID NO: 3197 - DNA, 33 bp, Artificial Sequence
  Synthetic Construct
gcccaatctccggtgcctggtaagcctgcacag

SEQ ID NO: 3198 - DNA, 33 bp, Artificial Sequence
  Synthetic Construct
gcccaaaccagaatcaacagccccctcgcacag

SEQ ID NO: 3199 - DNA, 33 bp, Artificial Sequence
  Synthetic Construct
gcccaagagtctacgtatgcgaagctggcacag

SEQ ID NO: 3200 - DNA, 33 bp, Artificial Sequence
  Synthetic Construct
gcccaacaaatcaaccaaggcaccagagcacag

SEQ ID NO: 3201 - DNA, 33 bp, Artificial Sequence
  Synthetic Construct
gcccaaggcagcagaaccggcagcatcgcacag

SEQ ID NO: 3202 - DNA, 33 bp, Artificial Sequence
  Synthetic Construct
gcccaagggaatgcttcttggtcggctgcacag

SEQ ID NO: 3203 - DNA, 33 bp, Artificial Sequence
  Synthetic Construct
gcccaagcggctcatgatattggtaaggcacag

SEQ ID NO: 3204 - DNA, 33 bp, Artificial Sequence
  Synthetic Construct
gcccaaaaggataggccttttgtggaggcacag

SEQ ID NO: 3205 - DNA, 33 bp, Artificial Sequence
  Synthetic Construct
gcccaactcccccacaccaaacccttcgcacag

SEQ ID NO: 3206 - DNA, 33 bp, Artificial Sequence
  Synthetic Construct
gcccaacctgggaagggtgtgtctcttgcacag

SEQ ID NO: 3207 - DNA, 33 bp, Artificial Sequence
  Synthetic Construct
gcccaagacagacaaaacgccagcgccgcacag

SEQ ID NO: 3208 - DNA, 33 bp, Artificial Sequence
  Synthetic Construct
gcccaagtccaacccagcctcagcgtcgcacag

SEQ ID NO: 3209 - DNA, 33 bp, Artificial Sequence
  Synthetic Construct
gcccaaaagcctacgccgattgagtttgcacag

SEQ ID NO: 3210 - DNA, 33 bp, Artificial Sequence
  Synthetic Construct
gcccaactgcttcatgatatgaagagtgcacag

SEQ ID NO: 3211 - DNA, 33 bp, Artificial Sequence
  Synthetic Construct
gcccaaaacagcgacagaaccctcagcgcacag

SEQ ID NO: 3212 - DNA, 33 bp, Artificial Sequence
  Synthetic Construct
gcccaaaaggttgggcatgggtttaatgcacag

SEQ ID NO: 3213 - DNA, 33 bp, Artificial Sequence
  Synthetic Construct
gcccaaacgaagcctgcggttagttttgcacag

SEQ ID NO: 3214 - DNA, 33 bp, Artificial Sequence
  Synthetic Construct
gcccaagctatgacgaatattccgaaggcacag

SEQ ID NO: 3215 - DNA, 33 bp, Artificial Sequence
  Synthetic Construct
gcccaattttcgcatatgtctttgccggcacag

SEQ ID NO: 3216 - DNA, 33 bp, Artificial Sequence
  Synthetic Construct
gcccaagggtctgtgcgggataatccggcacag

SEQ ID NO: 3217 - DNA, 33 bp, Artificial Sequence
  Synthetic Construct
gcccaaagtagttcgcaggggccgactgcacag

SEQ ID NO: 3218 - DNA, 33 bp, Artificial Sequence
  Synthetic Construct
gcccaacttgtggggcggccggttacggcacag

SEQ ID NO: 3219 - DNA, 33 bp, Artificial Sequence
  Synthetic Construct
gcccaaatcaactacggcgtccaaaaagcacag

SEQ ID NO: 3220 - DNA, 33 bp, Artificial Sequence
  Synthetic Construct
gcccaaattaataaggataataatcaggcacag

SEQ ID NO: 3221 - DNA, 33 bp, Artificial Sequence
  Synthetic Construct
gcccaaagtggtcagtcttctgctatggcacag

SEQ ID NO: 3222 - DNA, 33 bp, Artificial Sequence
  Synthetic Construct
gcccaagaatacaacagcaccaaactcgcacag

SEQ ID NO: 3223 - DNA, 33 bp, Artificial Sequence
  Synthetic Construct
gcccaatttatgacgctggagcgggcggcacag

SEQ ID NO: 3224 - DNA, 33 bp, Artificial Sequence
  Synthetic Construct
gcccaattcggcaaagactacgtcaacgcacag

SEQ ID NO: 3225 - DNA, 33 bp, Artificial Sequence
  Synthetic Construct
gcccaactcctcctcggcggcacccccgcacag

SEQ ID NO: 3226 - DNA, 33 bp, Artificial Sequence
  Synthetic Construct
gcccaaaccaccacctacaccagaaacgcacag

SEQ ID NO: 3227 - DNA, 33 bp, Artificial Sequence
  Synthetic Construct
gcccaagatcggggtatgcggggggctgcacag

SEQ ID NO: 3228 - DNA, 33 bp, Artificial Sequence
  Synthetic Construct
gcccaagcggtttcgggtacgcgtacggcacag

SEQ ID NO: 3229 - DNA, 33 bp, Artificial Sequence
  Synthetic Construct
gcccaaaacttcagcggcgtcgccaaagcacag

SEQ ID NO: 3230 - DNA, 33 bp, Artificial Sequence
  Synthetic Construct
gcccaagatcggaataatagtatttcggcacag

SEQ ID NO: 3231 - DNA, 33 bp, Artificial Sequence
  Synthetic Construct
gcccaaatcccccaaagacccctcgacgcacag

SEQ ID NO: 3232 - DNA, 33 bp, Artificial Sequence
  Synthetic Construct
gcccaacctgctgcgaatcagtatgttgcacag

SEQ ID NO: 3233 - DNA, 33 bp, Artificial Sequence
  Synthetic Construct
gcccaatacagcggcaccgccatcagagcacag

SEQ ID NO: 3234 - DNA, 33 bp, Artificial Sequence
  Synthetic Construct
gcccaatgggttcagcggactgagagtgcacag

SEQ ID NO: 3235 - DNA, 33 bp, Artificial Sequence
  Synthetic Construct
gcccaacccaaagacggcggcgccatcgcacag

SEQ ID NO: 3236 - DNA, 33 bp, Artificial Sequence
  Synthetic Construct
gcccaacttgctactccgcaggaggaggcacag

SEQ ID NO: 3237 - DNA, 33 bp, Artificial Sequence
  Synthetic Construct
gcccaactgaatagtccggttatggcggcacag

SEQ ID NO: 3238 - DNA, 33 bp, Artificial Sequence
  Synthetic Construct
gcccaaggggctactgggacgagggctgcacag

SEQ ID NO: 3239 - DNA, 33 bp, Artificial Sequence
  Synthetic Construct
gcccaacggacggatgtgcggacgaatgcacag

SEQ ID NO: 3240 - DNA, 33 bp, Artificial Sequence
  Synthetic Construct
gcccaaagaaacctcgcccacccctacgcacag

SEQ ID NO: 3241 - DNA, 33 bp, Artificial Sequence
  Synthetic Construct
gcccaactcagcaccagctacagcaccgcacag

SEQ ID NO: 3242 - DNA, 33 bp, Artificial Sequence
  Synthetic Construct
gcccaaggcgtcaaccaaaccgccagagcacag

SEQ ID NO: 3243 - DNA, 33 bp, Artificial Sequence
  Synthetic Construct
gcccaacttccggctagttcggctagggcacag

SEQ ID NO: 3244 - DNA, 33 bp, Artificial Sequence
  Synthetic Construct
gcccaacaactctacagcgtcaacgccgcacag

SEQ ID NO: 3245 - DNA, 33 bp, Artificial Sequence
  Synthetic Construct
gcccaagttgggacgtatactgctacggcacag

SEQ ID NO: 3246 - DNA, 33 bp, Artificial Sequence
  Synthetic Construct
gcccaaagaagcatgaccgtcatcgaagcacag

SEQ ID NO: 3247 - DNA, 33 bp, Artificial Sequence
  Synthetic Construct
gcccaatttgggcgtggtgatacgggtgcacag

SEQ ID NO: 3248 - DNA, 33 bp, Artificial Sequence
  Synthetic Construct
gcccaagccgccggcagaagcaaccccgcacag

SEQ ID NO: 3249 - DNA, 33 bp, Artificial Sequence
  Synthetic Construct
gcccaaatgcctcagtcgagtcttgctgcacag

SEQ ID NO: 3250 - DNA, 33 bp, Artificial Sequence
  Synthetic Construct
gcccaaccgtctaagcatgagcggtatgcacag

SEQ ID NO: 3251 - DNA, 33 bp, Artificial Sequence
  Synthetic Construct
gcccaattgtttgattcttctaagactgcacag

SEQ ID NO: 3252 - DNA, 33 bp, Artificial Sequence
  Synthetic Construct
gcccaaagcccccaacccagactcagcgcacag

SEQ ID NO: 3253 - DNA, 33 bp, Artificial Sequence
  Synthetic Construct
gcccaaagaagacccgacgtcgaaaacgcacag

SEQ ID NO: 3254 - DNA, 33 bp, Artificial Sequence
  Synthetic Construct
gcccaaccgatgggtagtgcgggtagtgcacag

SEQ ID NO: 3255 - DNA, 33 bp, Artificial Sequence
  Synthetic Construct
gcccaatggagcaccggcatgaccagcgcacag

SEQ ID NO: 3256 - DNA, 33 bp, Artificial Sequence
  Synthetic Construct
gcccaaggcctcgtcagaaacggcgtcgcacag

SEQ ID NO: 3257 - DNA, 33 bp, Artificial Sequence
  Synthetic Construct
gcccaagaggggtcgtatagtacgtctgcacag

SEQ ID NO: 3258 - DNA, 33 bp, Artificial Sequence
  Synthetic Construct
gcccaagccaccagcatgctcacccacgcacag

SEQ ID NO: 3259 - DNA, 33 bp, Artificial Sequence
  Synthetic Construct
gcccaaagcaccaccggcccccccagcgcacag

SEQ ID NO: 3260 - DNA, 33 bp, Artificial Sequence
  Synthetic Construct
gcccaacgtggggcgtcggtgtctatggcacag

SEQ ID NO: 3261 - DNA, 33 bp, Artificial Sequence
  Synthetic Construct
gcccaagtccacgaacacggcgccagcgcacag

SEQ ID NO: 3262 - DNA, 33 bp, Artificial Sequence
  Synthetic Construct
gcccaacattctccttctcagccgagggcacag

SEQ ID NO: 3263 - DNA, 33 bp, Artificial Sequence
  Synthetic Construct
gcccaaggcatcggccaaaacaccgccgcacag

SEQ ID NO: 3264 - DNA, 33 bp, Artificial Sequence
  Synthetic Construct
gcccaacacagagtcgaaaacagctacgcacag

SEQ ID NO: 3265 - DNA, 33 bp, Artificial Sequence
  Synthetic Construct
gcccaaactgagtttaagcctccgtcggcacag

SEQ ID NO: 3266 - DNA, 33 bp, Artificial Sequence
  Synthetic Construct
gcccaatatggtaatttgggggttaatgcacag

SEQ ID NO: 3267 - DNA, 33 bp, Artificial Sequence
  Synthetic Construct
gcccaactcaccagagtcctcaccggcgcacag

SEQ ID NO: 3268 - DNA, 33 bp, Artificial Sequence
  Synthetic Construct
gcccaaatgaaaaacagcaacggcgccgcacag

SEQ ID NO: 3269 - DNA, 33 bp, Artificial Sequence
  Synthetic Construct
gcccaaggcacccaaacccacctccaagcacag

SEQ ID NO: 3270 - DNA, 33 bp, Artificial Sequence
  Synthetic Construct
gcccaaaatgcgcttgctaggacgatggcacag

SEQ ID NO: 3271 - DNA, 33 bp, Artificial Sequence
  Synthetic Construct
gcccaaaataattctatgcagacggtggcacag

SEQ ID NO: 3272 - DNA, 33 bp, Artificial Sequence
  Synthetic Construct
gcccaacaacaaggcaacggcagaagcgcacag

SEQ ID NO: 3273 - DNA, 33 bp, Artificial Sequence
  Synthetic Construct
gcccaactcaccaaaagccaaggctacgcacag

SEQ ID NO: 3274 - DNA, 33 bp, Artificial Sequence
  Synthetic Construct
gcccaagcccccgccgaacccaaaaccgcacag

SEQ ID NO: 3275 - DNA, 33 bp, Artificial Sequence
  Synthetic Construct
gcccaatatagtaatcaggtgagtaatgcacag

SEQ ID NO: 3276 - DNA, 33 bp, Artificial Sequence
  Synthetic Construct
gcccaaactcgtacggggttttctcctgcacag

SEQ ID NO: 3277 - DNA, 33 bp, Artificial Sequence
  Synthetic Construct
gcccaacccgtctacaaaaccgacgacgcacag

SEQ ID NO: 3278 - DNA, 33 bp, Artificial Sequence
  Synthetic Construct
gcccaatctgataggccggctcctgaggcacag

SEQ ID NO: 3279 - DNA, 33 bp, Artificial Sequence
  Synthetic Construct
gcccaagttcaggagaagtcgaggcctgcacag

SEQ ID NO: 3280 - DNA, 33 bp, Artificial Sequence
  Synthetic Construct
gcccaaagcggcggcctcaccgaaagagcacag

SEQ ID NO: 3281 - DNA, 33 bp, Artificial Sequence
  Synthetic Construct
gcccaaagcggcggcaccagagaaggcgcacag

SEQ ID NO: 3282 - DNA, 33 bp, Artificial Sequence
  Synthetic Construct
gcccaagccgtccccggcgaaaccagagcacag

SEQ ID NO: 3283 - DNA, 33 bp, Artificial Sequence
  Synthetic Construct
gcccaaccgcggccggagaggatgtatgcacag

SEQ ID NO: 3284 - DNA, 33 bp, Artificial Sequence
  Synthetic Construct
gcccaaagcaacggcaacatcagcagagcacag

SEQ ID NO: 3285 - DNA, 33 bp, Artificial Sequence
  Synthetic Construct
gcccaagccagaaccgaaagaaaccaagcacag

SEQ ID NO: 3286 - DNA, 33 bp, Artificial Sequence
  Synthetic Construct
gcccaaagtcctcagcagttttcgaaggcacag

SEQ ID NO: 3287 - DNA, 33 bp, Artificial Sequence
  Synthetic Construct
gcccaaagcaccggccccttcccccaagcacag

SEQ ID NO: 3288 - DNA, 33 bp, Artificial Sequence
  Synthetic Construct
gcccaagccaacatcggcaccagcaccgcacag

SEQ ID NO: 3289 - DNA, 33 bp, Artificial Sequence
  Synthetic Construct
gcccaatacagagacaacaccagcggcgcacag

SEQ ID NO: 3290 - DNA, 33 bp, Artificial Sequence
  Synthetic Construct
gcccaagtgcagactaggtctccgatggcacag

SEQ ID NO: 3291 - DNA, 33 bp, Artificial Sequence
  Synthetic Construct
gcccaaatccacaccagcatcgtcgacgcacag

SEQ ID NO: 3292 - DNA, 33 bp, Artificial Sequence
  Synthetic Construct
gcccaaatgactcggactagtagtgaggcacag

SEQ ID NO: 3293 - DNA, 33 bp, Artificial Sequence
  Synthetic Construct
gcccaaccgtcgaattttcctgggtctgcacag

SEQ ID NO: 3294 - DNA, 33 bp, Artificial Sequence
  Synthetic Construct
gcccaaatgatcggcggcacccaaagcgcacag

SEQ ID NO: 3295 - DNA, 33 bp, Artificial Sequence
  Synthetic Construct
gcccaaaagcttgataagcatgagtctgcacag

SEQ ID NO: 3296 - DNA, 33 bp, Artificial Sequence
  Synthetic Construct
gcccaacttacgagtagtaatagtgctgcacag

SEQ ID NO: 3297 - DNA, 33 bp, Artificial Sequence
  Synthetic Construct
gcccaaagtactcgtgatactcattttgcacag

SEQ ID NO: 3298 - DNA, 33 bp, Artificial Sequence
  Synthetic Construct
gcccaagatacgttgaaggctgttagggcacag

SEQ ID NO: 3299 - DNA, 33 bp, Artificial Sequence
  Synthetic Construct
gcccaacagcgtaatccgtcgcttcatgcacag

SEQ ID NO: 3300 - DNA, 33 bp, Artificial Sequence
  Synthetic Construct
gcccaatcgggtgatgggaatcgttcggcacag

SEQ ID NO: 3301 - DNA, 33 bp, Artificial Sequence
  Synthetic Construct
gcccaaggcgtctacaaaaccctccacgcacag

SEQ ID NO: 3302 - DNA, 33 bp, Artificial Sequence
  Synthetic Construct
gcccaaattaattcgaatcaggtgagtgcacag

SEQ ID NO: 3303 - DNA, 33 bp, Artificial Sequence
  Synthetic Construct
gcccaacactacaacgaacacatgaccgcacag

SEQ ID NO: 3304 - DNA, 33 bp, Artificial Sequence
  Synthetic Construct
gcccaaactgtgcaggttcgtgatcgggcacag

SEQ ID NO: 3305 - DNA, 33 bp, Artificial Sequence
  Synthetic Construct
gcccaaggcaacgacatcagaagcagagcacag

SEQ ID NO: 3306 - DNA, 33 bp, Artificial Sequence
  Synthetic Construct
gcccaagtcagcgtcagcatgggccccgcacag

SEQ ID NO: 3307 - DNA, 33 bp, Artificial Sequence
  Synthetic Construct
gcccaattcaaaaccaacatcagcgccgcacag

SEQ ID NO: 3308 - DNA, 33 bp, Artificial Sequence
  Synthetic Construct
gcccaatttccgaaggtggagaggtatgcacag

SEQ ID NO: 3309 - DNA, 33 bp, Artificial Sequence
  Synthetic Construct
gcccaacttagtaagtttcagactacggcacag

SEQ ID NO: 3310 - DNA, 33 bp, Artificial Sequence
  Synthetic Construct
gcccaaagcctcatgaacagcagaagcgcacag

SEQ ID NO: 3311 - DNA, 33 bp, Artificial Sequence
  Synthetic Construct
gcccaagggcgtggggtgctggagtctgcacag

SEQ ID NO: 3312 - DNA, 33 bp, Artificial Sequence
  Synthetic Construct
gcccaacctaatgggtcgcagatgattgcacag

SEQ ID NO: 3313 - DNA, 33 bp, Artificial Sequence
  Synthetic Construct
gcccaacccaccgtcggcaacagctacgcacag

SEQ ID NO: 3314 - DNA, 33 bp, Artificial Sequence
  Synthetic Construct
gcccaaagcagcgacatcatgaaagccgcacag

SEQ ID NO: 3315 - DNA, 33 bp, Artificial Sequence
  Synthetic Construct
gcccaactgatgactagtgctggtcgtgcacag

SEQ ID NO: 3316 - DNA, 33 bp, Artificial Sequence
  Synthetic Construct
gcccaacccgccatgagcagcagcagagcacag

SEQ ID NO: 3317 - DNA, 33 bp, Artificial Sequence
  Synthetic Construct
gcccaacgtgataaggcgatttcgacggcacag

SEQ ID NO: 3318 - DNA, 33 bp, Artificial Sequence
  Synthetic Construct
gcccaattgactttgaagcaggggattgcacag

SEQ ID NO: 3319 - DNA, 33 bp, Artificial Sequence
  Synthetic Construct
gcccaatctcatgctaatgggtttagtgcacag

SEQ ID NO: 3320 - DNA, 33 bp, Artificial Sequence
  Synthetic Construct
gcccaaccgaatttgaaggctccgcaggcacag

SEQ ID NO: 3321 - DNA, 33 bp, Artificial Sequence
  Synthetic Construct
gcccaaagctacggcagagaagtcagagcacag

SEQ ID NO: 3322 - DNA, 33 bp, Artificial Sequence
  Synthetic Construct
gcccaaaacgacacccaaagccccaaagcacag

SEQ ID NO: 3323 - DNA, 33 bp, Artificial Sequence
  Synthetic Construct
gcccaagacgaaagagcccccaaacacgcacag

SEQ ID NO: 3324 - DNA, 33 bp, Artificial Sequence
  Synthetic Construct
gcccaaaacggcagacccatgggcatggcacag

SEQ ID NO: 3325 - DNA, 33 bp, Artificial Sequence
  Synthetic Construct
gcccaacatactcagtctgtgactatggcacag

SEQ ID NO: 3326 - DNA, 33 bp, Artificial Sequence
  Synthetic Construct
gcccaaaacaacttcaacgccagcctcgcacag

SEQ ID NO: 3327 - DNA, 33 bp, Artificial Sequence
  Synthetic Construct
gcccaagaatacctcaaaggcagcgccgcacag

SEQ ID NO: 3328 - DNA, 33 bp, Artificial Sequence
  Synthetic Construct
gcccaatctaagacgcctgatatgttggcacag

SEQ ID NO: 3329 - DNA, 33 bp, Artificial Sequence
  Synthetic Construct
gcccaagtcaacaccggccacgtcagagcacag

SEQ ID NO: 3330 - DNA, 33 bp, Artificial Sequence
  Synthetic Construct
gcccaaggttctcagtcggatgcgcgtgcacag

SEQ ID NO: 3331 - DNA, 33 bp, Artificial Sequence
  Synthetic Construct
gcccaatctttgactttttctaaggatgcacag

SEQ ID NO: 3332 - DNA, 33 bp, Artificial Sequence
  Synthetic Construct
gcccaaaacgccctcgaaagcagaatggcacag

SEQ ID NO: 3333 - DNA, 33 bp, Artificial Sequence
  Synthetic Construct
gcccaaaacggcatcgccagagaacccgcacag

SEQ ID NO: 3334 - DNA, 33 bp, Artificial Sequence
  Synthetic Construct
gcccaaaacctcgtcagcgtcagcaccgcacag

SEQ ID NO: 3335 - DNA, 33 bp, Artificial Sequence
  Synthetic Construct
gcccaagacatgctcagctacaaacccgcacag

SEQ ID NO: 3336 - DNA, 33 bp, Artificial Sequence
  Synthetic Construct
gcccaaagaagcaccgacagcatgaccgcacag

SEQ ID NO: 3337 - DNA, 33 bp, Artificial Sequence
  Synthetic Construct
gcccaagagatgaatcatagtctttctgcacag

SEQ ID NO: 3338 - DNA, 33 bp, Artificial Sequence
  Synthetic Construct
gcccaagccctcagcaaagaagccagcgcacag

SEQ ID NO: 3339 - DNA, 33 bp, Artificial Sequence
  Synthetic Construct
gcccaaaacggccacaacatgagccaagcacag

SEQ ID NO: 3340 - DNA, 33 bp, Artificial Sequence
  Synthetic Construct
gcccaaaccaccgccgaagccaccagagcacag

SEQ ID NO: 3341 - DNA, 33 bp, Artificial Sequence
  Synthetic Construct
gcccaaagagaaagcgcccaccacaacgcacag

SEQ ID NO: 3342 - DNA, 33 bp, Artificial Sequence
  Synthetic Construct
gcccaaatgtttacggggaatgggcaggcacag

SEQ ID NO: 3343 - DNA, 33 bp, Artificial Sequence
  Synthetic Construct
gcccaacatcttcagacgccgccggctgcacag

SEQ ID NO: 3344 - DNA, 33 bp, Artificial Sequence
  Synthetic Construct
gcccaatcgcttgtgggtcagggtaaggcacag

SEQ ID NO: 3345 - DNA, 33 bp, Artificial Sequence
  Synthetic Construct
gcccaactccccctcacccccatcgccgcacag

SEQ ID NO: 3346 - DNA, 33 bp, Artificial Sequence
  Synthetic Construct
gcccaagctatgaagcagtcgtctattgcacag

SEQ ID NO: 3347 - DNA, 33 bp, Artificial Sequence
  Synthetic Construct
gcccaatatcctacgaatgtgaagtcggcacag

SEQ ID NO: 3348 - DNA, 33 bp, Artificial Sequence
  Synthetic Construct
gcccaaagcaacagcctccccagcagagcacag

SEQ ID NO: 3349 - DNA, 33 bp, Artificial Sequence
  Synthetic Construct
gcccaaccgacggcggctactgggacggcacag

SEQ ID NO: 3350 - DNA, 33 bp, Artificial Sequence
  Synthetic Construct
gcccaaatcgcccaaaacggccccggcgcacag

SEQ ID NO: 3351 - DNA, 33 bp, Artificial Sequence
  Synthetic Construct
gcccaaactactcatcagcttactccggcacag

SEQ ID NO: 3352 - DNA, 33 bp, Artificial Sequence
  Synthetic Construct
gcccaacttattcctgcgagggatgtggcacag

SEQ ID NO: 3353 - DNA, 33 bp, Artificial Sequence
  Synthetic Construct
gcccaaaaaatcgcccacggcgacatcgcacag

SEQ ID NO: 3354 - DNA, 33 bp, Artificial Sequence
  Synthetic Construct
gcccaagccagaccccaaagcgacaaagcacag

SEQ ID NO: 3355 - DNA, 33 bp, Artificial Sequence
  Synthetic Construct
gcccaacccagacccaacgtcctcgacgcacag

SEQ ID NO: 3356 - DNA, 33 bp, Artificial Sequence
  Synthetic Construct
gcccaactcaacaaaggcagcagcaacgcacag

SEQ ID NO: 3357 - DNA, 33 bp, Artificial Sequence
  Synthetic Construct
gcccaacgggtttataatggtgatctggcacag

SEQ ID NO: 3358 - DNA, 33 bp, Artificial Sequence
  Synthetic Construct
gcccaaaccgtccccgccaacagcagcgcacag

SEQ ID NO: 3359 - DNA, 33 bp, Artificial Sequence
  Synthetic Construct
gcccaaaccagacacaccagcctcaccgcacag

SEQ ID NO: 3360 - DNA, 33 bp, Artificial Sequence
  Synthetic Construct
gcccaaaatcatgcggtgacgaattctgcacag

SEQ ID NO: 3361 - DNA, 33 bp, Artificial Sequence
  Synthetic Construct
gcccaattggcgtcgcattctacgcttgcacag

SEQ ID NO: 3362 - DNA, 33 bp, Artificial Sequence
  Synthetic Construct
gcccaagtcgccttcaaaagcggcatcgcacag

SEQ ID NO: 3363 - DNA, 33 bp, Artificial Sequence
  Synthetic Construct
gcccaaagagtcggccccgaaagcagcgcacag

SEQ ID NO: 3364 - DNA, 33 bp, Artificial Sequence
  Synthetic Construct
gcccaagcccccagcaacgtccacaccgcacag

SEQ ID NO: 3365 - DNA, 33 bp, Artificial Sequence
  Synthetic Construct
gcccaaactaggtcggaggtgatgaaggcacag

SEQ ID NO: 3366 - DNA, 33 bp, Artificial Sequence
  Synthetic Construct
gcccaattgaaggagcagcatggtggggcacag

SEQ ID NO: 3367 - DNA, 33 bp, Artificial Sequence
  Synthetic Construct
gcccaaaaggcggagtcgcatgcgacggcacag

SEQ ID NO: 3368 - DNA, 33 bp, Artificial Sequence
  Synthetic Construct
gcccaatataggacggatatgctgagtgcacag

SEQ ID NO: 3369 - DNA, 33 bp, Artificial Sequence
  Synthetic Construct
gcccaagatacgcaggggaggatgcgggcacag

SEQ ID NO: 3370 - DNA, 33 bp, Artificial Sequence
  Synthetic Construct
gcccaatgtcttcctaagggttgtacggcacag

SEQ ID NO: 3371 - DNA, 33 bp, Artificial Sequence
  Synthetic Construct
gcccaaggcagccccaccgtcgtccacgcacag

SEQ ID NO: 3372 - DNA, 33 bp, Artificial Sequence
  Synthetic Construct
gcccaattgtcgctttctacgcagagggcacag

SEQ ID NO: 3373 - DNA, 33 bp, Artificial Sequence
  Synthetic Construct
gcccaaaacatggcccaaaacgccagagcacag

SEQ ID NO: 3374 - DNA, 33 bp, Artificial Sequence
  Synthetic Construct
gcccaactcagcaccaacgtcctcctcgcacag

SEQ ID NO: 3375 - DNA, 33 bp, Artificial Sequence
  Synthetic Construct
gcccaaacttcgcctgttattcgtactgcacag

SEQ ID NO: 3376 - DNA, 33 bp, Artificial Sequence
  Synthetic Construct
gcccaacctagtgctggtcatgttttggcacag

SEQ ID NO: 3377 - DNA, 33 bp, Artificial Sequence
  Synthetic Construct
gcccaactgtctggtacggctacttcggcacag

SEQ ID NO: 3378 - DNA, 33 bp, Artificial Sequence
  Synthetic Construct
gcccaaacgggtaatccgaatccgactgcacag

SEQ ID NO: 3379 - DNA, 33 bp, Artificial Sequence
  Synthetic Construct
gcccaacaattcgaacacagcctccccgcacag

SEQ ID NO: 3380 - DNA, 33 bp, Artificial Sequence
  Synthetic Construct
gcccaactcacccccggccaaatcagagcacag

SEQ ID NO: 3381 - DNA, 33 bp, Artificial Sequence
  Synthetic Construct
gcccaactgatgaatgcgaagacgacggcacag

SEQ ID NO: 3382 - DNA, 33 bp, Artificial Sequence
  Synthetic Construct
gcccaacaaagagacaccaacatggccgcacag

SEQ ID NO: 3383 - DNA, 33 bp, Artificial Sequence
  Synthetic Construct
gcccaaaacctcctcgaaatcggcagagcacag

SEQ ID NO: 3384 - DNA, 33 bp, Artificial Sequence
  Synthetic Construct
gcccaagacgtcaaagacaaacaaatcgcacag

SEQ ID NO: 3385 - DNA, 33 bp, Artificial Sequence
  Synthetic Construct
gcccaagtgactatttcgaataagcctgcacag

SEQ ID NO: 3386 - DNA, 33 bp, Artificial Sequence
  Synthetic Construct
gcccaaagcacccccatcaacagcagagcacag

SEQ ID NO: 3387 - DNA, 33 bp, Artificial Sequence
  Synthetic Construct
gcccaaggcacccacggcctcaccagcgcacag

SEQ ID NO: 3388 - DNA, 33 bp, Artificial Sequence
  Synthetic Construct
gcccaacagtctccggggatgattcatgcacag

SEQ ID NO: 3389 - DNA, 33 bp, Artificial Sequence
  Synthetic Construct
gcccaacaaaccggccccgtcctcagcgcacag

SEQ ID NO: 3390 - DNA, 33 bp, Artificial Sequence
  Synthetic Construct
gcccaaacttatgtgtcgtctggtccggcacag

SEQ ID NO: 3391 - DNA, 33 bp, Artificial Sequence
  Synthetic Construct
gcccaaaccagcaccctccccagactcgcacag

SEQ ID NO: 3392 - DNA, 33 bp, Artificial Sequence
  Synthetic Construct
gcccaatacacccacaaagacaacgacgcacag

SEQ ID NO: 3393 - DNA, 33 bp, Artificial Sequence
  Synthetic Construct
gcccaactcggcgcccaaagcaccctcgcacag

SEQ ID NO: 3394 - DNA, 33 bp, Artificial Sequence
  Synthetic Construct
gcccaattggcgcaggttaggcctgctgcacag

SEQ ID NO: 3395 - DNA, 33 bp, Artificial Sequence
  Synthetic Construct
gcccaaggcagagtcgtcgccagcaacgcacag

SEQ ID NO: 3396 - DNA, 33 bp, Artificial Sequence
  Synthetic Construct
gcccaaagtaatcgggttagggatcttgcacag

SEQ ID NO: 3397 - DNA, 33 bp, Artificial Sequence
  Synthetic Construct
gcccaagaaagagacagagaaaaactcgcacag

SEQ ID NO: 3398 - DNA, 33 bp, Artificial Sequence
  Synthetic Construct
gcccaaaagtctgggacgagttctactgcacag

SEQ ID NO: 3399 - DNA, 33 bp, Artificial Sequence
  Synthetic Construct
gcccaagctggtcagagtactatttatgcacag

SEQ ID NO: 3400 - DNA, 33 bp, Artificial Sequence
  Synthetic Construct
gcccaagagttttcgcagccgaggctggcacag

SEQ ID NO: 3401 - DNA, 33 bp, Artificial Sequence
  Synthetic Construct
gcccaaacgtatgcgaggtcggataaggcacag

SEQ ID NO: 3402 - DNA, 33 bp, Artificial Sequence
  Synthetic Construct
gcccaaggcaaattcaacggccacaccgcacag

SEQ ID NO: 3403 - DNA, 33 bp, Artificial Sequence
  Synthetic Construct
gcccaacggttgattagtaatgggaatgcacag

SEQ ID NO: 3404 - DNA, 33 bp, Artificial Sequence
  Synthetic Construct
gcccaattgaaggagtcgttggggcctgcacag

SEQ ID NO: 3405 - DNA, 33 bp, Artificial Sequence
  Synthetic Construct
gcccaaaacagacacaccctcgccgtcgcacag

SEQ ID NO: 3406 - DNA, 33 bp, Artificial Sequence
  Synthetic Construct
gcccaaagagacaccagactcagcgccgcacag

SEQ ID NO: 3407 - DNA, 33 bp, Artificial Sequence
  Synthetic Construct
gcccaagtcagcagactcggcagcatcgcacag

SEQ ID NO: 3408 - DNA, 33 bp, Artificial Sequence
  Synthetic Construct
gcccaattgactacgtcggtgatttcggcacag

SEQ ID NO: 3409 - DNA, 33 bp, Artificial Sequence
  Synthetic Construct
gcccaatttaagggggtggctcatattgcacag

SEQ ID NO: 3410 - DNA, 33 bp, Artificial Sequence
  Synthetic Construct
gcccaaaagacgacggaggctcttcctgcacag

SEQ ID NO: 3411 - DNA, 33 bp, Artificial Sequence
  Synthetic Construct
gcccaacgtaatcagcatgatactactgcacag

SEQ ID NO: 3412 - DNA, 33 bp, Artificial Sequence
  Synthetic Construct
gcccaaaataagcttctgcctcgtagtgcacag

SEQ ID NO: 3413 - DNA, 33 bp, Artificial Sequence
  Synthetic Construct
gcccaagtcaacagccacgaaagagccgcacag

SEQ ID NO: 3414 - DNA, 33 bp, Artificial Sequence
  Synthetic Construct
gcccaagcgaagggtagtctgaatatggcacag

SEQ ID NO: 3415 - DNA, 33 bp, Artificial Sequence
  Synthetic Construct
gcccaagttaagactgatcgggttctggcacag

SEQ ID NO: 3416 - DNA, 33 bp, Artificial Sequence
  Synthetic Construct
gcccaaccgcgttcggatcagattagggcacag

SEQ ID NO: 3417 - DNA, 33 bp, Artificial Sequence
  Synthetic Construct
gcccaaaacagagtcggcaccgaaagagcacag

SEQ ID NO: 3418 - DNA, 33 bp, Artificial Sequence
  Synthetic Construct
gcccaaggcgtccccaccgccggcaccgcacag

SEQ ID NO: 3419 - DNA, 33 bp, Artificial Sequence
  Synthetic Construct
gcccaaagcctcatgaaacaaagccacgcacag

SEQ ID NO: 3420 - DNA, 33 bp, Artificial Sequence
  Synthetic Construct
gcccaaggcaccagcagcaacatcatggcacag

SEQ ID NO: 3421 - DNA, 33 bp, Artificial Sequence
  Synthetic Construct
gcccaacttcggagtgatattagtactgcacag

SEQ ID NO: 3422 - DNA, 33 bp, Artificial Sequence
  Synthetic Construct
gcccaaatgaccaccggcagagacctcgcacag

SEQ ID NO: 3423 - DNA, 33 bp, Artificial Sequence
  Synthetic Construct
gcccaaagtggtgttgcgaatagttatgcacag

SEQ ID NO: 3424 - DNA, 33 bp, Artificial Sequence
  Synthetic Construct
gcccaagcggttccgtcttataataatgcacag

SEQ ID NO: 3425 - DNA, 33 bp, Artificial Sequence
  Synthetic Construct
gcccaactcaacggcggcaacagccccgcacag

SEQ ID NO: 3426 - DNA, 33 bp, Artificial Sequence
  Synthetic Construct
gcccaaaacagccacagcaccagctgggcacag

SEQ ID NO: 3427 - DNA, 33 bp, Artificial Sequence
  Synthetic Construct
gcccaaatgtatcatacggggcaggtggcacag

SEQ ID NO: 3428 - DNA, 33 bp, Artificial Sequence
  Synthetic Construct
gcccaaagagacaaactctacatcgccgcacag

SEQ ID NO: 3429 - DNA, 33 bp, Artificial Sequence
  Synthetic Construct
gcccaaaggaagtcggaggcggttcttgcacag

SEQ ID NO: 3430 - DNA, 33 bp, Artificial Sequence
  Synthetic Construct
gcccaacataagggtattcaggtgattgcacag

SEQ ID NO: 3431 - DNA, 33 bp, Artificial Sequence
  Synthetic Construct
gcccaaattgggaaggatgctccgaaggcacag

SEQ ID NO: 3432 - DNA, 33 bp, Artificial Sequence
  Synthetic Construct
gcccaaagcctcgccggcctccaagacgcacag

SEQ ID NO: 3433 - DNA, 33 bp, Artificial Sequence
  Synthetic Construct
gcccaatttagggtgtctgttgctgaggcacag

SEQ ID NO: 3434 - DNA, 33 bp, Artificial Sequence
  Synthetic Construct
gcccaaacccacaaagaacacagcatcgcacag

SEQ ID NO: 3435 - DNA, 33 bp, Artificial Sequence
  Synthetic Construct
gcccaaaacagcaaccacacctacagagcacag

SEQ ID NO: 3436 - DNA, 33 bp, Artificial Sequence
  Synthetic Construct
gcccaatttaatggggttcgtacggtggcacag

SEQ ID NO: 3437 - DNA, 33 bp, Artificial Sequence
  Synthetic Construct
gcccaacacatgggcatgagagacggcgcacag

SEQ ID NO: 3438 - DNA, 33 bp, Artificial Sequence
  Synthetic Construct
gcccaagggcagcagtctatggcggtggcacag

SEQ ID NO: 3439 - DNA, 33 bp, Artificial Sequence
  Synthetic Construct
gcccaatggtcgagtcaggttaatcgtgcacag

SEQ ID NO: 3440 - DNA, 33 bp, Artificial Sequence
  Synthetic Construct
gcccaaggttcgcatgttgggatgccggcacag

SEQ ID NO: 3441 - DNA, 33 bp, Artificial Sequence
  Synthetic Construct
gcccaaaaggggtcgttgactgctagtgcacag

SEQ ID NO: 3442 - DNA, 33 bp, Artificial Sequence
  Synthetic Construct
gcccaaggcgcccaaagcaacatcgtcgcacag

SEQ ID NO: 3443 - DNA, 33 bp, Artificial Sequence
  Synthetic Construct
gcccaaaatgattataatcatacgcgtgcacag

SEQ ID NO: 3444 - DNA, 33 bp, Artificial Sequence
  Synthetic Construct
gcccaacaaatcaaccccagcagcgtcgcacag

SEQ ID NO: 3445 - DNA, 33 bp, Artificial Sequence
  Synthetic Construct
gcccaagcgttgcgtggtgcgtctaatgcacag

SEQ ID NO: 3446 - DNA, 33 bp, Artificial Sequence
  Synthetic Construct
gcccaaagtgcttcgactatgtcgtttgcacag

SEQ ID NO: 3447 - DNA, 33 bp, Artificial Sequence
  Synthetic Construct
gcccaactcagcagcaacaacaacaacgcacag

SEQ ID NO: 3448 - DNA, 33 bp, Artificial Sequence
  Synthetic Construct
gcccaatctacgacgctggcgtcgaaggcacag

SEQ ID NO: 3449 - DNA, 33 bp, Artificial Sequence
  Synthetic Construct
gcccaacacagaatgctcgacggcgtcgcacag

SEQ ID NO: 3450 - DNA, 33 bp, Artificial Sequence
  Synthetic Construct
gcccaaagcagcgaaagcagcacccccgcacag

SEQ ID NO: 3451 - DNA, 33 bp, Artificial Sequence
  Synthetic Construct
gcccaattgtatgattctagtcatagtgcacag

SEQ ID NO: 3452 - DNA, 33 bp, Artificial Sequence
  Synthetic Construct
gcccaaggtaattataatttgagtgtggcacag

SEQ ID NO: 3453 - DNA, 33 bp, Artificial Sequence
  Synthetic Construct
gcccaaatgcataatgttgctacggtggcacag

SEQ ID NO: 3454 - DNA, 33 bp, Artificial Sequence
  Synthetic Construct
gcccaaaccaactacggcgacagcgtcgcacag

SEQ ID NO: 3455 - DNA, 33 bp, Artificial Sequence
  Synthetic Construct
gcccaaaatcgtggggaggatgcgcgggcacag

SEQ ID NO: 3456 - DNA, 33 bp, Artificial Sequence
  Synthetic Construct
gcccaatttggtaagacggcggctactgcacag

SEQ ID NO: 3457 - DNA, 33 bp, Artificial Sequence
  Synthetic Construct
gcccaaaatacgaaggttaatactgaggcacag

SEQ ID NO: 3458 - DNA, 33 bp, Artificial Sequence
  Synthetic Construct
gcccaagtcaccggccacctcagcagcgcacag

SEQ ID NO: 3459 - DNA, 33 bp, Artificial Sequence
  Synthetic Construct
gcccaagtggctacttcgcatttgaaggcacag

SEQ ID NO: 3460 - DNA, 33 bp, Artificial Sequence
  Synthetic Construct
gcccaatacacccccggcagcgacagagcacag

SEQ ID NO: 3461 - DNA, 33 bp, Artificial Sequence
  Synthetic Construct
gcccaaggcttcaccaccgtcacccacgcacag

SEQ ID NO: 3462 - DNA, 33 bp, Artificial Sequence
  Synthetic Construct
gcccaagccgccgccaccagcaccaccgcacag

SEQ ID NO: 3463 - DNA, 33 bp, Artificial Sequence
  Synthetic Construct
gcccaagcgaatattcatgttcatggtgcacag

SEQ ID NO: 3464 - DNA, 33 bp, Artificial Sequence
  Synthetic Construct
gcccaatatagtttgcggggtaatgatgcacag

SEQ ID NO: 3465 - DNA, 33 bp, Artificial Sequence
  Synthetic Construct
gcccaaattgatcagattgtgcagcgtgcacag

SEQ ID NO: 3466 - DNA, 33 bp, Artificial Sequence
  Synthetic Construct
gcccaattcaacagcgacctcgccatggcacag

SEQ ID NO: 3467 - DNA, 33 bp, Artificial Sequence
  Synthetic Construct
gcccaaaatatggagtcgcagcgttatgcacag

SEQ ID NO: 3468 - DNA, 33 bp, Artificial Sequence
  Synthetic Construct
gcccaaccgctttctagttcgctttcggcacag

SEQ ID NO: 3469 - DNA, 33 bp, Artificial Sequence
  Synthetic Construct
gcccaacagggtacgcttcatgctgaggcacag

SEQ ID NO: 3470 - DNA, 33 bp, Artificial Sequence
  Synthetic Construct
gcccaacccgacagagccaccgccctcgcacag

SEQ ID NO: 3471 - DNA, 33 bp, Artificial Sequence
  Synthetic Construct
gcccaagccaacggcaaaatccaactcgcacag

SEQ ID NO: 3472 - DNA, 33 bp, Artificial Sequence
  Synthetic Construct
gcccaatacagcaaagacagacacgacgcacag

SEQ ID NO: 3473 - DNA, 33 bp, Artificial Sequence
  Synthetic Construct
gcccaagacagcaccagcagagcctgggcacag

SEQ ID NO: 3474 - DNA, 33 bp, Artificial Sequence
  Synthetic Construct
gcccaaggcctcagcgtcgccatccccgcacag

SEQ ID NO: 3475 - DNA, 33 bp, Artificial Sequence
  Synthetic Construct
gcccaatcgtatcttactaatcatgtggcacag

SEQ ID NO: 3476 - DNA, 33 bp, Artificial Sequence
  Synthetic Construct
gcccaagttattacgcataatatgcctgcacag

SEQ ID NO: 3477 - DNA, 33 bp, Artificial Sequence
  Synthetic Construct
gcccaaaacagaacccacgtcccccaagcacag

SEQ ID NO: 3478 - DNA, 33 bp, Artificial Sequence
  Synthetic Construct
gcccaactccaaaccaccagagccgtcgcacag

SEQ ID NO: 3479 - DNA, 33 bp, Artificial Sequence
  Synthetic Construct
gcccaagcccccaacgccatcgacgtcgcacag

SEQ ID NO: 3480 - DNA, 33 bp, Artificial Sequence
  Synthetic Construct
gcccaagtcagagacaacaccgtctacgcacag

SEQ ID NO: 3481 - DNA, 33 bp, Artificial Sequence
  Synthetic Construct
gcccaaactcgtattgggacgtcgttggcacag

SEQ ID NO: 3482 - DNA, 33 bp, Artificial Sequence
  Synthetic Construct
gcccaaaccctcaccagcggcaacgtcgcacag

SEQ ID NO: 3483 - DNA, 33 bp, Artificial Sequence
  Synthetic Construct
gcccaacatcttgatactatgcggggtgcacag

SEQ ID NO: 3484 - DNA, 33 bp, Artificial Sequence
  Synthetic Construct
gcccaactcagcagcaccaccctcaacgcacag

SEQ ID NO: 3485 - DNA, 33 bp, Artificial Sequence
  Synthetic Construct
gcccaagttcagagtaataggactaatgcacag

SEQ ID NO: 3486 - DNA, 33 bp, Artificial Sequence
  Synthetic Construct
gcccaaaataataatattacgacgtctgcacag

SEQ ID NO: 3487 - DNA, 33 bp, Artificial Sequence
  Synthetic Construct
gcccaagtcggcaccgccggcaaactcgcacag

SEQ ID NO: 3488 - DNA, 33 bp, Artificial Sequence
  Synthetic Construct
gcccaacccgccatcagcaccgaccacgcacag

SEQ ID NO: 3489 - DNA, 33 bp, Artificial Sequence
  Synthetic Construct
gcccaaagtaatctgggtaatgtgccggcacag

SEQ ID NO: 3490 - DNA, 33 bp, Artificial Sequence
  Synthetic Construct
gcccaacaaaaccaaagcagattcaccgcacag

SEQ ID NO: 3491 - DNA, 33 bp, Artificial Sequence
  Synthetic Construct
gcccaagcttctaagggtatgacgttggcacag

SEQ ID NO: 3492 - DNA, 33 bp, Artificial Sequence
  Synthetic Construct
gcccaagccaccgcccaagacaaaaccgcacag

SEQ ID NO: 3493 - DNA, 33 bp, Artificial Sequence
  Synthetic Construct
gcccaatgggacagcagcagcgtcagagcacag

SEQ ID NO: 3494 - DNA, 33 bp, Artificial Sequence
  Synthetic Construct
gcccaaacgaatggtagtgagaagagtgcacag

SEQ ID NO: 3495 - DNA, 33 bp, Artificial Sequence
  Synthetic Construct
gcccaatctgctgagaatcatacgtatgcacag

SEQ ID NO: 3496 - DNA, 33 bp, Artificial Sequence
  Synthetic Construct
gcccaaagcgtcccccaagcctaccaagcacag

SEQ ID NO: 3497 - DNA, 33 bp, Artificial Sequence
  Synthetic Construct
gcccaaaaagactacgtcgtcaccaacgcacag

SEQ ID NO: 3498 - DNA, 33 bp, Artificial Sequence
  Synthetic Construct
gcccaagtcgtccaaatgaaacaaaccgcacag

SEQ ID NO: 3499 - DNA, 33 bp, Artificial Sequence
  Synthetic Construct
gcccaaagaaccctcagcctcaccgccgcacag

SEQ ID NO: 3500 - DNA, 33 bp, Artificial Sequence
  Synthetic Construct
gcccaaaacaccgtcgtcggcagcagcgcacag

SEQ ID NO: 3501 - DNA, 33 bp, Artificial Sequence
  Synthetic Construct
gcccaatctttgaatagtccgacgactgcacag

SEQ ID NO: 3502 - DNA, 33 bp, Artificial Sequence
  Synthetic Construct
gcccaaaccaccggcatggacgtcaaagcacag

SEQ ID NO: 3503 - DNA, 33 bp, Artificial Sequence
  Synthetic Construct
gcccaaaacaacagagacaccaccaacgcacag

SEQ ID NO: 3504 - DNA, 33 bp, Artificial Sequence
  Synthetic Construct
gcccaatggggcaactacacccccaccgcacag

SEQ ID NO: 3505 - DNA, 33 bp, Artificial Sequence
  Synthetic Construct
gcccaagggattacgcgttctgatactgcacag

SEQ ID NO: 3506 - DNA, 33 bp, Artificial Sequence
  Synthetic Construct
gcccaacacatcctcagaacccccgaagcacag

SEQ ID NO: 3507 - DNA, 33 bp, Artificial Sequence
  Synthetic Construct
gcccaacgttctgctagtgtggagaatgcacag

SEQ ID NO: 3508 - DNA, 33 bp, Artificial Sequence
  Synthetic Construct
gcccaaagcctcagcctcggcaaaggcgcacag

SEQ ID NO: 3509 - DNA, 33 bp, Artificial Sequence
  Synthetic Construct
gcccaaaaaagagaagtcgtcggcgacgcacag

SEQ ID NO: 3510 - DNA, 33 bp, Artificial Sequence
  Synthetic Construct
gcccaaatccaacccagcaaccacgaagcacag

SEQ ID NO: 3511 - DNA, 33 bp, Artificial Sequence
  Synthetic Construct
gcccaaatgaatctgggtaatgcgccggcacag

SEQ ID NO: 3512 - DNA, 33 bp, Artificial Sequence
  Synthetic Construct
gcccaacagccgaataatactaatagtgcacag

SEQ ID NO: 3513 - DNA, 33 bp, Artificial Sequence
  Synthetic Construct
gcccaactccaaagcatggtccaaggcgcacag

SEQ ID NO: 3514 - DNA, 33 bp, Artificial Sequence
  Synthetic Construct
gcccaacatggtaatactacttcgactgcacag

SEQ ID NO: 3515 - DNA, 33 bp, Artificial Sequence
  Synthetic Construct
gcccaaatccaaagcaccgtcaccctcgcacag

SEQ ID NO: 3516 - DNA, 33 bp, Artificial Sequence
  Synthetic Construct
gcccaagacgacagacaaggccccagagcacag

SEQ ID NO: 3517 - DNA, 33 bp, Artificial Sequence
  Synthetic Construct
gcccaacagacggctacgaatattctggcacag

SEQ ID NO: 3518 - DNA, 33 bp, Artificial Sequence
  Synthetic Construct
gcccaacggcagcatgcggatactgttgcacag

SEQ ID NO: 3519 - DNA, 33 bp, Artificial Sequence
  Synthetic Construct
gcccaaactaggtcggagagttctctggcacag

SEQ ID NO: 3520 - DNA, 33 bp, Artificial Sequence
  Synthetic Construct
gcccaacgtgggcatgatccggctgtggcacag

SEQ ID NO: 3521 - DNA, 33 bp, Artificial Sequence
  Synthetic Construct
gcccaaagcaccagccaaaccgacctcgcacag

SEQ ID NO: 3522 - DNA, 33 bp, Artificial Sequence
  Synthetic Construct
gcccaagtcagcaccagcgccgtcctcgcacag

SEQ ID NO: 3523 - DNA, 33 bp, Artificial Sequence
  Synthetic Construct
gcccaaagcatgccccccgaaagattcgcacag

SEQ ID NO: 3524 - DNA, 33 bp, Artificial Sequence
  Synthetic Construct
gcccaagtcaccagcgcccaccccgtcgcacag

SEQ ID NO: 3525 - DNA, 33 bp, Artificial Sequence
  Synthetic Construct
gcccaaaccagcagacaagtcggcctcgcacag

SEQ ID NO: 3526 - DNA, 33 bp, Artificial Sequence
  Synthetic Construct
gcccaaactccgaagttttcttatgaggcacag

SEQ ID NO: 3527 - DNA, 33 bp, Artificial Sequence
  Synthetic Construct
gcccaaaacagaatggccagcaccatggcacag

SEQ ID NO: 3528 - DNA, 33 bp, Artificial Sequence
  Synthetic Construct
gcccaactcctcgacaacaccagacccgcacag

SEQ ID NO: 3529 - DNA, 33 bp, Artificial Sequence
  Synthetic Construct
gcccaattgacgactattcctagtactgcacag

SEQ ID NO: 3530 - DNA, 33 bp, Artificial Sequence
  Synthetic Construct
gcccaagccaacagaatcagagacaacgcacag

SEQ ID NO: 3531 - DNA, 33 bp, Artificial Sequence
  Synthetic Construct
gcccaacccagagacatccaaagaaccgcacag

SEQ ID NO: 3532 - DNA, 33 bp, Artificial Sequence
  Synthetic Construct
gcccaaatgcctcatgggcttaagaatgcacag

SEQ ID NO: 3533 - DNA, 33 bp, Artificial Sequence
  Synthetic Construct
gcccaaccttttacgcagaatcatcttgcacag

SEQ ID NO: 3534 - DNA, 33 bp, Artificial Sequence
  Synthetic Construct
gcccaaaatgcgaatggtaatactcgtgcacag

SEQ ID NO: 3535 - DNA, 33 bp, Artificial Sequence
  Synthetic Construct
gcccaactggcttattctacgtcggcggcacag

SEQ ID NO: 3536 - DNA, 33 bp, Artificial Sequence
  Synthetic Construct
gcccaaaccgacagatacaacatcaaagcacag

SEQ ID NO: 3537 - DNA, 33 bp, Artificial Sequence
  Synthetic Construct
gcccaatatgttactagtgctgagcatgcacag

SEQ ID NO: 3538 - DNA, 33 bp, Artificial Sequence
  Synthetic Construct
gcccaaagtcatcagcagactacggttgcacag

SEQ ID NO: 3539 - DNA, 33 bp, Artificial Sequence
  Synthetic Construct
gcccaacttaatatgcagacgaggggggcacag

SEQ ID NO: 3540 - DNA, 33 bp, Artificial Sequence
  Synthetic Construct
gcccaatacaccccccaactcaaaagcgcacag

SEQ ID NO: 3541 - DNA, 33 bp, Artificial Sequence
  Synthetic Construct
gcccaacagattaatggtcaggttattgcacag

SEQ ID NO: 3542 - DNA, 33 bp, Artificial Sequence
  Synthetic Construct
gcccaaacgcgtgagggtgtgttgcctgcacag

SEQ ID NO: 3543 - DNA, 33 bp, Artificial Sequence
  Synthetic Construct
gcccaagttcatcagtcggtgccgctggcacag

SEQ ID NO: 3544 - DNA, 33 bp, Artificial Sequence
  Synthetic Construct
gcccaaccgtattcgatggggcatcctgcacag

SEQ ID NO: 3545 - DNA, 33 bp, Artificial Sequence
  Synthetic Construct
gcccaaggcaccaaaacccacagcctcgcacag

SEQ ID NO: 3546 - DNA, 33 bp, Artificial Sequence
  Synthetic Construct
gcccaaacgctgactacggggtcgaaggcacag

SEQ ID NO: 3547 - DNA, 33 bp, Artificial Sequence
  Synthetic Construct
gcccaatttacgattggtgttacgggggcacag

SEQ ID NO: 3548 - DNA, 33 bp, Artificial Sequence
  Synthetic Construct
gcccaactcagcagccacaaccacaacgcacag

SEQ ID NO: 3549 - DNA, 33 bp, Artificial Sequence
  Synthetic Construct
gcccaaaccggcaaaatgcccctcgaagcacag

SEQ ID NO: 3550 - DNA, 33 bp, Artificial Sequence
  Synthetic Construct
gcccaaactgcgaatcctcatgcgactgcacag

SEQ ID NO: 3551 - DNA, 33 bp, Artificial Sequence
  Synthetic Construct
gcccaacacgacagcgtcgccagcagcgcacag

SEQ ID NO: 3552 - DNA, 33 bp, Artificial Sequence
  Synthetic Construct
gcccaaacgcgtgcggatgtgttgatggcacag

SEQ ID NO: 3553 - DNA, 33 bp, Artificial Sequence
  Synthetic Construct
gcccaagctaatcatgcttctaatgcggcacag

SEQ ID NO: 3554 - DNA, 33 bp, Artificial Sequence
  Synthetic Construct
gcccaaagccacatcgtcggcgtcgaagcacag

SEQ ID NO: 3555 - DNA, 33 bp, Artificial Sequence
  Synthetic Construct
gcccaatacaccgcccaaaaaaccagcgcacag

SEQ ID NO: 3556 - DNA, 33 bp, Artificial Sequence
  Synthetic Construct
gcccaattgcctgctgtgcagaagatggcacag

SEQ ID NO: 3557 - DNA, 33 bp, Artificial Sequence
  Synthetic Construct
gcccaatctggtattcagacggctaaggcacag

SEQ ID NO: 3558 - DNA, 33 bp, Artificial Sequence
  Synthetic Construct
gcccaagatccggtgaagattggtcatgcacag

SEQ ID NO: 3559 - DNA, 33 bp, Artificial Sequence
  Synthetic Construct
gcccaaagtcagactatgagtaagagtgcacag

SEQ ID NO: 3560 - DNA, 33 bp, Artificial Sequence
  Synthetic Construct
gcccaaagcctcacccccaccaacatcgcacag

SEQ ID NO: 3561 - DNA, 33 bp, Artificial Sequence
  Synthetic Construct
gcccaatatcttaataatacgaattctgcacag

SEQ ID NO: 3562 - DNA, 33 bp, Artificial Sequence
  Synthetic Construct
gcccaaatgaccagaatgagccaaaacgcacag

SEQ ID NO: 3563 - DNA, 33 bp, Artificial Sequence
  Synthetic Construct
gcccaagtcaaccaaagcctcagcagagcacag

SEQ ID NO: 3564 - DNA, 33 bp, Artificial Sequence
  Synthetic Construct
gcccaaagaaccgtcaccgacaacagagcacag

SEQ ID NO: 3565 - DNA, 33 bp, Artificial Sequence
  Synthetic Construct
gcccaaattactggggtgtttgctaatgcacag

SEQ ID NO: 3566 - DNA, 33 bp, Artificial Sequence
  Synthetic Construct
gcccaatcgcctgggctgagtagggttgcacag

SEQ ID NO: 3567 - DNA, 33 bp, Artificial Sequence
  Synthetic Construct
gcccaagtggtgaatcctcagactagggcacag

SEQ ID NO: 3568 - DNA, 33 bp, Artificial Sequence
  Synthetic Construct
gcccaatggagccaaagcctcagcgccgcacag

SEQ ID NO: 3569 - DNA, 33 bp, Artificial Sequence
  Synthetic Construct
gcccaacccagagacgccagcaacgacgcacag

SEQ ID NO: 3570 - DNA, 33 bp, Artificial Sequence
  Synthetic Construct
gcccaatacaccagcatgaccgaattcgcacag

SEQ ID NO: 3571 - DNA, 33 bp, Artificial Sequence
  Synthetic Construct
gcccaaaacaacagccccagccccagagcacag

SEQ ID NO: 3572 - DNA, 33 bp, Artificial Sequence
  Synthetic Construct
gcccaaaacagcctcagccacggcgacgcacag

SEQ ID NO: 3573 - DNA, 33 bp, Artificial Sequence
  Synthetic Construct
gcccaaagagtcgccggcgaaatggccgcacag

SEQ ID NO: 3574 - DNA, 33 bp, Artificial Sequence
  Synthetic Construct
gcccaaggtattgggtctagggagcttgcacag

SEQ ID NO: 3575 - DNA, 33 bp, Artificial Sequence
  Synthetic Construct
gcccaatatgttagtcgtattcgtgatgcacag

SEQ ID NO: 3576 - DNA, 33 bp, Artificial Sequence
  Synthetic Construct
gcccaataccccagccccaacgacaacgcacag

SEQ ID NO: 3577 - DNA, 33 bp, Artificial Sequence
  Synthetic Construct
gcccaacttcagaggacggcgcataatgcacag

SEQ ID NO: 3578 - DNA, 33 bp, Artificial Sequence
  Synthetic Construct
gcccaactcgacagcctcagcagacacgcacag

SEQ ID NO: 3579 - DNA, 33 bp, Artificial Sequence
  Synthetic Construct
gcccaaaccaaaatcagcgccggcagcgcacag

SEQ ID NO: 3580 - DNA, 33 bp, Artificial Sequence
  Synthetic Construct
gcccaaaaagacaacagccccgtcgtcgcacag

SEQ ID NO: 3581 - DNA, 33 bp, Artificial Sequence
  Synthetic Construct
gcccaaaccggccaaggcagcagcctcgcacag

SEQ ID NO: 3582 - DNA, 33 bp, Artificial Sequence
  Synthetic Construct
gcccaagatacgcatctgagtcgtcatgcacag

SEQ ID NO: 3583 - DNA, 33 bp, Artificial Sequence
  Synthetic Construct
gcccaagatattgttaggaggcaggctgcacag

SEQ ID NO: 3584 - DNA, 33 bp, Artificial Sequence
  Synthetic Construct
gcccaagctatgaagtatgcgcagactgcacag

SEQ ID NO: 3585 - DNA, 33 bp, Artificial Sequence
  Synthetic Construct
gcccaaaggctggctgatcagcatccggcacag

SEQ ID NO: 3586 - DNA, 33 bp, Artificial Sequence
  Synthetic Construct
gcccaagctcctgatagtactcggatggcacag

SEQ ID NO: 3587 - DNA, 33 bp, Artificial Sequence
  Synthetic Construct
gcccaaagtcgggtttctccttcttcggcacag

SEQ ID NO: 3588 - DNA, 33 bp, Artificial Sequence
  Synthetic Construct
gcccaagtgcatggtcagggtgagcctgcacag

SEQ ID NO: 3589 - DNA, 33 bp, Artificial Sequence
  Synthetic Construct
gcccaaatgagagacagcagcaccagagcacag

SEQ ID NO: 3590 - DNA, 33 bp, Artificial Sequence
  Synthetic Construct
gcccaatggccccaacacaccaacaccgcacag

SEQ ID NO: 3591 - DNA, 33 bp, Artificial Sequence
  Synthetic Construct
gcccaagtcggcagctaccccgtcaccgcacag

SEQ ID NO: 3592 - DNA, 33 bp, Artificial Sequence
  Synthetic Construct
gcccaaactgcgactcagggggctaatgcacag

SEQ ID NO: 3593 - DNA, 33 bp, Artificial Sequence
  Synthetic Construct
gcccaaaagaataatagtatggatagtgcacag

SEQ ID NO: 3594 - DNA, 33 bp, Artificial Sequence
  Synthetic Construct
gcccaacacaccaacgccgtcaaagaagcacag

SEQ ID NO: 3595 - DNA, 33 bp, Artificial Sequence
  Synthetic Construct
gcccaacttcattcggtgactacgccggcacag

SEQ ID NO: 3596 - DNA, 33 bp, Artificial Sequence
  Synthetic Construct
gcccaagcccccggccaacaaaacttcgcacag

SEQ ID NO: 3597 - DNA, 33 bp, Artificial Sequence
  Synthetic Construct
gcccaatcttatactaatcgtactatggcacag

SEQ ID NO: 3598 - DNA, 33 bp, Artificial Sequence
  Synthetic Construct
gcccaatcgggtcagagtaatacgaaggcacag

SEQ ID NO: 3599 - DNA, 33 bp, Artificial Sequence
  Synthetic Construct
gcccaagacagctacagagcccaaagcgcacag

SEQ ID NO: 3600 - DNA, 33 bp, Artificial Sequence
  Synthetic Construct
gcccaaatgtataagcataattctgatgcacag

SEQ ID NO: 3601 - DNA, 33 bp, Artificial Sequence
  Synthetic Construct
gcccaaagcctcgccatggtcaaccccgcacag

SEQ ID NO: 3602 - DNA, 33 bp, Artificial Sequence
  Synthetic Construct
gcccaacccctcaccagcaaaagcatggcacag

SEQ ID NO: 3603 - DNA, 33 bp, Artificial Sequence
  Synthetic Construct
gcccaactcggcgcccaacccacccccgcacag

SEQ ID NO: 3604 - DNA, 33 bp, Artificial Sequence
  Synthetic Construct
gcccaagaaggcaaccaaaaaccccaagcacag

SEQ ID NO: 3605 - DNA, 33 bp, Artificial Sequence
  Synthetic Construct
gcccaacaggttcggccgggtgctcatgcacag

SEQ ID NO: 3606 - DNA, 33 bp, Artificial Sequence
  Synthetic Construct
gcccaaagcggcaacatcaccgccatggcacag

SEQ ID NO: 3607 - DNA, 33 bp, Artificial Sequence
  Synthetic Construct
gcccaaaacgacagcaaaatcgccgaagcacag

SEQ ID NO: 3608 - DNA, 33 bp, Artificial Sequence
  Synthetic Construct
gcccaaatcatgaaaaacgaacacaacgcacag

SEQ ID NO: 3609 - DNA, 33 bp, Artificial Sequence
  Synthetic Construct
gcccaacttttgacgaatactgatcgggcacag

SEQ ID NO: 3610 - DNA, 33 bp, Artificial Sequence
  Synthetic Construct
gcccaagatacggcgcagagtcgtaatgcacag

SEQ ID NO: 3611 - DNA, 33 bp, Artificial Sequence
  Synthetic Construct
gcccaaattgatcatggtaagacgaatgcacag

SEQ ID NO: 3612 - DNA, 33 bp, Artificial Sequence
  Synthetic Construct
gcccaaaccagccccagaagcctcctcgcacag

SEQ ID NO: 3613 - DNA, 33 bp, Artificial Sequence
  Synthetic Construct
gcccaatcgaatcctcgggattctagtgcacag

SEQ ID NO: 3614 - DNA, 33 bp, Artificial Sequence
  Synthetic Construct
gcccaaatcatgcaaagcatccaaaacgcacag

SEQ ID NO: 3615 - DNA, 33 bp, Artificial Sequence
  Synthetic Construct
gcccaaaaagtcagccccagcagcaccgcacag

SEQ ID NO: 3616 - DNA, 33 bp, Artificial Sequence
  Synthetic Construct
gcccaaaccggccccagccccagcctcgcacag

SEQ ID NO: 3617 - DNA, 33 bp, Artificial Sequence
  Synthetic Construct
gcccaaggcgccgccagagcccaagccgcacag

SEQ ID NO: 3618 - DNA, 33 bp, Artificial Sequence
  Synthetic Construct
gcccaaaagtttcagtctcctgagcctgcacag

SEQ ID NO: 3619 - DNA, 33 bp, Artificial Sequence
  Synthetic Construct
gcccaaatggcgacgaattcgacggaggcacag

SEQ ID NO: 3620 - DNA, 33 bp, Artificial Sequence
  Synthetic Construct
gcccaaaacgtcctcaccaacatcagcgcacag

SEQ ID NO: 3621 - DNA, 33 bp, Artificial Sequence
  Synthetic Construct
gcccaaaagaatggtatgaatttggtggcacag

SEQ ID NO: 3622 - DNA, 33 bp, Artificial Sequence
  Synthetic Construct
gcccaaactcctacgcagccttctagtgcacag

SEQ ID NO: 3623 - DNA, 33 bp, Artificial Sequence
  Synthetic Construct
gcccaaactaaggagcttgttattcatgcacag

SEQ ID NO: 3624 - DNA, 33 bp, Artificial Sequence
  Synthetic Construct
gcccaaatcatgaaccaaagcgtccaagcacag

SEQ ID NO: 3625 - DNA, 33 bp, Artificial Sequence
  Synthetic Construct
gcccaagtgtctaatgctagggataaggcacag

SEQ ID NO: 3626 - DNA, 33 bp, Artificial Sequence
  Synthetic Construct
gcccaaagtaatcatacgcggtcgtatgcacag

SEQ ID NO: 3627 - DNA, 33 bp, Artificial Sequence
  Synthetic Construct
gcccaacacaccgacagactcaaccccgcacag

SEQ ID NO: 3628 - DNA, 33 bp, Artificial Sequence
  Synthetic Construct
gcccaagccgcccccagcatgagcgacgcacag

SEQ ID NO: 3629 - DNA, 33 bp, Artificial Sequence
  Synthetic Construct
gcccaattttcgaatacgcatgctttggcacag

SEQ ID NO: 3630 - DNA, 33 bp, Artificial Sequence
  Synthetic Construct
gcccaagctcatgatctgcatcgtgtggcacag

SEQ ID NO: 3631 - DNA, 33 bp, Artificial Sequence
  Synthetic Construct
gcccaacttcaggttaatcatgtggcggcacag

SEQ ID NO: 3632 - DNA, 33 bp, Artificial Sequence
  Synthetic Construct
gcccaaagcggccccaacctcagcagagcacag

SEQ ID NO: 3633 - DNA, 33 bp, Artificial Sequence
  Synthetic Construct
gcccaaacttatacgtcgacgcctggtgcacag

SEQ ID NO: 3634 - DNA, 33 bp, Artificial Sequence
  Synthetic Construct
gcccaatatggtactcctccttcgacggcacag

SEQ ID NO: 3635 - DNA, 33 bp, Artificial Sequence
  Synthetic Construct
gcccaatatggtgtgagttcgggtagtgcacag

SEQ ID NO: 3636 - DNA, 33 bp, Artificial Sequence
  Synthetic Construct
gcccaacccaccagagacctcatgagcgcacag

SEQ ID NO: 3637 - DNA, 33 bp, Artificial Sequence
  Synthetic Construct
gcccaaaagattgatgcgatgacgcaggcacag

SEQ ID NO: 3638 - DNA, 33 bp, Artificial Sequence
  Synthetic Construct
gcccaaagaatcggcaccagcgaagtcgcacag

SEQ ID NO: 3639 - DNA, 33 bp, Artificial Sequence
  Synthetic Construct
gcccaatttgatcctcttcagtcgtcggcacag

SEQ ID NO: 3640 - DNA, 33 bp, Artificial Sequence
  Synthetic Construct
gcccaactcctccaccacgtcgaagtcgcacag

SEQ ID NO: 3641 - DNA, 33 bp, Artificial Sequence
  Synthetic Construct
gcccaagtcaccctcggcaacagcgtcgcacag

SEQ ID NO: 3642 - DNA, 33 bp, Artificial Sequence
  Synthetic Construct
gcccaactcctcaacgacagaagcgtcgcacag

SEQ ID NO: 3643 - DNA, 33 bp, Artificial Sequence
  Synthetic Construct
gcccaattcgtcgacagaagaccccaagcacag

SEQ ID NO: 3644 - DNA, 33 bp, Artificial Sequence
  Synthetic Construct
gcccaaacgaatgtgactacgacgacggcacag

SEQ ID NO: 3645 - DNA, 33 bp, Artificial Sequence
  Synthetic Construct
gcccaagacgaaaccaacaaaagatgggcacag

SEQ ID NO: 3646 - DNA, 33 bp, Artificial Sequence
  Synthetic Construct
gcccaaacgtcgacgtctgctattcgggcacag

SEQ ID NO: 3647 - DNA, 33 bp, Artificial Sequence
  Synthetic Construct
gcccaaggcaccagcagagtccaaggcgcacag

SEQ ID NO: 3648 - DNA, 33 bp, Artificial Sequence
  Synthetic Construct
gcccaactcaacaccatggccctccccgcacag

SEQ ID NO: 3649 - DNA, 33 bp, Artificial Sequence
  Synthetic Construct
gcccaaagtactcatgcgactgatagggcacag

SEQ ID NO: 3650 - DNA, 33 bp, Artificial Sequence
  Synthetic Construct
gcccaacaccacggcgtcaccagcggcgcacag

SEQ ID NO: 3651 - DNA, 33 bp, Artificial Sequence
  Synthetic Construct
gcccaaggcctcatggccaacaaccccgcacag

SEQ ID NO: 3652 - DNA, 33 bp, Artificial Sequence
  Synthetic Construct
gcccaagggtcttcgtctaattcgtttgcacag

SEQ ID NO: 3653 - DNA, 33 bp, Artificial Sequence
  Synthetic Construct
gcccaaagagaaaaaatgaccctcctcgcacag

SEQ ID NO: 3654 - DNA, 33 bp, Artificial Sequence
  Synthetic Construct
gcccaaagccccgtcagcagcgacagcgcacag

SEQ ID NO: 3655 - DNA, 33 bp, Artificial Sequence
  Synthetic Construct
gcccaagacgtcgcccacaaagacagagcacag

SEQ ID NO: 3656 - DNA, 33 bp, Artificial Sequence
  Synthetic Construct
gcccaaagtatggtttctaatattgcggcacag

SEQ ID NO: 3657 - DNA, 33 bp, Artificial Sequence
  Synthetic Construct
gcccaaatgatgcataatatgcagtctgcacag

SEQ ID NO: 3658 - DNA, 33 bp, Artificial Sequence
  Synthetic Construct
gcccaagtgtcgaattcttctcggatggcacag

SEQ ID NO: 3659 - DNA, 33 bp, Artificial Sequence
  Synthetic Construct
gcccaatatacggctactaaggcgagtgcacag

SEQ ID NO: 3660 - DNA, 33 bp, Artificial Sequence
  Synthetic Construct
gcccaaagcaccagcggcggcgtcagagcacag

SEQ ID NO: 3661 - DNA, 33 bp, Artificial Sequence
  Synthetic Construct
gcccaatttactagggctgagcctgcggcacag

SEQ ID NO: 3662 - DNA, 33 bp, Artificial Sequence
  Synthetic Construct
gcccaacctattacgaggggtactattgcacag

SEQ ID NO: 3663 - DNA, 33 bp, Artificial Sequence
  Synthetic Construct
gcccaataccacaacagcatgctcggcgcacag

SEQ ID NO: 3664 - DNA, 33 bp, Artificial Sequence
  Synthetic Construct
gcccaaagtaatagtccgggtaatgctgcacag

SEQ ID NO: 3665 - DNA, 33 bp, Artificial Sequence
  Synthetic Construct
gcccaacaaaaaggcgtccaactccccgcacag

SEQ ID NO: 3666 - DNA, 33 bp, Artificial Sequence
  Synthetic Construct
gcccaacgtagtgagactaataatactgcacag

SEQ ID NO: 3667 - DNA, 33 bp, Artificial Sequence
  Synthetic Construct
gcccaagtggatcagatgctggctcctgcacag

SEQ ID NO: 3668 - DNA, 33 bp, Artificial Sequence
  Synthetic Construct
gcccaacaaaccagacacaccagcatggcacag

SEQ ID NO: 3669 - DNA, 33 bp, Artificial Sequence
  Synthetic Construct
gcccaaatgcacgccgacagagccctcgcacag

SEQ ID NO: 3670 - DNA, 33 bp, Artificial Sequence
  Synthetic Construct
gcccaatcgactacgcatgctcctaaggcacag

SEQ ID NO: 3671 - DNA, 33 bp, Artificial Sequence
  Synthetic Construct
gcccaatctaatcagactattatgacggcacag

SEQ ID NO: 3672 - DNA, 33 bp, Artificial Sequence
  Synthetic Construct
gcccaagtttcttcgccttctggtctggcacag

SEQ ID NO: 3673 - DNA, 33 bp, Artificial Sequence
  Synthetic Construct
gcccaaaaaagaggcgaagaaatggtcgcacag

SEQ ID NO: 3674 - DNA, 33 bp, Artificial Sequence
  Synthetic Construct
gcccaacaggatagtgggaatagttatgcacag

SEQ ID NO: 3675 - DNA, 33 bp, Artificial Sequence
  Synthetic Construct
gcccaaagccacgccaccaccggcggcgcacag

SEQ ID NO: 3676 - DNA, 33 bp, Artificial Sequence
  Synthetic Construct
gcccaaaagctgagtgagacgtctcatgcacag

SEQ ID NO: 3677 - DNA, 33 bp, Artificial Sequence
  Synthetic Construct
gcccaacttaattataaggaggcgccggcacag

SEQ ID NO: 3678 - DNA, 33 bp, Artificial Sequence
  Synthetic Construct
gcccaaagcgtcgacagcgtcagactcgcacag

SEQ ID NO: 3679 - DNA, 33 bp, Artificial Sequence
  Synthetic Construct
gcccaacaacccaacgtcatccaaaccgcacag

SEQ ID NO: 3680 - DNA, 33 bp, Artificial Sequence
  Synthetic Construct
gcccaacgtatgactaatttgcagactgcacag

SEQ ID NO: 3681 - DNA, 33 bp, Artificial Sequence
  Synthetic Construct
gcccaagccacccccggcggcagcggcgcacag

SEQ ID NO: 3682 - DNA, 33 bp, Artificial Sequence
  Synthetic Construct
gcccaagacgtcaacagcatgagcagcgcacag

SEQ ID NO: 3683 - DNA, 33 bp, Artificial Sequence
  Synthetic Construct
gcccaattgcctcgtagtcatcttgatgcacag

SEQ ID NO: 3684 - DNA, 33 bp, Artificial Sequence
  Synthetic Construct
gcccaacccgcccccagatacgacaaagcacag

SEQ ID NO: 3685 - DNA, 33 bp, Artificial Sequence
  Synthetic Construct
gcccaaagaaactacagcgacaaagacgcacag

SEQ ID NO: 3686 - DNA, 33 bp, Artificial Sequence
  Synthetic Construct
gcccaaagtgagaatcttttgagtcgtgcacag

SEQ ID NO: 3687 - DNA, 33 bp, Artificial Sequence
  Synthetic Construct
gcccaaagtagtcttaatatgaaggatgcacag

SEQ ID NO: 3688 - DNA, 33 bp, Artificial Sequence
  Synthetic Construct
gcccaaagcgacaaagaatacggcagagcacag

SEQ ID NO: 3689 - DNA, 33 bp, Artificial Sequence
  Synthetic Construct
gcccaatacgtcagccaaagcggcatggcacag

SEQ ID NO: 3690 - DNA, 33 bp, Artificial Sequence
  Synthetic Construct
gcccaaaacgtcgtcagcgtcagacaagcacag

SEQ ID NO: 3691 - DNA, 33 bp, Artificial Sequence
  Synthetic Construct
gcccaaacgggtaaggagggtcggactgcacag

SEQ ID NO: 3692 - DNA, 33 bp, Artificial Sequence
  Synthetic Construct
gcccaatttaagaatactgtggcgactgcacag

SEQ ID NO: 3693 - DNA, 33 bp, Artificial Sequence
  Synthetic Construct
gcccaaggcagcagagaacccagcagcgcacag

SEQ ID NO: 3694 - DNA, 33 bp, Artificial Sequence
  Synthetic Construct
gcccaaagagaaaaagtcagcacccccgcacag

SEQ ID NO: 3695 - DNA, 33 bp, Artificial Sequence
  Synthetic Construct
gcccaacaggagcctgctaggcataatgcacag

SEQ ID NO: 3696 - DNA, 33 bp, Artificial Sequence
  Synthetic Construct
gcccaaactagtcattcgaatggtcgtgcacag

SEQ ID NO: 3697 - DNA, 33 bp, Artificial Sequence
  Synthetic Construct
gcccaagacctcagcagccccaaaatggcacag

SEQ ID NO: 3698 - DNA, 33 bp, Artificial Sequence
  Synthetic Construct
gcccaactcgccaccacccccaaacccgcacag

SEQ ID NO: 3699 - DNA, 33 bp, Artificial Sequence
  Synthetic Construct
gcccaaagcggccccaacgtcagcctcgcacag

SEQ ID NO: 3700 - DNA, 33 bp, Artificial Sequence
  Synthetic Construct
gcccaacccgtctacaacgccagccccgcacag

SEQ ID NO: 3701 - DNA, 33 bp, Artificial Sequence
  Synthetic Construct
gcccaaaattctactactttggtgatggcacag

SEQ ID NO: 3702 - DNA, 33 bp, Artificial Sequence
  Synthetic Construct
gcccaaagaaacgccgtcgtcagcatggcacag

SEQ ID NO: 3703 - DNA, 33 bp, Artificial Sequence
  Synthetic Construct
gcccaaaaggatcttctggctaagcttgcacag

SEQ ID NO: 3704 - DNA, 33 bp, Artificial Sequence
  Synthetic Construct
gcccaaccccacgaaggcagcagcagagcacag

SEQ ID NO: 3705 - DNA, 33 bp, Artificial Sequence
  Synthetic Construct
gcccaacgggatacggtttcgcgttatgcacag

SEQ ID NO: 3706 - DNA, 33 bp, Artificial Sequence
  Synthetic Construct
gcccaaggccaagccgcccaaggccacgcacag

SEQ ID NO: 3707 - DNA, 33 bp, Artificial Sequence
  Synthetic Construct
gcccaaagggctgagactgctcatgtggcacag

SEQ ID NO: 3708 - DNA, 33 bp, Artificial Sequence
  Synthetic Construct
gcccaagaaaacagaaccgtccccaccgcacag

SEQ ID NO: 3709 - DNA, 33 bp, Artificial Sequence
  Synthetic Construct
gcccaaagtagtaatgatgcgagggtggcacag

SEQ ID NO: 3710 - DNA, 33 bp, Artificial Sequence
  Synthetic Construct
gcccaacccggccaagtcgacagaagagcacag

SEQ ID NO: 3711 - DNA, 33 bp, Artificial Sequence
  Synthetic Construct
gcccaaggccccggcgccaacaccaccgcacag

SEQ ID NO: 3712 - DNA, 33 bp, Artificial Sequence
  Synthetic Construct
gcccaaatgcccgaaaacctcaaagaagcacag

SEQ ID NO: 3713 - DNA, 33 bp, Artificial Sequence
  Synthetic Construct
gcccaaacgaatgcggtggcttctaatgcacag

SEQ ID NO: 3714 - DNA, 33 bp, Artificial Sequence
  Synthetic Construct
gcccaatacggcaaaatcgaactctacgcacag

SEQ ID NO: 3715 - DNA, 33 bp, Artificial Sequence
  Synthetic Construct
gcccaaaatccgaatggtacgggttttgcacag

SEQ ID NO: 3716 - DNA, 33 bp, Artificial Sequence
  Synthetic Construct
gcccaatctcggaatactatgggttcggcacag

SEQ ID NO: 3717 - DNA, 33 bp, Artificial Sequence
  Synthetic Construct
gcccaaccgagtcatgggattacggctgcacag

SEQ ID NO: 3718 - DNA, 33 bp, Artificial Sequence
  Synthetic Construct
gcccaattggagacgctgagggggcctgcacag

SEQ ID NO: 3719 - DNA, 33 bp, Artificial Sequence
  Synthetic Construct
gcccaagatcgttctcctgatattagggcacag

SEQ ID NO: 3720 - DNA, 33 bp, Artificial Sequence
  Synthetic Construct
gcccaaaaggatttggcgtctgcgaaggcacag

SEQ ID NO: 3721 - DNA, 33 bp, Artificial Sequence
  Synthetic Construct
gcccaaatcaccagccacggcaacagcgcacag

SEQ ID NO: 3722 - DNA, 33 bp, Artificial Sequence
  Synthetic Construct
gcccaacattctaagatgccttctacggcacag

SEQ ID NO: 3723 - DNA, 33 bp, Artificial Sequence
  Synthetic Construct
gcccaaattgcgacttttacgacggcggcacag

SEQ ID NO: 3724 - DNA, 33 bp, Artificial Sequence
  Synthetic Construct
gcccaagcggcgtctgggtatcttaatgcacag

SEQ ID NO: 3725 - DNA, 33 bp, Artificial Sequence
  Synthetic Construct
gcccaagatagtgttaggccggctattgcacag

SEQ ID NO: 3726 - DNA, 33 bp, Artificial Sequence
  Synthetic Construct
gcccaaagactcagcgaagaaatgagagcacag

SEQ ID NO: 3727 - DNA, 33 bp, Artificial Sequence
  Synthetic Construct
gcccaactccccatcagcgccaccgaagcacag

SEQ ID NO: 3728 - DNA, 33 bp, Artificial Sequence
  Synthetic Construct
gcccaatctaatgtggcggctcagatggcacag

SEQ ID NO: 3729 - DNA, 33 bp, Artificial Sequence
  Synthetic Construct
gcccaatatcagtcgctgatttctgaggcacag

SEQ ID NO: 3730 - DNA, 33 bp, Artificial Sequence
  Synthetic Construct
gcccaatatcagagtgggtatgataaggcacag

SEQ ID NO: 3731 - DNA, 33 bp, Artificial Sequence
  Synthetic Construct
gcccaactcagaaccggcgaactcaccgcacag

SEQ ID NO: 3732 - DNA, 33 bp, Artificial Sequence
  Synthetic Construct
gcccaaccggcgacgaataatatgcgggcacag

SEQ ID NO: 3733 - DNA, 33 bp, Artificial Sequence
  Synthetic Construct
gcccaagtcagcagcagcaaattcagcgcacag

SEQ ID NO: 3734 - DNA, 33 bp, Artificial Sequence
  Synthetic Construct
gcccaaactacgctgcttgataaggctgcacag

SEQ ID NO: 3735 - DNA, 33 bp, Artificial Sequence
  Synthetic Construct
gcccaaagccccgccctccaccccagcgcacag

SEQ ID NO: 3736 - DNA, 33 bp, Artificial Sequence
  Synthetic Construct
gcccaattcaaccacaacagaaccgacgcacag

SEQ ID NO: 3737 - DNA, 33 bp, Artificial Sequence
  Synthetic Construct
gcccaagccgaaaaaaccgccaacggcgcacag

SEQ ID NO: 3738 - DNA, 33 bp, Artificial Sequence
  Synthetic Construct
gcccaaaatctgcgtgtgacggcttcggcacag

SEQ ID NO: 3739 - DNA, 33 bp, Artificial Sequence
  Synthetic Construct
gcccaaatgaaggatgggtcgcggattgcacag

SEQ ID NO: 3740 - DNA, 33 bp, Artificial Sequence
  Synthetic Construct
gcccaaagaatcggcgccaacgccaccgcacag

SEQ ID NO: 3741 - DNA, 33 bp, Artificial Sequence
  Synthetic Construct
gcccaagccaacctcacccccaacagagcacag

SEQ ID NO: 3742 - DNA, 33 bp, Artificial Sequence
  Synthetic Construct
gcccaatcggtgtctgataagagtcatgcacag

SEQ ID NO: 3743 - DNA, 33 bp, Artificial Sequence
  Synthetic Construct
gcccaatacagcaccctccacaccgccgcacag

SEQ ID NO: 3744 - DNA, 33 bp, Artificial Sequence
  Synthetic Construct
gcccaaacgaagtttggtggtattcaggcacag

SEQ ID NO: 3745 - DNA, 33 bp, Artificial Sequence
  Synthetic Construct
gcccaagacatccccaaaggcagcagcgcacag

SEQ ID NO: 3746 - DNA, 33 bp, Artificial Sequence
  Synthetic Construct
gcccaaatcctccccagcagcagccaagcacag

SEQ ID NO: 3747 - DNA, 33 bp, Artificial Sequence
  Synthetic Construct
gcccaagtcagccaaaccaccagcagcgcacag

SEQ ID NO: 3748 - DNA, 33 bp, Artificial Sequence
  Synthetic Construct
gcccaaacgattcatctgcataaggatgcacag

SEQ ID NO: 3749 - DNA, 33 bp, Artificial Sequence
  Synthetic Construct
gcccaagtcaccgacagagtcggcaacgcacag

SEQ ID NO: 3750 - DNA, 33 bp, Artificial Sequence
  Synthetic Construct
gcccaactgcctgctcgggctgctaatgcacag

SEQ ID NO: 3751 - DNA, 33 bp, Artificial Sequence
  Synthetic Construct
gcccaacacacccaaagcatgaccgtcgcacag

SEQ ID NO: 3752 - DNA, 33 bp, Artificial Sequence
  Synthetic Construct
gcccaactcctcaacagcagccaactcgcacag

SEQ ID NO: 3753 - DNA, 33 bp, Artificial Sequence
  Synthetic Construct
gcccaaagaaacagcgaactcagagccgcacag

SEQ ID NO: 3754 - DNA, 33 bp, Artificial Sequence
  Synthetic Construct
gcccaacagaagtctccgaatggtctggcacag

SEQ ID NO: 3755 - DNA, 33 bp, Artificial Sequence
  Synthetic Construct
gcccaaaaaagcggcgaccacctcaccgcacag

SEQ ID NO: 3756 - DNA, 33 bp, Artificial Sequence
  Synthetic Construct
gcccaagggaatcggactacgagtagtgcacag

SEQ ID NO: 3757 - DNA, 33 bp, Artificial Sequence
  Synthetic Construct
gcccaaatggtcgccctcaccgtcggcgcacag

SEQ ID NO: 3758 - DNA, 33 bp, Artificial Sequence
  Synthetic Construct
gcccaactcagcagcaacagccccagagcacag

SEQ ID NO: 3759 - DNA, 33 bp, Artificial Sequence
  Synthetic Construct
gcccaagcttcgaataatcagacgtatgcacag

SEQ ID NO: 3760 - DNA, 33 bp, Artificial Sequence
  Synthetic Construct
gcccaaaacaacatcgtcaccaccagcgcacag

SEQ ID NO: 3761 - DNA, 33 bp, Artificial Sequence
  Synthetic Construct
gcccaacacgacaccaaaaaacccatggcacag

SEQ ID NO: 3762 - DNA, 33 bp, Artificial Sequence
  Synthetic Construct
gcccaaattaatacggctagttataaggcacag

SEQ ID NO: 3763 - DNA, 33 bp, Artificial Sequence
  Synthetic Construct
gcccaaagtggtatggttagtatgtcggcacag

SEQ ID NO: 3764 - DNA, 33 bp, Artificial Sequence
  Synthetic Construct
gcccaactcgtcaccgccagcgccagagcacag

SEQ ID NO: 3765 - DNA, 33 bp, Artificial Sequence
  Synthetic Construct
gcccaaagcagagcccccagcgccatggcacag

SEQ ID NO: 3766 - DNA, 33 bp, Artificial Sequence
  Synthetic Construct
gcccaaaacaacaaccaaaaagtctacgcacag

SEQ ID NO: 3767 - DNA, 33 bp, Artificial Sequence
  Synthetic Construct
gcccaaactagtgtggttgctaatcctgcacag

SEQ ID NO: 3768 - DNA, 33 bp, Artificial Sequence
  Synthetic Construct
gcccaaggcaacgccggccccagcctcgcacag

SEQ ID NO: 3769 - DNA, 33 bp, Artificial Sequence
  Synthetic Construct
gcccaatacagcaccagcctcgaactcgcacag

SEQ ID NO: 3770 - DNA, 33 bp, Artificial Sequence
  Synthetic Construct
gcccaaccgtctaatccgcctaaggaggcacag

SEQ ID NO: 3771 - DNA, 33 bp, Artificial Sequence
  Synthetic Construct
gcccaaactaattctaagccttcgtgggcacag

SEQ ID NO: 3772 - DNA, 33 bp, Artificial Sequence
  Synthetic Construct
gcccaatcgattgatcggcagcagcttgcacag

SEQ ID NO: 3773 - DNA, 33 bp, Artificial Sequence
  Synthetic Construct
gcccaaaacaaagccggccccgccagcgcacag

SEQ ID NO: 3774 - DNA, 33 bp, Artificial Sequence
  Synthetic Construct
gcccaaagcatgaccaccaacagaagcgcacag

SEQ ID NO: 3775 - DNA, 33 bp, Artificial Sequence
  Synthetic Construct
gcccaaggcaacagcgccgtccaactcgcacag

SEQ ID NO: 3776 - DNA, 33 bp, Artificial Sequence
  Synthetic Construct
gcccaaagaagcagcgacgtcaacaccgcacag

SEQ ID NO: 3777 - DNA, 33 bp, Artificial Sequence
  Synthetic Construct
gcccaacacaacggcgtccaaagcgtcgcacag

SEQ ID NO: 3778 - DNA, 33 bp, Artificial Sequence
  Synthetic Construct
gcccaagaaaaagaccacggcatggccgcacag

SEQ ID NO: 3779 - DNA, 33 bp, Artificial Sequence
  Synthetic Construct
gcccaatacagactccccgacggcagagcacag

SEQ ID NO: 3780 - DNA, 33 bp, Artificial Sequence
  Synthetic Construct
gcccaaagcagcagagaactcagactcgcacag

SEQ ID NO: 3781 - DNA, 33 bp, Artificial Sequence
  Synthetic Construct
gcccaaaaccaagtcgaaagcagagtcgcacag

SEQ ID NO: 3782 - DNA, 33 bp, Artificial Sequence
  Synthetic Construct
gcccaagccctccacagcgtccccaaagcacag

SEQ ID NO: 3783 - DNA, 33 bp, Artificial Sequence
  Synthetic Construct
gcccaaactggtcctagtacggtgccggcacag

SEQ ID NO: 3784 - DNA, 33 bp, Artificial Sequence
  Synthetic Construct
gcccaagaacccctcggcgtccaccccgcacag

SEQ ID NO: 3785 - DNA, 33 bp, Artificial Sequence
  Synthetic Construct
gcccaaaccagaaccgacaccaccaacgcacag

SEQ ID NO: 3786 - DNA, 33 bp, Artificial Sequence
  Synthetic Construct
gcccaaagccacaacctcaccgccgacgcacag

SEQ ID NO: 3787 - DNA, 33 bp, Artificial Sequence
  Synthetic Construct
gcccaaaacgtcagaagagacgacaccgcacag

SEQ ID NO: 3788 - DNA, 33 bp, Artificial Sequence
  Synthetic Construct
gcccaattcgccgccaacctcgtcgccgcacag

SEQ ID NO: 3789 - DNA, 33 bp, Artificial Sequence
  Synthetic Construct
gcccaaatcggcgcccaagccagaatggcacag

SEQ ID NO: 3790 - DNA, 33 bp, Artificial Sequence
  Synthetic Construct
gcccaaaattctatgtctaaggcttatgcacag

SEQ ID NO: 3791 - DNA, 33 bp, Artificial Sequence
  Synthetic Construct
gcccaaaacgtcaacaaagacagagtcgcacag

SEQ ID NO: 3792 - DNA, 33 bp, Artificial Sequence
  Synthetic Construct
gcccaatcttttcagggttcggctagggcacag

SEQ ID NO: 3793 - DNA, 33 bp, Artificial Sequence
  Synthetic Construct
gcccaagccaacagcgaccacatccacgcacag

SEQ ID NO: 3794 - DNA, 33 bp, Artificial Sequence
  Synthetic Construct
gcccaagtcagcctcgccagcaaaagcgcacag

SEQ ID NO: 3795 - DNA, 33 bp, Artificial Sequence
  Synthetic Construct
gcccaacccaaagacagagccaccagcgcacag

SEQ ID NO: 3796 - DNA, 33 bp, Artificial Sequence
  Synthetic Construct
gcccaagttcggtcgcagagtgattcggcacag

SEQ ID NO: 3797 - DNA, 33 bp, Artificial Sequence
  Synthetic Construct
gcccaacttggtaattcggtgtttaaggcacag

SEQ ID NO: 3798 - DNA, 33 bp, Artificial Sequence
  Synthetic Construct
gcccaaagcaccaaagaaagccccaaagcacag

SEQ ID NO: 3799 - DNA, 33 bp, Artificial Sequence
  Synthetic Construct
gcccaactccaacccaccaccttcagcgcacag

SEQ ID NO: 3800 - DNA, 33 bp, Artificial Sequence
  Synthetic Construct
gcccaacccatgcacaccgccatggtcgcacag

SEQ ID NO: 3801 - DNA, 33 bp, Artificial Sequence
  Synthetic Construct
gcccaagtgtttgctcatactggtcttgcacag

SEQ ID NO: 3802 - DNA, 33 bp, Artificial Sequence
  Synthetic Construct
gcccaacaaaaagccaccagcatccacgcacag

SEQ ID NO: 3803 - DNA, 33 bp, Artificial Sequence
  Synthetic Construct
gcccaaggttctaagtcggataatctggcacag

SEQ ID NO: 3804 - DNA, 33 bp, Artificial Sequence
  Synthetic Construct
gcccaaagcggcaccaacgtcgtcagcgcacag

SEQ ID NO: 3805 - DNA, 33 bp, Artificial Sequence
  Synthetic Construct
gcccaaaccaaactcaccaccctcagcgcacag

SEQ ID NO: 3806 - DNA, 33 bp, Artificial Sequence
  Synthetic Construct
gcccaacccatcctccacaaccaaatcgcacag

SEQ ID NO: 3807 - DNA, 33 bp, Artificial Sequence
  Synthetic Construct
gcccaagtcaccaaccccatcaaacccgcacag

SEQ ID NO: 3808 - DNA, 33 bp, Artificial Sequence
  Synthetic Construct
gcccaaaccaacgccctccacatgaaagcacag

SEQ ID NO: 3809 - DNA, 33 bp, Artificial Sequence
  Synthetic Construct
gcccaagtcgcccacgcctaccccgccgcacag

SEQ ID NO: 3810 - DNA, 33 bp, Artificial Sequence
  Synthetic Construct
gcccaagctgagcatggtcttggtcctgcacag

SEQ ID NO: 3811 - DNA, 33 bp, Artificial Sequence
  Synthetic Construct
gcccaaatgaacaaatacagccccgccgcacag

SEQ ID NO: 3812 - DNA, 33 bp, Artificial Sequence
  Synthetic Construct
gcccaaaccatgcaagacagactcaccgcacag

SEQ ID NO: 3813 - DNA, 33 bp, Artificial Sequence
  Synthetic Construct
gcccaaggcgtcaaaatcctcaacagcgcacag

SEQ ID NO: 3814 - DNA, 33 bp, Artificial Sequence
  Synthetic Construct
gcccaagcgcagaataagatgacgagtgcacag

SEQ ID NO: 3815 - DNA, 33 bp, Artificial Sequence
  Synthetic Construct
gcccaaaccagcgccctcaccgacatcgcacag

SEQ ID NO: 3816 - DNA, 33 bp, Artificial Sequence
  Synthetic Construct
gcccaagacctcagacacgccgacatcgcacag

SEQ ID NO: 3817 - DNA, 33 bp, Artificial Sequence
  Synthetic Construct
gcccaacagaataaggcgttgacggtggcacag

SEQ ID NO: 3818 - DNA, 33 bp, Artificial Sequence
  Synthetic Construct
gcccaaactcaggggattacgattgtggcacag

SEQ ID NO: 3819 - DNA, 33 bp, Artificial Sequence
  Synthetic Construct
gcccaaacggcgactattctgtcgggggcacag

SEQ ID NO: 3820 - DNA, 33 bp, Artificial Sequence
  Synthetic Construct
gcccaatttgcggcgagtaatatttctgcacag

SEQ ID NO: 3821 - DNA, 33 bp, Artificial Sequence
  Synthetic Construct
gcccaacgtaatactatggagactatggcacag

SEQ ID NO: 3822 - DNA, 33 bp, Artificial Sequence
  Synthetic Construct
gcccaaagttctggtactagttatagtgcacag

SEQ ID NO: 3823 - DNA, 33 bp, Artificial Sequence
  Synthetic Construct
gcccaagccaaccacggcctcaacgccgcacag

SEQ ID NO: 3824 - DNA, 33 bp, Artificial Sequence
  Synthetic Construct
gcccaaatgctgtcgaattcgcgtagtgcacag

SEQ ID NO: 3825 - DNA, 33 bp, Artificial Sequence
  Synthetic Construct
gcccaagctgcgattcatgcgacgcctgcacag

SEQ ID NO: 3826 - DNA, 33 bp, Artificial Sequence
  Synthetic Construct
gcccaatggcagtcgtttgcgtcggcggcacag

SEQ ID NO: 3827 - DNA, 33 bp, Artificial Sequence
  Synthetic Construct
gcccaaatgggtgggaattcgagtacggcacag

SEQ ID NO: 3828 - DNA, 33 bp, Artificial Sequence
  Synthetic Construct
gcccaaaagacggatttggcgcagcatgcacag

SEQ ID NO: 3829 - DNA, 33 bp, Artificial Sequence
  Synthetic Construct
gcccaagtcaacaccaccagattcagcgcacag

SEQ ID NO: 3830 - DNA, 33 bp, Artificial Sequence
  Synthetic Construct
gcccaaaatgtgcatgctcatcaggctgcacag

SEQ ID NO: 3831 - DNA, 33 bp, Artificial Sequence
  Synthetic Construct
gcccaaggcgccatgagcatccaaaccgcacag

SEQ ID NO: 3832 - DNA, 33 bp, Artificial Sequence
  Synthetic Construct
gcccaagctcggggtccgacgattgttgcacag

SEQ ID NO: 3833 - DNA, 33 bp, Artificial Sequence
  Synthetic Construct
gcccaaacgatgcatagtaagtcggatgcacag

SEQ ID NO: 3834 - DNA, 33 bp, Artificial Sequence
  Synthetic Construct
gcccaaacggttacgcagactactcaggcacag

SEQ ID NO: 3835 - DNA, 33 bp, Artificial Sequence
  Synthetic Construct
gcccaaggcaacaccaacagcctcaccgcacag

SEQ ID NO: 3836 - DNA, 33 bp, Artificial Sequence
  Synthetic Construct
gcccaaagagtcatcgccagcgtcaacgcacag

SEQ ID NO: 3837 - DNA, 33 bp, Artificial Sequence
  Synthetic Construct
gcccaacccagcagcggcaacagcgaagcacag

SEQ ID NO: 3838 - DNA, 33 bp, Artificial Sequence
  Synthetic Construct
gcccaacagccgcatggttttacggctgcacag

SEQ ID NO: 3839 - DNA, 33 bp, Artificial Sequence
  Synthetic Construct
gcccaaaccaccggcaccaacatgagagcacag

SEQ ID NO: 3840 - DNA, 33 bp, Artificial Sequence
  Synthetic Construct
gcccaattcaccagactcgaagacagagcacag

SEQ ID NO: 3841 - DNA, 33 bp, Artificial Sequence
  Synthetic Construct
gcccaagacagaagccccgcccacaccgcacag

SEQ ID NO: 3842 - DNA, 33 bp, Artificial Sequence
  Synthetic Construct
gcccaacacgtccacaacaccgtccccgcacag

SEQ ID NO: 3843 - DNA, 33 bp, Artificial Sequence
  Synthetic Construct
gcccaaatgaacaccaccggcaccaaagcacag

SEQ ID NO: 3844 - DNA, 33 bp, Artificial Sequence
  Synthetic Construct
gcccaattcgccacccaaaccatcgccgcacag

SEQ ID NO: 3845 - DNA, 33 bp, Artificial Sequence
  Synthetic Construct
gcccaagtcagcggcaacatccccgtcgcacag

SEQ ID NO: 3846 - DNA, 33 bp, Artificial Sequence
  Synthetic Construct
gcccaagacggcagaaacatcgcccccgcacag

SEQ ID NO: 3847 - DNA, 33 bp, Artificial Sequence
  Synthetic Construct
gcccaaatgctccccaccgtcaacagagcacag

SEQ ID NO: 3848 - DNA, 33 bp, Artificial Sequence
  Synthetic Construct
gcccaacctactactaatgtgcttggtgcacag

SEQ ID NO: 3849 - DNA, 33 bp, Artificial Sequence
  Synthetic Construct
gcccaacgggagatgcatggtactcttgcacag

SEQ ID NO: 3850 - DNA, 33 bp, Artificial Sequence
  Synthetic Construct
gcccaatctccgtattcgactcgtccggcacag

SEQ ID NO: 3851 - DNA, 33 bp, Artificial Sequence
  Synthetic Construct
gcccaatacaacatgaacaccgaaatggcacag

SEQ ID NO: 3852 - DNA, 33 bp, Artificial Sequence
  Synthetic Construct
gcccaaggggcgcgtatgggtcattcggcacag

SEQ ID NO: 3853 - DNA, 33 bp, Artificial Sequence
  Synthetic Construct
gcccaattcagccccggctacgtccccgcacag

SEQ ID NO: 3854 - DNA, 33 bp, Artificial Sequence
  Synthetic Construct
gcccaacagcagcatattcctccttctgcacag

SEQ ID NO: 3855 - DNA, 33 bp, Artificial Sequence
  Synthetic Construct
gcccaactcagcaccagcctcagccccgcacag

SEQ ID NO: 3856 - DNA, 33 bp, Artificial Sequence
  Synthetic Construct
gcccaagttaatgggattaaggagtatgcacag

SEQ ID NO: 3857 - DNA, 33 bp, Artificial Sequence
  Synthetic Construct
gcccaaggtgtgcggactgagccgatggcacag

SEQ ID NO: 3858 - DNA, 33 bp, Artificial Sequence
  Synthetic Construct
gcccaaagaaacaacgacagcctcaccgcacag

SEQ ID NO: 3859 - DNA, 33 bp, Artificial Sequence
  Synthetic Construct
gcccaatttaatgcgtctcctaagttggcacag

SEQ ID NO: 3860 - DNA, 33 bp, Artificial Sequence
  Synthetic Construct
gcccaaggcctcaccaccagcaccaccgcacag

SEQ ID NO: 3861 - DNA, 33 bp, Artificial Sequence
  Synthetic Construct
gcccaaatgatcagaggcaccagcagcgcacag

SEQ ID NO: 3862 - DNA, 33 bp, Artificial Sequence
  Synthetic Construct
gcccaaactaagcttgtggctactgtggcacag

SEQ ID NO: 3863 - DNA, 33 bp, Artificial Sequence
  Synthetic Construct
gcccaagtgagtcggcagtttgagccggcacag

SEQ ID NO: 3864 - DNA, 33 bp, Artificial Sequence
  Synthetic Construct
gcccaaaatggtgatagtttgcgtcctgcacag

SEQ ID NO: 3865 - DNA, 33 bp, Artificial Sequence
  Synthetic Construct
gcccaaacccaaaacctcagcagccacgcacag

SEQ ID NO: 3866 - DNA, 33 bp, Artificial Sequence
  Synthetic Construct
gcccaaaccgtcaccggcagcctcgtcgcacag

SEQ ID NO: 3867 - DNA, 33 bp, Artificial Sequence
  Synthetic Construct
gcccaaggcagaggccccgaagcccaagcacag

SEQ ID NO: 3868 - DNA, 33 bp, Artificial Sequence
  Synthetic Construct
gcccaacccagaaacgtcggcctcgaagcacag

SEQ ID NO: 3869 - DNA, 33 bp, Artificial Sequence
  Synthetic Construct
gcccaattcaacagcagcatccccaccgcacag

SEQ ID NO: 3870 - DNA, 33 bp, Artificial Sequence
  Synthetic Construct
gcccaaggtaatcagcagcattcttctgcacag

SEQ ID NO: 3871 - DNA, 33 bp, Artificial Sequence
  Synthetic Construct
gcccaacccatcaccaacggcagcttcgcacag

SEQ ID NO: 3872 - DNA, 33 bp, Artificial Sequence
  Synthetic Construct
gcccaagttcagcgtactccgcttactgcacag

SEQ ID NO: 3873 - DNA, 33 bp, Artificial Sequence
  Synthetic Construct
gcccaaacgccttatgctggtagggctgcacag

SEQ ID NO: 3874 - DNA, 33 bp, Artificial Sequence
  Synthetic Construct
gcccaactggctctgtctaatcgtacggcacag

SEQ ID NO: 3875 - DNA, 33 bp, Artificial Sequence
  Synthetic Construct
gcccaaggtcagatggctactggtctggcacag

SEQ ID NO: 3876 - DNA, 33 bp, Artificial Sequence
  Synthetic Construct
gcccaatctaatcctgcgactactactgcacag

SEQ ID NO: 3877 - DNA, 33 bp, Artificial Sequence
  Synthetic Construct
gcccaagggcggactactagtgatagtgcacag

SEQ ID NO: 3878 - DNA, 33 bp, Artificial Sequence
  Synthetic Construct
gcccaaagcagactcaccagcctcggcgcacag

SEQ ID NO: 3879 - DNA, 33 bp, Artificial Sequence
  Synthetic Construct
gcccaacatctttctacgccggatttggcacag

SEQ ID NO: 3880 - DNA, 33 bp, Artificial Sequence
  Synthetic Construct
gcccaaatgcctcatgctccgacttcggcacag

SEQ ID NO: 3881 - DNA, 33 bp, Artificial Sequence
  Synthetic Construct
gcccaagttgcgggtatgttgacgcatgcacag

SEQ ID NO: 3882 - DNA, 33 bp, Artificial Sequence
  Synthetic Construct
gcccaagtcgccagccaaaaactcaacgcacag

SEQ ID NO: 3883 - DNA, 33 bp, Artificial Sequence
  Synthetic Construct
gcccaaacccaaagcatgaccagcagagcacag

SEQ ID NO: 3884 - DNA, 33 bp, Artificial Sequence
  Synthetic Construct
gcccaacccatcagcaccatgagcctcgcacag

SEQ ID NO: 3885 - DNA, 33 bp, Artificial Sequence
  Synthetic Construct
gcccaagcccaactcaacagcgccggcgcacag

SEQ ID NO: 3886 - DNA, 33 bp, Artificial Sequence
  Synthetic Construct
gcccaacacctccccaaatacgaacacgcacag

SEQ ID NO: 3887 - DNA, 33 bp, Artificial Sequence
  Synthetic Construct
gcccaaggggtgcaggctgttgtgggtgcacag

SEQ ID NO: 3888 - DNA, 33 bp, Artificial Sequence
  Synthetic Construct
gcccaaggcgacacccaatacgccagagcacag

SEQ ID NO: 3889 - DNA, 33 bp, Artificial Sequence
  Synthetic Construct
gcccaagccagccccctcgtcatgagcgcacag

SEQ ID NO: 3890 - DNA, 33 bp, Artificial Sequence
  Synthetic Construct
gcccaaagcaacgccggcatgagcaaagcacag

SEQ ID NO: 3891 - DNA, 33 bp, Artificial Sequence
  Synthetic Construct
gcccaaagaagcgtcagcgccgtccccgcacag

SEQ ID NO: 3892 - DNA, 33 bp, Artificial Sequence
  Synthetic Construct
gcccaacccagctaccacaaaagccccgcacag

SEQ ID NO: 3893 - DNA, 33 bp, Artificial Sequence
  Synthetic Construct
gcccaacatcagtttactagttctgcggcacag

SEQ ID NO: 3894 - DNA, 33 bp, Artificial Sequence
  Synthetic Construct
gcccaaaaccaaagccccatcggcgccgcacag

SEQ ID NO: 3895 - DNA, 33 bp, Artificial Sequence
  Synthetic Construct
gcccaaggtgcggctgggatgtcgcgggcacag

SEQ ID NO: 3896 - DNA, 33 bp, Artificial Sequence
  Synthetic Construct
gcccaaacggtgaagacgtatagtgcggcacag

SEQ ID NO: 3897 - DNA, 33 bp, Artificial Sequence
  Synthetic Construct
gcccaactcagcatgaccagccaaatggcacag

SEQ ID NO: 3898 - DNA, 33 bp, Artificial Sequence
  Synthetic Construct
gcccaaggcctcagccccaccttcggcgcacag

SEQ ID NO: 3899 - DNA, 33 bp, Artificial Sequence
  Synthetic Construct
gcccaaatggacaccgtcatgaaaggcgcacag

SEQ ID NO: 3900 - DNA, 33 bp, Artificial Sequence
  Synthetic Construct
gcccaacgtgataagatttctacgtatgcacag

SEQ ID NO: 3901 - DNA, 33 bp, Artificial Sequence
  Synthetic Construct
gcccaagacagcaacagctacgtcagagcacag

SEQ ID NO: 3902 - DNA, 33 bp, Artificial Sequence
  Synthetic Construct
gcccaaagcctcaaaagcagccccttcgcacag

SEQ ID NO: 3903 - DNA, 33 bp, Artificial Sequence
  Synthetic Construct
gcccaacttgatcgtactgcgaagcctgcacag

SEQ ID NO: 3904 - DNA, 33 bp, Artificial Sequence
  Synthetic Construct
gcccaaccgtcgagggctccggatcctgcacag

SEQ ID NO: 3905 - DNA, 33 bp, Artificial Sequence
  Synthetic Construct
gcccaatacctcaaccaaatcagaagcgcacag

SEQ ID NO: 3906 - DNA, 33 bp, Artificial Sequence
  Synthetic Construct
gcccaacaaaacagaagcgtcgtcgaagcacag

SEQ ID NO: 3907 - DNA, 33 bp, Artificial Sequence
  Synthetic Construct
gcccaacaggagtctatggttaagtatgcacag

SEQ ID NO: 3908 - DNA, 33 bp, Artificial Sequence
  Synthetic Construct
gcccaaaagctgtcgcaggagagtaatgcacag

SEQ ID NO: 3909 - DNA, 33 bp, Artificial Sequence
  Synthetic Construct
gcccaacgtggtactatggagcatgatgcacag

SEQ ID NO: 3910 - DNA, 33 bp, Artificial Sequence
  Synthetic Construct
gcccaacagtcgggtcctgggattgtggcacag

SEQ ID NO: 3911 - DNA, 33 bp, Artificial Sequence
  Synthetic Construct
gcccaactcaaccaaggcgacctcctcgcacag

SEQ ID NO: 3912 - DNA, 33 bp, Artificial Sequence
  Synthetic Construct
gcccaagccaaaaccatcggcagcaccgcacag

SEQ ID NO: 3913 - DNA, 33 bp, Artificial Sequence
  Synthetic Construct
gcccaagacagcggcaacagaaccagcgcacag

SEQ ID NO: 3914 - DNA, 33 bp, Artificial Sequence
  Synthetic Construct
gcccaactcagccacagcaccagcttcgcacag

SEQ ID NO: 3915 - DNA, 33 bp, Artificial Sequence
  Synthetic Construct
gcccaaggtgatttttcgtcgaagcaggcacag

SEQ ID NO: 3916 - DNA, 33 bp, Artificial Sequence
  Synthetic Construct
gcccaagatcatagtaatgcgtatcgtgcacag

SEQ ID NO: 3917 - DNA, 33 bp, Artificial Sequence
  Synthetic Construct
gcccaagttccgactgatcgtcctcgtgcacag

SEQ ID NO: 3918 - DNA, 33 bp, Artificial Sequence
  Synthetic Construct
gcccaaagcatgcaactcatcaacgaagcacag

SEQ ID NO: 3919 - DNA, 33 bp, Artificial Sequence
  Synthetic Construct
gcccaatacgccaacagcgtcggcctcgcacag

SEQ ID NO: 3920 - DNA, 33 bp, Artificial Sequence
  Synthetic Construct
gcccaagtctacctcgccagcggcggcgcacag

SEQ ID NO: 3921 - DNA, 33 bp, Artificial Sequence
  Synthetic Construct
gcccaactcatccccgtcaccagcgtcgcacag

SEQ ID NO: 3922 - DNA, 33 bp, Artificial Sequence
  Synthetic Construct
gcccaaggcaacatgaacagcagaaccgcacag

SEQ ID NO: 3923 - DNA, 33 bp, Artificial Sequence
  Synthetic Construct
gcccaaagccacaacgacagaagcctcgcacag

SEQ ID NO: 3924 - DNA, 33 bp, Artificial Sequence
  Synthetic Construct
gcccaacataggattcctacggctggggcacag

SEQ ID NO: 3925 - DNA, 33 bp, Artificial Sequence
  Synthetic Construct
gcccaaatgggcaaagactacacccacgcacag

SEQ ID NO: 3926 - DNA, 33 bp, Artificial Sequence
  Synthetic Construct
gcccaatctcatgcgagtactcctattgcacag

SEQ ID NO: 3927 - DNA, 33 bp, Artificial Sequence
  Synthetic Construct
gcccaactcaacagccaaaccagaagcgcacag

SEQ ID NO: 3928 - DNA, 33 bp, Artificial Sequence
  Synthetic Construct
gcccaacggacgctgagtgatagtgtggcacag

SEQ ID NO: 3929 - DNA, 33 bp, Artificial Sequence
  Synthetic Construct
gcccaacttacgactgctaagacgtttgcacag

SEQ ID NO: 3930 - DNA, 33 bp, Artificial Sequence
  Synthetic Construct
gcccaaagaatcgtcggcagcaccagcgcacag

SEQ ID NO: 3931 - DNA, 33 bp, Artificial Sequence
  Synthetic Construct
gcccaaaccaaaaccctcgccctccacgcacag

SEQ ID NO: 3932 - DNA, 33 bp, Artificial Sequence
  Synthetic Construct
gcccaatgggaagtccccgccagaaacgcacag

SEQ ID NO: 3933 - DNA, 33 bp, Artificial Sequence
  Synthetic Construct
gcccaaatttctaatccggcgattgctgcacag

SEQ ID NO: 3934 - DNA, 33 bp, Artificial Sequence
  Synthetic Construct
gcccaattgggggcttcgcagacttctgcacag

SEQ ID NO: 3935 - DNA, 33 bp, Artificial Sequence
  Synthetic Construct
gcccaactcagcacccacaacagcgtcgcacag

SEQ ID NO: 3936 - DNA, 33 bp, Artificial Sequence
  Synthetic Construct
gcccaaagacacaccgacatcgacaccgcacag

SEQ ID NO: 3937 - DNA, 33 bp, Artificial Sequence
  Synthetic Construct
gcccaagggaggccggttattgcggcggcacag

SEQ ID NO: 3938 - DNA, 33 bp, Artificial Sequence
  Synthetic Construct
gcccaagccaacctcagagacggcgtcgcacag

SEQ ID NO: 3939 - DNA, 33 bp, Artificial Sequence
  Synthetic Construct
gcccaagttcagtctccgtcgattacggcacag

SEQ ID NO: 3940 - DNA, 33 bp, Artificial Sequence
  Synthetic Construct
gcccaattcaccagcggcagccacctcgcacag

SEQ ID NO: 3941 - DNA, 33 bp, Artificial Sequence
  Synthetic Construct
gcccaacctcttcagcagtcgggtcatgcacag

SEQ ID NO: 3942 - DNA, 33 bp, Artificial Sequence
  Synthetic Construct
gcccaagccagagtcgccaccaccctcgcacag

SEQ ID NO: 3943 - DNA, 33 bp, Artificial Sequence
  Synthetic Construct
gcccaacccggcagacaaaacgacgccgcacag

SEQ ID NO: 3944 - DNA, 33 bp, Artificial Sequence
  Synthetic Construct
gcccaaaaatacagcagcaccgccatcgcacag

SEQ ID NO: 3945 - DNA, 33 bp, Artificial Sequence
  Synthetic Construct
gcccaacacagcacccactacatcgccgcacag

SEQ ID NO: 3946 - DNA, 33 bp, Artificial Sequence
  Synthetic Construct
gcccaacaacccctcaacgccctccccgcacag

SEQ ID NO: 3947 - DNA, 33 bp, Artificial Sequence
  Synthetic Construct
gcccaaaaaacccaagaaaccggcaacgcacag

SEQ ID NO: 3948 - DNA, 33 bp, Artificial Sequence
  Synthetic Construct
gcccaaagtgagttgtctcggcatgcggcacag

SEQ ID NO: 3949 - DNA, 33 bp, Artificial Sequence
  Synthetic Construct
gcccaaggccccaaaaccatcagcaccgcacag

SEQ ID NO: 3950 - DNA, 33 bp, Artificial Sequence
  Synthetic Construct
gcccaaagtcatagtattgtgaatccggcacag

SEQ ID NO: 3951 - DNA, 33 bp, Artificial Sequence
  Synthetic Construct
gcccaacattcgaatactgtgagttcggcacag

SEQ ID NO: 3952 - DNA, 33 bp, Artificial Sequence
  Synthetic Construct
gcccaagtcgccggcctcaccgtccaagcacag

SEQ ID NO: 3953 - DNA, 33 bp, Artificial Sequence
  Synthetic Construct
gcccaagccaaccccggcctcgccaacgcacag

SEQ ID NO: 3954 - DNA, 33 bp, Artificial Sequence
  Synthetic Construct
gcccaagccagcgtccaaatgaccctcgcacag

SEQ ID NO: 3955 - DNA, 33 bp, Artificial Sequence
  Synthetic Construct
gcccaactcgtcaccgcccaaggccccgcacag

SEQ ID NO: 3956 - DNA, 33 bp, Artificial Sequence
  Synthetic Construct
gcccaaactacgcgttatacttcgccggcacag

SEQ ID NO: 3957 - DNA, 33 bp, Artificial Sequence
  Synthetic Construct
gcccaaatggacaccgacaaacccagagcacag

SEQ ID NO: 3958 - DNA, 33 bp, Artificial Sequence
  Synthetic Construct
gcccaaggcaccagcgtccaagacagagcacag

SEQ ID NO: 3959 - DNA, 33 bp, Artificial Sequence
  Synthetic Construct
gcccaaagagccagcccccaacaatacgcacag

SEQ ID NO: 3960 - DNA, 33 bp, Artificial Sequence
  Synthetic Construct
gcccaagtcagcagcgaacacagaatcgcacag

SEQ ID NO: 3961 - DNA, 33 bp, Artificial Sequence
  Synthetic Construct
gcccaaagcaacatgaaaatccaacccgcacag

SEQ ID NO: 3962 - DNA, 33 bp, Artificial Sequence
  Synthetic Construct
gcccaaaacctcagaatcgaacccatggcacag

SEQ ID NO: 3963 - DNA, 33 bp, Artificial Sequence
  Synthetic Construct
gcccaacccaccgaaagcctcagagtcgcacag

SEQ ID NO: 3964 - DNA, 33 bp, Artificial Sequence
  Synthetic Construct
gcccaaactaataggggtcttgctcttgcacag

SEQ ID NO: 3965 - DNA, 33 bp, Artificial Sequence
  Synthetic Construct
gcccaacatgagaagacggcgtatattgcacag

SEQ ID NO: 3966 - DNA, 33 bp, Artificial Sequence
  Synthetic Construct
gcccaaaatgttatttctaagaatttggcacag

SEQ ID NO: 3967 - DNA, 33 bp, Artificial Sequence
  Synthetic Construct
gcccaagggacggcggggttttcgtcggcacag

SEQ ID NO: 3968 - DNA, 33 bp, Artificial Sequence
  Synthetic Construct
gcccaaattgcgcagatgggggttaaggcacag

SEQ ID NO: 3969 - DNA, 33 bp, Artificial Sequence
  Synthetic Construct
gcccaaacttctaaggatgtgaaggatgcacag

SEQ ID NO: 3970 - DNA, 33 bp, Artificial Sequence
  Synthetic Construct
gcccaaatcatcggcgccagagacatcgcacag

SEQ ID NO: 3971 - DNA, 33 bp, Artificial Sequence
  Synthetic Construct
gcccaacttagggatacgggtcttggggcacag

SEQ ID NO: 3972 - DNA, 33 bp, Artificial Sequence
  Synthetic Construct
gcccaactcagcaacagcctcggccaagcacag

SEQ ID NO: 3973 - DNA, 33 bp, Artificial Sequence
  Synthetic Construct
gcccaaaacgtcctcaacagcagaggcgcacag

SEQ ID NO: 3974 - DNA, 33 bp, Artificial Sequence
  Synthetic Construct
gcccaatttaggggtagtggtagtccggcacag

SEQ ID NO: 3975 - DNA, 33 bp, Artificial Sequence
  Synthetic Construct
gcccaaaatccggagttgccgcgtcaggcacag

SEQ ID NO: 3976 - DNA, 33 bp, Artificial Sequence
  Synthetic Construct
gcccaaacgtctagttcgtttaaggaggcacag

SEQ ID NO: 3977 - DNA, 33 bp, Artificial Sequence
  Synthetic Construct
gcccaaaacagagaatacatgacccacgcacag

SEQ ID NO: 3978 - DNA, 33 bp, Artificial Sequence
  Synthetic Construct
gcccaaacgcctggtgttgcgcatcctgcacag

SEQ ID NO: 3979 - DNA, 33 bp, Artificial Sequence
  Synthetic Construct
gcccaaacgcagtcttcggaggggcctgcacag

SEQ ID NO: 3980 - DNA, 33 bp, Artificial Sequence
  Synthetic Construct
gcccaaaggggtgagccgattgtgtcggcacag

SEQ ID NO: 3981 - DNA, 33 bp, Artificial Sequence
  Synthetic Construct
gcccaatcgcttacgtctctgaattctgcacag

SEQ ID NO: 3982 - DNA, 33 bp, Artificial Sequence
  Synthetic Construct
gcccaaacggtgttgcatacgaggcaggcacag

SEQ ID NO: 3983 - DNA, 33 bp, Artificial Sequence
  Synthetic Construct
gcccaattgtcgaagtcgggtgcggatgcacag

SEQ ID NO: 3984 - DNA, 33 bp, Artificial Sequence
  Synthetic Construct
gcccaagccaacggcaaccaaagcctcgcacag

SEQ ID NO: 3985 - DNA, 33 bp, Artificial Sequence
  Synthetic Construct
gcccaattcgtcaccagcagcagcggcgcacag

SEQ ID NO: 3986 - DNA, 33 bp, Artificial Sequence
  Synthetic Construct
gcccaaggtgcgaataatcatacgcgtgcacag

SEQ ID NO: 3987 - DNA, 33 bp, Artificial Sequence
  Synthetic Construct
gcccaacacgccagcgacgtcaacaacgcacag

SEQ ID NO: 3988 - DNA, 33 bp, Artificial Sequence
  Synthetic Construct
gcccaaggccaccacaccagcgaccccgcacag

SEQ ID NO: 3989 - DNA, 33 bp, Artificial Sequence
  Synthetic Construct
gcccaagacaaaaaccccggcgtccacgcacag

SEQ ID NO: 3990 - DNA, 33 bp, Artificial Sequence
  Synthetic Construct
gcccaatcgaggaattcgcatattgaggcacag

SEQ ID NO: 3991 - DNA, 33 bp, Artificial Sequence
  Synthetic Construct
gcccaacaggcgagttctgatcatgttgcacag

SEQ ID NO: 3992 - DNA, 33 bp, Artificial Sequence
  Synthetic Construct
gcccaactcagagacaccccctacaacgcacag

SEQ ID NO: 3993 - DNA, 33 bp, Artificial Sequence
  Synthetic Construct
gcccaaagtttggctgcgacgagggatgcacag

SEQ ID NO: 3994 - DNA, 33 bp, Artificial Sequence
  Synthetic Construct
gcccaaggccacgtcaacaacgccgtcgcacag

SEQ ID NO: 3995 - DNA, 33 bp, Artificial Sequence
  Synthetic Construct
gcccaaattggtgggcttacgacgcgggcacag

SEQ ID NO: 3996 - DNA, 33 bp, Artificial Sequence
  Synthetic Construct
gcccaaagcaaagaaagaaacggccaagcacag

SEQ ID NO: 3997 - DNA, 33 bp, Artificial Sequence
  Synthetic Construct
gcccaattgaatagtggttcttctgctgcacag

SEQ ID NO: 3998 - DNA, 33 bp, Artificial Sequence
  Synthetic Construct
gcccaaaccatgagcaccacctacgaagcacag

SEQ ID NO: 3999 - DNA, 33 bp, Artificial Sequence
  Synthetic Construct
gcccaaggcgccgacaacagaatcagcgcacag

SEQ ID NO: 4000 - DNA, 33 bp, Artificial Sequence
  Synthetic Construct
gcccaaacccaaaacaacggcgacgtcgcacag

SEQ ID NO: 4001 - DNA, 33 bp, Artificial Sequence
  Synthetic Construct
gcccaaaatggtccgtctgtgctgagtgcacag

SEQ ID NO: 4002 - DNA, 33 bp, Artificial Sequence
  Synthetic Construct
gcccaaacggctcttcgggatgtgggtgcacag

SEQ ID NO: 4003 - DNA, 33 bp, Artificial Sequence
  Synthetic Construct
gcccaaaggactatggggacgactatggcacag

SEQ ID NO: 4004 - DNA, 33 bp, Artificial Sequence
  Synthetic Construct
gcccaaacgaggggtacgactgtggaggcacag

SEQ ID NO: 4005 - DNA, 33 bp, Artificial Sequence
  Synthetic Construct
gcccaaaccgtcagcagagtccaagtcgcacag

SEQ ID NO: 4006 - DNA, 33 bp, Artificial Sequence
  Synthetic Construct
gcccaaaggctggatactagtgcggatgcacag

SEQ ID NO: 4007 - DNA, 33 bp, Artificial Sequence
  Synthetic Construct
gcccaactcatgaccaaaggcctcgtcgcacag

SEQ ID NO: 4008 - DNA, 33 bp, Artificial Sequence
  Synthetic Construct
gcccaacccatgagaatgcaaaccgccgcacag

SEQ ID NO: 4009 - DNA, 33 bp, Artificial Sequence
  Synthetic Construct
gcccaagtggtgctggggagtacttctgcacag

SEQ ID NO: 4010 - DNA, 33 bp, Artificial Sequence
  Synthetic Construct
gcccaatctaataatgggaatggtcatgcacag

SEQ ID NO: 4011 - DNA, 33 bp, Artificial Sequence
  Synthetic Construct
gcccaaagaggccccgacctcctcaacgcacag

SEQ ID NO: 4012 - DNA, 33 bp, Artificial Sequence
  Synthetic Construct
gcccaaggttttaatagtatgaagcctgcacag

SEQ ID NO: 4013 - DNA, 33 bp, Artificial Sequence
  Synthetic Construct
gcccaactcaacagcaaccccatgaacgcacag

SEQ ID NO: 4014 - DNA, 33 bp, Artificial Sequence
  Synthetic Construct
gcccaactcagcaacagagtccaaagcgcacag

SEQ ID NO: 4015 - DNA, 33 bp, Artificial Sequence
  Synthetic Construct
gcccaaagcagaatggaaggcaccgtcgcacag

SEQ ID NO: 4016 - DNA, 33 bp, Artificial Sequence
  Synthetic Construct
gcccaaagcgaacaatacgtcagagtcgcacag

SEQ ID NO: 4017 - DNA, 33 bp, Artificial Sequence
  Synthetic Construct
gcccaaagtaatcttgcgaatcagcctgcacag

SEQ ID NO: 4018 - DNA, 33 bp, Artificial Sequence
  Synthetic Construct
gcccaagtgagtatgcagaggccgacggcacag

SEQ ID NO: 4019 - DNA, 33 bp, Artificial Sequence
  Synthetic Construct
gcccaatttcatggtcagggtatgtctgcacag

SEQ ID NO: 4020 - DNA, 33 bp, Artificial Sequence
  Synthetic Construct
gcccaaaccggcgccatcaacgcccccgcacag

SEQ ID NO: 4021 - DNA, 33 bp, Artificial Sequence
  Synthetic Construct
gcccaaacgctgtttaagaatggtcctgcacag

SEQ ID NO: 4022 - DNA, 33 bp, Artificial Sequence
  Synthetic Construct
gcccaagtggtgcctatttcgacgaatgcacag

SEQ ID NO: 4023 - DNA, 33 bp, Artificial Sequence
  Synthetic Construct
gcccaagccaaaggcaccgccctcgtcgcacag

SEQ ID NO: 4024 - DNA, 33 bp, Artificial Sequence
  Synthetic Construct
gcccaaagggatactgtgcaggtgtatgcacag

SEQ ID NO: 4025 - DNA, 33 bp, Artificial Sequence
  Synthetic Construct
gcccaactcggcaccaaagccacccacgcacag

SEQ ID NO: 4026 - DNA, 33 bp, Artificial Sequence
  Synthetic Construct
gcccaagacaacgtcagagtcaccgccgcacag

SEQ ID NO: 4027 - DNA, 33 bp, Artificial Sequence
  Synthetic Construct
gcccaaacgaggcctgggtcgcatactgcacag

SEQ ID NO: 4028 - DNA, 33 bp, Artificial Sequence
  Synthetic Construct
gcccaagctcagttggctcctcgtgcggcacag

SEQ ID NO: 4029 - DNA, 33 bp, Artificial Sequence
  Synthetic Construct
gcccaatctactatgcggacgtcgctggcacag

SEQ ID NO: 4030 - DNA, 33 bp, Artificial Sequence
  Synthetic Construct
gcccaaatgaatcagacttctgctaaggcacag

SEQ ID NO: 4031 - DNA, 33 bp, Artificial Sequence
  Synthetic Construct
gcccaaagcagaagcagccccaccatcgcacag

SEQ ID NO: 4032 - DNA, 33 bp, Artificial Sequence
  Synthetic Construct
gcccaaagcgccctcaaccaataccccgcacag

SEQ ID NO: 4033 - DNA, 33 bp, Artificial Sequence
  Synthetic Construct
gcccaaatcagcaccaccaccagaaacgcacag

SEQ ID NO: 4034 - DNA, 33 bp, Artificial Sequence
  Synthetic Construct
gcccaatctcgtgatacgccgagtggtgcacag

SEQ ID NO: 4035 - DNA, 33 bp, Artificial Sequence
  Synthetic Construct
gcccaaaacttcaacaaacaaggcctcgcacag

SEQ ID NO: 4036 - DNA, 33 bp, Artificial Sequence
  Synthetic Construct
gcccaacctagtaatacgtcttcggttgcacag

SEQ ID NO: 4037 - DNA, 33 bp, Artificial Sequence
  Synthetic Construct
gcccaaactgttagtacgaatgcgagggcacag

SEQ ID NO: 4038 - DNA, 33 bp, Artificial Sequence
  Synthetic Construct
gcccaaaacatgagccaaaccgtcgccgcacag

SEQ ID NO: 4039 - DNA, 33 bp, Artificial Sequence
  Synthetic Construct
gcccaaattgggaagagttctactcctgcacag

SEQ ID NO: 4040 - DNA, 33 bp, Artificial Sequence
  Synthetic Construct
gcccaaagagaaaccgaaaccggcagagcacag

SEQ ID NO: 4041 - DNA, 33 bp, Artificial Sequence
  Synthetic Construct
gcccaaccttatactccgctgactggtgcacag

SEQ ID NO: 4042 - DNA, 33 bp, Artificial Sequence
  Synthetic Construct
gcccaagccgaatacaacaccggcgtcgcacag

SEQ ID NO: 4043 - DNA, 33 bp, Artificial Sequence
  Synthetic Construct
gcccaaggcagaaacgccgaaaccagagcacag

SEQ ID NO: 4044 - DNA, 33 bp, Artificial Sequence
  Synthetic Construct
gcccaaacgtttaatcatactactgatgcacag

SEQ ID NO: 4045 - DNA, 33 bp, Artificial Sequence
  Synthetic Construct
gcccaaacccacctcagcaccctcggcgcacag

SEQ ID NO: 4046 - DNA, 33 bp, Artificial Sequence
  Synthetic Construct
gcccaacttaagggtattagtcagcatgcacag

SEQ ID NO: 4047 - DNA, 33 bp, Artificial Sequence
  Synthetic Construct
gcccaatattctagtggtatgactacggcacag

SEQ ID NO: 4048 - DNA, 33 bp, Artificial Sequence
  Synthetic Construct
gcccaaacggctattacgatgactagtgcacag

SEQ ID NO: 4049 - DNA, 33 bp, Artificial Sequence
  Synthetic Construct
gcccaaagaggcaacgaactcaacaccgcacag

SEQ ID NO: 4050 - DNA, 33 bp, Artificial Sequence
  Synthetic Construct
gcccaagtcgtcagcagccaaatggccgcacag

SEQ ID NO: 4051 - DNA, 33 bp, Artificial Sequence
  Synthetic Construct
gcccaacaccaacacgaaaacatggtcgcacag

SEQ ID NO: 4052 - DNA, 33 bp, Artificial Sequence
  Synthetic Construct
gcccaaagcttcggcggcgtccccaaagcacag

SEQ ID NO: 4053 - DNA, 33 bp, Artificial Sequence
  Synthetic Construct
gcccaattgatgcgtgatagtaagtctgcacag

SEQ ID NO: 4054 - DNA, 33 bp, Artificial Sequence
  Synthetic Construct
gcccaaatgagaaccaacctcagcatggcacag

SEQ ID NO: 4055 - DNA, 33 bp, Artificial Sequence
  Synthetic Construct
gcccaaccgaataatcctgtggtgcctgcacag

SEQ ID NO: 4056 - DNA, 33 bp, Artificial Sequence
  Synthetic Construct
gcccaaagggttagtcagtctatgggtgcacag

SEQ ID NO: 4057 - DNA, 33 bp, Artificial Sequence
  Synthetic Construct
gcccaagctgagggtcctcagaagacggcacag

SEQ ID NO: 4058 - DNA, 33 bp, Artificial Sequence
  Synthetic Construct
gcccaacttaattctgtggttcatacggcacag

SEQ ID NO: 4059 - DNA, 33 bp, Artificial Sequence
  Synthetic Construct
gcccaactgttgacgttgaattcggctgcacag

SEQ ID NO: 4060 - DNA, 33 bp, Artificial Sequence
  Synthetic Construct
gcccaaacgcttgctcctcggagggatgcacag

SEQ ID NO: 4061 - DNA, 33 bp, Artificial Sequence
  Synthetic Construct
gcccaaagagtcgccaaccccgccaccgcacag

SEQ ID NO: 4062 - DNA, 33 bp, Artificial Sequence
  Synthetic Construct
gcccaattgccggatcctaggttgcaggcacag

SEQ ID NO: 4063 - DNA, 33 bp, Artificial Sequence
  Synthetic Construct
gcccaaaaaatggacgtcggcgaagccgcacag

SEQ ID NO: 4064 - DNA, 33 bp, Artificial Sequence
  Synthetic Construct
gcccaaggtccgtctcctatggttatggcacag

SEQ ID NO: 4065 - DNA, 33 bp, Artificial Sequence
  Synthetic Construct
gcccaaggcaccaacaaagccaccgccgcacag

SEQ ID NO: 4066 - DNA, 33 bp, Artificial Sequence
  Synthetic Construct
gcccaactcagcgcccacggcaccaccgcacag

SEQ ID NO: 4067 - DNA, 33 bp, Artificial Sequence
  Synthetic Construct
gcccaaaccagcagatacaacagcgccgcacag

SEQ ID NO: 4068 - DNA, 33 bp, Artificial Sequence
  Synthetic Construct
gcccaaggccccaacagcagcttcaaagcacag

SEQ ID NO: 4069 - DNA, 33 bp, Artificial Sequence
  Synthetic Construct
gcccaaagtgttgggagggctccgattgcacag

SEQ ID NO: 4070 - DNA, 33 bp, Artificial Sequence
  Synthetic Construct
gcccaatttcagggtgagaagacgtgggcacag

SEQ ID NO: 4071 - DNA, 33 bp, Artificial Sequence
  Synthetic Construct
gcccaaaccagcagcgccagaaccatcgcacag

SEQ ID NO: 4072 - DNA, 33 bp, Artificial Sequence
  Synthetic Construct
gcccaagctgagcgtactgggactgcggcacag

SEQ ID NO: 4073 - DNA, 33 bp, Artificial Sequence
  Synthetic Construct
gcccaactcaacctcggcacccccaaagcacag

SEQ ID NO: 4074 - DNA, 33 bp, Artificial Sequence
  Synthetic Construct
gcccaagctgcgccggttgggtctagggcacag

SEQ ID NO: 4075 - DNA, 33 bp, Artificial Sequence
  Synthetic Construct
gcccaaatgagacaagccaaccaccccgcacag

SEQ ID NO: 4076 - DNA, 33 bp, Artificial Sequence
  Synthetic Construct
gcccaagagcagcagcgtgatgtgctggcacag

SEQ ID NO: 4077 - DNA, 33 bp, Artificial Sequence
  Synthetic Construct
gcccaacccaaaagcgacgaactcaccgcacag

SEQ ID NO: 4078 - DNA, 33 bp, Artificial Sequence
  Synthetic Construct
gcccaaaatgctcgtgttcaggagactgcacag

SEQ ID NO: 4079 - DNA, 33 bp, Artificial Sequence
  Synthetic Construct
gcccaaactacggttgctactcagtcggcacag

SEQ ID NO: 4080 - DNA, 33 bp, Artificial Sequence
  Synthetic Construct
gcccaaaccgaagtcagccacagacccgcacag

SEQ ID NO: 4081 - DNA, 33 bp, Artificial Sequence
  Synthetic Construct
gcccaaagcagcaccgtcaaaaacgtcgcacag

SEQ ID NO: 4082 - DNA, 33 bp, Artificial Sequence
  Synthetic Construct
gcccaaatcgacagccacctcaacagagcacag

SEQ ID NO: 4083 - DNA, 33 bp, Artificial Sequence
  Synthetic Construct
gcccaaggttcgactcagctgagtctggcacag

SEQ ID NO: 4084 - DNA, 33 bp, Artificial Sequence
  Synthetic Construct
gcccaagacggcagccccgccaccaaagcacag

SEQ ID NO: 4085 - DNA, 33 bp, Artificial Sequence
  Synthetic Construct
gcccaacaaaccggcaacagccaagccgcacag

SEQ ID NO: 4086 - DNA, 33 bp, Artificial Sequence
  Synthetic Construct
gcccaaagacaagacgtcaacgtcagcgcacag

SEQ ID NO: 4087 - DNA, 33 bp, Artificial Sequence
  Synthetic Construct
gcccaactcgactacggcgtcaaaagcgcacag

SEQ ID NO: 4088 - DNA, 33 bp, Artificial Sequence
  Synthetic Construct
gcccaaggttctcgtcctgaggcgccggcacag

SEQ ID NO: 4089 - DNA, 33 bp, Artificial Sequence
  Synthetic Construct
gcccaatggagcaacatgaccgccgccgcacag

SEQ ID NO: 4090 - DNA, 33 bp, Artificial Sequence
  Synthetic Construct
gcccaaactaatactactcggatttctgcacag

SEQ ID NO: 4091 - DNA, 33 bp, Artificial Sequence
  Synthetic Construct
gcccaaccttatgcggagaggcaggctgcacag

SEQ ID NO: 4092 - DNA, 33 bp, Artificial Sequence
  Synthetic Construct
gcccaaaccagcagcgccaccgtcctcgcacag

SEQ ID NO: 4093 - DNA, 33 bp, Artificial Sequence
  Synthetic Construct
gcccaagcgcagactgattttaggcaggcacag

SEQ ID NO: 4094 - DNA, 33 bp, Artificial Sequence
  Synthetic Construct
gcccaaaacagcggcaacgaacacagcgcacag

SEQ ID NO: 4095 - DNA, 33 bp, Artificial Sequence
  Synthetic Construct
gcccaaaagccgctgattaatgctactgcacag

SEQ ID NO: 4096 - DNA, 33 bp, Artificial Sequence
  Synthetic Construct
gcccaaatggggagttcgtcggcgtttgcacag

SEQ ID NO: 4097 - DNA, 33 bp, Artificial Sequence
  Synthetic Construct
gcccaaattggtaataagacgagtctggcacag

SEQ ID NO: 4098 - DNA, 33 bp, Artificial Sequence
  Synthetic Construct
gcccaagccgccaacaccgcccccaaagcacag

SEQ ID NO: 4099 - DNA, 33 bp, Artificial Sequence
  Synthetic Construct
gcccaactcgtcgaccaaagagccaccgcacag

SEQ ID NO: 4100 - DNA, 33 bp, Artificial Sequence
  Synthetic Construct
gcccaacaagtcaaactcggcagcaccgcacag

SEQ ID NO: 4101 - DNA, 33 bp, Artificial Sequence
  Synthetic Construct
gcccaactcaccagcaacacccacgtcgcacag

SEQ ID NO: 4102 - DNA, 33 bp, Artificial Sequence
  Synthetic Construct
gcccaagtctacagcgccatcaacaaagcacag

SEQ ID NO: 4103 - DNA, 33 bp, Artificial Sequence
  Synthetic Construct
gcccaaagagccaacggcagcgacctcgcacag

SEQ ID NO: 4104 - DNA, 33 bp, Artificial Sequence
  Synthetic Construct
gcccaaaacctcaaaagccaaaccgaagcacag

SEQ ID NO: 4105 - DNA, 33 bp, Artificial Sequence
  Synthetic Construct
gcccaaagctacggcaacgaaatcagagcacag

SEQ ID NO: 4106 - DNA, 33 bp, Artificial Sequence
  Synthetic Construct
gcccaactcaccagaggcgccatcggcgcacag

SEQ ID NO: 4107 - DNA, 33 bp, Artificial Sequence
  Synthetic Construct
gcccaacccatcagaaccgtcgacaccgcacag

SEQ ID NO: 4108 - DNA, 33 bp, Artificial Sequence
  Synthetic Construct
gcccaacggagtatgcctgatggttcggcacag

SEQ ID NO: 4109 - DNA, 33 bp, Artificial Sequence
  Synthetic Construct
gcccaaaccgcccacaccggccccctcgcacag

SEQ ID NO: 4110 - DNA, 33 bp, Artificial Sequence
  Synthetic Construct
gcccaatcgcaggggagtccgctttcggcacag

SEQ ID NO: 4111 - DNA, 33 bp, Artificial Sequence
  Synthetic Construct
gcccaactccaagccatcgcccacagcgcacag

SEQ ID NO: 4112 - DNA, 33 bp, Artificial Sequence
  Synthetic Construct
gcccaaggcaacagcctcagcaccagcgcacag

SEQ ID NO: 4113 - DNA, 33 bp, Artificial Sequence
  Synthetic Construct
gcccaactcacccacagagaagccgaagcacag

SEQ ID NO: 4114 - DNA, 33 bp, Artificial Sequence
  Synthetic Construct
gcccaaacgttgcatctggcgaaggaggcacag

SEQ ID NO: 4115 - DNA, 33 bp, Artificial Sequence
  Synthetic Construct
gcccaaaacatcagcagcagcggcaaagcacag

SEQ ID NO: 4116 - DNA, 33 bp, Artificial Sequence
  Synthetic Construct
gcccaaggcagacacatggtcatggaagcacag

SEQ ID NO: 4117 - DNA, 33 bp, Artificial Sequence
  Synthetic Construct
gcccaaggtgagaggtttggggggcctgcacag

SEQ ID NO: 4118 - DNA, 33 bp, Artificial Sequence
  Synthetic Construct
gcccaatatagtgggtcttctactaaggcacag

SEQ ID NO: 4119 - DNA, 33 bp, Artificial Sequence
  Synthetic Construct
gcccaaaaggagtctgttagtgcgaatgcacag

SEQ ID NO: 4120 - DNA, 33 bp, Artificial Sequence
  Synthetic Construct
gcccaaattacgagtgatgggaagccggcacag

SEQ ID NO: 4121 - DNA, 33 bp, Artificial Sequence
  Synthetic Construct
gcccaaggtcatgatgcgcgtgtggttgcacag

SEQ ID NO: 4122 - DNA, 33 bp, Artificial Sequence
  Synthetic Construct
gcccaaaccagcagcaacggcgtcagagcacag

SEQ ID NO: 4123 - DNA, 33 bp, Artificial Sequence
  Synthetic Construct
gcccaaaatcatcagaatcggtctttggcacag

SEQ ID NO: 4124 - DNA, 33 bp, Artificial Sequence
  Synthetic Construct
gcccaacgggttccggagcagaatgtggcacag

SEQ ID NO: 4125 - DNA, 33 bp, Artificial Sequence
  Synthetic Construct
gcccaaagcgcccaactcagaagcagcgcacag

SEQ ID NO: 4126 - DNA, 33 bp, Artificial Sequence
  Synthetic Construct
gcccaacacgccaaaagcgaaacctacgcacag

SEQ ID NO: 4127 - DNA, 33 bp, Artificial Sequence
  Synthetic Construct
gcccaactcctcacccaagtcgaaaccgcacag

SEQ ID NO: 4128 - DNA, 33 bp, Artificial Sequence
  Synthetic Construct
gcccaaaccaaaaccgccgacacctacgcacag

SEQ ID NO: 4129 - DNA, 33 bp, Artificial Sequence
  Synthetic Construct
gcccaagttatgcctgctacgttgagtgcacag

SEQ ID NO: 4130 - DNA, 33 bp, Artificial Sequence
  Synthetic Construct
gcccaataccaagccaacaacctcatcgcacag

SEQ ID NO: 4131 - DNA, 33 bp, Artificial Sequence
  Synthetic Construct
gcccaagtcagagtccccgacagcagcgcacag

SEQ ID NO: 4132 - DNA, 33 bp, Artificial Sequence
  Synthetic Construct
gcccaacaccaaaccggcagcggcttcgcacag

SEQ ID NO: 4133 - DNA, 33 bp, Artificial Sequence
  Synthetic Construct
gcccaaagtgctacgttgagtgggtatgcacag

SEQ ID NO: 4134 - DNA, 33 bp, Artificial Sequence
  Synthetic Construct
gcccaaaatggttctgcgacgtattctgcacag

SEQ ID NO: 4135 - DNA, 33 bp, Artificial Sequence
  Synthetic Construct
gcccaaagcaccagacccaccctcaccgcacag

SEQ ID NO: 4136 - DNA, 33 bp, Artificial Sequence
  Synthetic Construct
gcccaaagacccgccgacgtcagccaagcacag

SEQ ID NO: 4137 - DNA, 33 bp, Artificial Sequence
  Synthetic Construct
gcccaaagccacctcagcagcaccggcgcacag

SEQ ID NO: 4138 - DNA, 33 bp, Artificial Sequence
  Synthetic Construct
gcccaagctaatcagtcttatgatcgggcacag

SEQ ID NO: 4139 - DNA, 33 bp, Artificial Sequence
  Synthetic Construct
gcccaaagcagcggcgacagaaccgccgcacag

SEQ ID NO: 4140 - DNA, 33 bp, Artificial Sequence
  Synthetic Construct
gcccaaggcagcgtccccggcctcaacgcacag

SEQ ID NO: 4141 - DNA, 33 bp, Artificial Sequence
  Synthetic Construct
gcccaactcgtcaccatccacagcgccgcacag

SEQ ID NO: 4142 - DNA, 33 bp, Artificial Sequence
  Synthetic Construct
gcccaacctcagcatgagactacgctggcacag

SEQ ID NO: 4143 - DNA, 33 bp, Artificial Sequence
  Synthetic Construct
gcccaaccgacgaagtcggcgcagtatgcacag

SEQ ID NO: 4144 - DNA, 33 bp, Artificial Sequence
  Synthetic Construct
gcccaaaaaaaagaccccgtcctcggcgcacag

SEQ ID NO: 4145 - DNA, 33 bp, Artificial Sequence
  Synthetic Construct
gcccaatttagggttggtccgtctgctgcacag

SEQ ID NO: 4146 - DNA, 33 bp, Artificial Sequence
  Synthetic Construct
gcccaaaccagcagcggccacgccgtcgcacag

SEQ ID NO: 4147 - DNA, 33 bp, Artificial Sequence
  Synthetic Construct
gcccaacgtgttggtgaggctaggatggcacag

SEQ ID NO: 4148 - DNA, 33 bp, Artificial Sequence
  Synthetic Construct
gcccaacgtgttacgtcgccttctaaggcacag

SEQ ID NO: 4149 - DNA, 33 bp, Artificial Sequence
  Synthetic Construct
gcccaagataggatgccttctacgattgcacag

SEQ ID NO: 4150 - DNA, 33 bp, Artificial Sequence
  Synthetic Construct
gcccaacaaggcgacaccagcaaacacgcacag

SEQ ID NO: 4151 - DNA, 33 bp, Artificial Sequence
  Synthetic Construct
gcccaaagcaccagcagcaacagagccgcacag

SEQ ID NO: 4152 - DNA, 33 bp, Artificial Sequence
  Synthetic Construct
gcccaaaaggtgcctacgggttatacggcacag

SEQ ID NO: 4153 - DNA, 33 bp, Artificial Sequence
  Synthetic Construct
gcccaattcaaaggccaaagaaacgacgcacag

SEQ ID NO: 4154 - DNA, 33 bp, Artificial Sequence
  Synthetic Construct
gcccaaggtaatcatttggggaatgaggcacag

SEQ ID NO: 4155 - DNA, 33 bp, Artificial Sequence
  Synthetic Construct
gcccaagccagcaaaagcttcgaactcgcacag

SEQ ID NO: 4156 - DNA, 33 bp, Artificial Sequence
  Synthetic Construct
gcccaaaccgtcagagacaccaccagagcacag

SEQ ID NO: 4157 - DNA, 33 bp, Artificial Sequence
  Synthetic Construct
gcccaaaaggttagtccgaatactcttgcacag

SEQ ID NO: 4158 - DNA, 33 bp, Artificial Sequence
  Synthetic Construct
gcccaaggcagaacccccgaaagctacgcacag

SEQ ID NO: 4159 - DNA, 33 bp, Artificial Sequence
  Synthetic Construct
gcccaacaggtgtcgggggttaggacggcacag

SEQ ID NO: 4160 - DNA, 33 bp, Artificial Sequence
  Synthetic Construct
gcccaatacaccggcatcagcaccagcgcacag

SEQ ID NO: 4161 - DNA, 33 bp, Artificial Sequence
  Synthetic Construct
gcccaacaaaccgccgaaccccacaaagcacag

SEQ ID NO: 4162 - DNA, 33 bp, Artificial Sequence
  Synthetic Construct
gcccaacttggtcctgtgggttctccggcacag

SEQ ID NO: 4163 - DNA, 33 bp, Artificial Sequence
  Synthetic Construct
gcccaagccagagacgacagcaccgacgcacag

SEQ ID NO: 4164 - DNA, 33 bp, Artificial Sequence
  Synthetic Construct
gcccaaaattttaagcatagtgaggtggcacag

SEQ ID NO: 4165 - DNA, 33 bp, Artificial Sequence
  Synthetic Construct
gcccaaattactactcctctgcaggcggcacag

SEQ ID NO: 4166 - DNA, 33 bp, Artificial Sequence
  Synthetic Construct
gcccaacccatgagcagcagagaaagagcacag

SEQ ID NO: 4167 - DNA, 33 bp, Artificial Sequence
  Synthetic Construct
gcccaagtcgaaaacggcaaaggcctcgcacag

SEQ ID NO: 4168 - DNA, 33 bp, Artificial Sequence
  Synthetic Construct
gcccaaaccagcaacagcggcctcgccgcacag

SEQ ID NO: 4169 - DNA, 33 bp, Artificial Sequence
  Synthetic Construct
gcccaaggcaacagcctcgccaaccccgcacag

SEQ ID NO: 4170 - DNA, 33 bp, Artificial Sequence
  Synthetic Construct
gcccaagccagcaacgaagcccacgccgcacag

SEQ ID NO: 4171 - DNA, 33 bp, Artificial Sequence
  Synthetic Construct
gcccaaggcctcgccggcagcacccccgcacag

SEQ ID NO: 4172 - DNA, 33 bp, Artificial Sequence
  Synthetic Construct
gcccaagtccccgcccccggcagatacgcacag

SEQ ID NO: 4173 - DNA, 33 bp, Artificial Sequence
  Synthetic Construct
gcccaagccagcgacagactcatcgccgcacag

SEQ ID NO: 4174 - DNA, 33 bp, Artificial Sequence
  Synthetic Construct
gcccaaatcagcacctggcaaacccaagcacag

SEQ ID NO: 4175 - DNA, 33 bp, Artificial Sequence
  Synthetic Construct
gcccaaatcaccagcggcgccaccgtcgcacag

SEQ ID NO: 4176 - DNA, 33 bp, Artificial Sequence
  Synthetic Construct
gcccaacttgcgaaggcgagtaatgttgcacag

SEQ ID NO: 4177 - DNA, 33 bp, Artificial Sequence
  Synthetic Construct
gcccaaccgcaggggacgtttgggagtgcacag

SEQ ID NO: 4178 - DNA, 33 bp, Artificial Sequence
  Synthetic Construct
gcccaaattgttcggccgccgaatagtgcacag

SEQ ID NO: 4179 - DNA, 33 bp, Artificial Sequence
  Synthetic Construct
gcccaaaccagccacctcaccagcgccgcacag

SEQ ID NO: 4180 - DNA, 33 bp, Artificial Sequence
  Synthetic Construct
gcccaactccaccccgaaaccatgagagcacag

SEQ ID NO: 4181 - DNA, 33 bp, Artificial Sequence
  Synthetic Construct
gcccaagtcctccacgacaccagatacgcacag

SEQ ID NO: 4182 - DNA, 33 bp, Artificial Sequence
  Synthetic Construct
gcccaagtcagcaacccccccagaggcgcacag

SEQ ID NO: 4183 - DNA, 33 bp, Artificial Sequence
  Synthetic Construct
gcccaagagcctctgatgactaggcctgcacag

SEQ ID NO: 4184 - DNA, 33 bp, Artificial Sequence
  Synthetic Construct
gcccaagacagagtcagcagcagccacgcacag

SEQ ID NO: 4185 - DNA, 33 bp, Artificial Sequence
  Synthetic Construct
gcccaaactaagactggtcattcgagtgcacag

SEQ ID NO: 4186 - DNA, 33 bp, Artificial Sequence
  Synthetic Construct
gcccaatcgtcgtattctcctgttactgcacag

SEQ ID NO: 4187 - DNA, 33 bp, Artificial Sequence
  Synthetic Construct
gcccaaaaacccaacctccaaaacaacgcacag

SEQ ID NO: 4188 - DNA, 33 bp, Artificial Sequence
  Synthetic Construct
gcccaactcaaaagcccccccggcatcgcacag

SEQ ID NO: 4189 - DNA, 33 bp, Artificial Sequence
  Synthetic Construct
gcccaagggatgcagctggggatgccggcacag

SEQ ID NO: 4190 - DNA, 33 bp, Artificial Sequence
  Synthetic Construct
gcccaacatcaggcgaatcttacgttggcacag

SEQ ID NO: 4191 - DNA, 33 bp, Artificial Sequence
  Synthetic Construct
gcccaaactggtcatcctacgactgcggcacag

SEQ ID NO: 4192 - DNA, 33 bp, Artificial Sequence
  Synthetic Construct
gcccaattcatcggcagccacctcggcgcacag

SEQ ID NO: 4193 - DNA, 33 bp, Artificial Sequence
  Synthetic Construct
gcccaaaggaatgagagtaatgggccggcacag

SEQ ID NO: 4194 - DNA, 33 bp, Artificial Sequence
  Synthetic Construct
gcccaaaagattgagacgaatggtaatgcacag

SEQ ID NO: 4195 - DNA, 33 bp, Artificial Sequence
  Synthetic Construct
gcccaatatcttcagaatggtgttgttgcacag

SEQ ID NO: 4196 - DNA, 33 bp, Artificial Sequence
  Synthetic Construct
gcccaaagacccggcatgctcggcaccgcacag

SEQ ID NO: 4197 - DNA, 33 bp, Artificial Sequence
  Synthetic Construct
gcccaattgacgcagattgggactgctgcacag

SEQ ID NO: 4198 - DNA, 33 bp, Artificial Sequence
  Synthetic Construct
gcccaaaacgaagacgtccaaagagccgcacag

SEQ ID NO: 4199 - DNA, 33 bp, Artificial Sequence
  Synthetic Construct
gcccaacatttggctgatcagagtcgtgcacag

SEQ ID NO: 4200 - DNA, 33 bp, Artificial Sequence
  Synthetic Construct
gcccaattgggtaatgatacggtgagggcacag

SEQ ID NO: 4201 - DNA, 33 bp, Artificial Sequence
  Synthetic Construct
gcccaaaacaaccaccacgtcccccccgcacag

SEQ ID NO: 4202 - DNA, 33 bp, Artificial Sequence
  Synthetic Construct
gcccaagacaaagccggcaccctcagcgcacag

SEQ ID NO: 4203 - DNA, 33 bp, Artificial Sequence
  Synthetic Construct
gcccaacgtactaagaatgagtcgatggcacag

SEQ ID NO: 4204 - DNA, 33 bp, Artificial Sequence
  Synthetic Construct
gcccaatttaatgttgtgcgtggtgatgcacag

SEQ ID NO: 4205 - DNA, 33 bp, Artificial Sequence
  Synthetic Construct
gcccaaatcgtcagaggcatgaaccaagcacag

SEQ ID NO: 4206 - DNA, 33 bp, Artificial Sequence
  Synthetic Construct
gcccaacaacacacccccaccctcaacgcacag

SEQ ID NO: 4207 - DNA, 33 bp, Artificial Sequence
  Synthetic Construct
gcccaaagcctcggcaaagaacccctcgcacag

SEQ ID NO: 4208 - DNA, 33 bp, Artificial Sequence
  Synthetic Construct
gcccaaagcagcggccacggcctcaacgcacag

SEQ ID NO: 4209 - DNA, 33 bp, Artificial Sequence
  Synthetic Construct
gcccaacggattaatagtgattctactgcacag

SEQ ID NO: 4210 - DNA, 33 bp, Artificial Sequence
  Synthetic Construct
gcccaaaatccgcataatcatcctgttgcacag

SEQ ID NO: 4211 - DNA, 33 bp, Artificial Sequence
  Synthetic Construct
gcccaatcgcataagccgtcgacggttgcacag

SEQ ID NO: 4212 - DNA, 33 bp, Artificial Sequence
  Synthetic Construct
gcccaaagcagcatgagcaccacctacgcacag

SEQ ID NO: 4213 - DNA, 33 bp, Artificial Sequence
  Synthetic Construct
gcccaaggtgctgctgcttctaatcctgcacag

SEQ ID NO: 4214 - DNA, 33 bp, Artificial Sequence
  Synthetic Construct
gcccaaatgaaccaaagagaacaaaaagcacag

SEQ ID NO: 4215 - DNA, 33 bp, Artificial Sequence
  Synthetic Construct
gcccaatcgtatcctagtaatccgcgggcacag

SEQ ID NO: 4216 - DNA, 33 bp, Artificial Sequence
  Synthetic Construct
gcccaactgcgtgattttgtgactgatgcacag

SEQ ID NO: 4217 - DNA, 33 bp, Artificial Sequence
  Synthetic Construct
gcccaaaacaacaccgtcatgagaagcgcacag

SEQ ID NO: 4218 - DNA, 33 bp, Artificial Sequence
  Synthetic Construct
gcccaactcagccccagaaaatacatcgcacag

SEQ ID NO: 4219 - DNA, 33 bp, Artificial Sequence
  Synthetic Construct
gcccaacacatcagaccccccagccccgcacag

SEQ ID NO: 4220 - DNA, 33 bp, Artificial Sequence
  Synthetic Construct
gcccaaccttatgtgtcgactactgcggcacag

SEQ ID NO: 4221 - DNA, 33 bp, Artificial Sequence
  Synthetic Construct
gcccaagtcaaccacggcagccccaccgcacag

SEQ ID NO: 4222 - DNA, 33 bp, Artificial Sequence
  Synthetic Construct
gcccaaagtggttatcttaatggtgcggcacag

SEQ ID NO: 4223 - DNA, 33 bp, Artificial Sequence
  Synthetic Construct
gcccaaagtcgggagaggacgtctgatgcacag

SEQ ID NO: 4224 - DNA, 33 bp, Artificial Sequence
  Synthetic Construct
gcccaaacccacagcgtcaccagaagcgcacag

SEQ ID NO: 4225 - DNA, 33 bp, Artificial Sequence
  Synthetic Construct
gcccaacttgttgcgaataagaatgcggcacag

SEQ ID NO: 4226 - DNA, 33 bp, Artificial Sequence
  Synthetic Construct
gcccaaaattttacggatcgtgctactgcacag

SEQ ID NO: 4227 - DNA, 33 bp, Artificial Sequence
  Synthetic Construct
gcccaatataggacgagtactttggcggcacag

SEQ ID NO: 4228 - DNA, 33 bp, Artificial Sequence
  Synthetic Construct
gcccaacacgtcatgaacaaacaagccgcacag

SEQ ID NO: 4229 - DNA, 33 bp, Artificial Sequence
  Synthetic Construct
gcccaagccaccaacaaccccgccagcgcacag

SEQ ID NO: 4230 - DNA, 33 bp, Artificial Sequence
  Synthetic Construct
gcccaaaccatcatgaaagcccaaaccgcacag

SEQ ID NO: 4231 - DNA, 33 bp, Artificial Sequence
  Synthetic Construct
gcccaaggcatgagcaccatgacccccgcacag

SEQ ID NO: 4232 - DNA, 33 bp, Artificial Sequence
  Synthetic Construct
gcccaaggcacccccatctacaaacaagcacag

SEQ ID NO: 4233 - DNA, 33 bp, Artificial Sequence
  Synthetic Construct
gcccaaaatggtacgttggagaaggcggcacag

SEQ ID NO: 4234 - DNA, 33 bp, Artificial Sequence
  Synthetic Construct
gcccaaagcaacgaaagaaccatccccgcacag

SEQ ID NO: 4235 - DNA, 33 bp, Artificial Sequence
  Synthetic Construct
gcccaaattccggtgtctattcaggctgcacag

SEQ ID NO: 4236 - DNA, 33 bp, Artificial Sequence
  Synthetic Construct
gcccaaaacctccaaagagaaggccccgcacag

SEQ ID NO: 4237 - DNA, 33 bp, Artificial Sequence
  Synthetic Construct
gcccaaggggagggtggtaagtctaatgcacag

SEQ ID NO: 4238 - DNA, 33 bp, Artificial Sequence
  Synthetic Construct
gcccaattgcagggtaatgggaggaatgcacag

SEQ ID NO: 4239 - DNA, 33 bp, Artificial Sequence
  Synthetic Construct
gcccaactcgtcagcagcaccagcgaagcacag

SEQ ID NO: 4240 - DNA, 33 bp, Artificial Sequence
  Synthetic Construct
gcccaaagcctcgccggcaacaccaccgcacag

SEQ ID NO: 4241 - DNA, 33 bp, Artificial Sequence
  Synthetic Construct
gcccaattgactgttggtaataatgtggcacag

SEQ ID NO: 4242 - DNA, 33 bp, Artificial Sequence
  Synthetic Construct
gcccaaagcatcctcaccagagacagcgcacag

SEQ ID NO: 4243 - DNA, 33 bp, Artificial Sequence
  Synthetic Construct
gcccaagttcttgttgattcgcgtgcggcacag

SEQ ID NO: 4244 - DNA, 33 bp, Artificial Sequence
  Synthetic Construct
gcccaaggcgtcgccagcaccaccaccgcacag

SEQ ID NO: 4245 - DNA, 33 bp, Artificial Sequence
  Synthetic Construct
gcccaacacggcgccaacctcagcgtcgcacag

SEQ ID NO: 4246 - DNA, 33 bp, Artificial Sequence
  Synthetic Construct
gcccaatcgtttaatcagccgtctgttgcacag

SEQ ID NO: 4247 - DNA, 33 bp, Artificial Sequence
  Synthetic Construct
gcccaactcaaccaaaaccaaagagtcgcacag

SEQ ID NO: 4248 - DNA, 33 bp, Artificial Sequence
  Synthetic Construct
gcccaaagaatcgacagccaagacaccgcacag

SEQ ID NO: 4249 - DNA, 33 bp, Artificial Sequence
  Synthetic Construct
gcccaaaccgtccccggcagacccagcgcacag

SEQ ID NO: 4250 - DNA, 33 bp, Artificial Sequence
  Synthetic Construct
gcccaacgtgagccgaataatacgagtgcacag

SEQ ID NO: 4251 - DNA, 33 bp, Artificial Sequence
  Synthetic Construct
gcccaagaaagaatgaccatgcacgccgcacag

SEQ ID NO: 4252 - DNA, 33 bp, Artificial Sequence
  Synthetic Construct
gcccaaattgctattcagaatgatcgggcacag

SEQ ID NO: 4253 - DNA, 33 bp, Artificial Sequence
  Synthetic Construct
gcccaacttggggctcagtctatttcggcacag

SEQ ID NO: 4254 - DNA, 33 bp, Artificial Sequence
  Synthetic Construct
gcccaagcgggggataagacgtatgttgcacag

SEQ ID NO: 4255 - DNA, 33 bp, Artificial Sequence
  Synthetic Construct
gcccaaatgaataggactgcgtatactgcacag

SEQ ID NO: 4256 - DNA, 33 bp, Artificial Sequence
  Synthetic Construct
gcccaagcgctgcctgggggtcttatggcacag

SEQ ID NO: 4257 - DNA, 33 bp, Artificial Sequence
  Synthetic Construct
gcccaactcaaaaaccacgacaccaccgcacag

SEQ ID NO: 4258 - DNA, 33 bp, Artificial Sequence
  Synthetic Construct
gcccaacccctcaactacgccctcgaagcacag

SEQ ID NO: 4259 - DNA, 33 bp, Artificial Sequence
  Synthetic Construct
gcccaaagcaaacaaatgcacaacgacgcacag

SEQ ID NO: 4260 - DNA, 33 bp, Artificial Sequence
  Synthetic Construct
gcccaaacggcgcatacgactccttttgcacag

SEQ ID NO: 4261 - DNA, 33 bp, Artificial Sequence
  Synthetic Construct
gcccaactcaaaaccggcgacagccaagcacag

SEQ ID NO: 4262 - DNA, 33 bp, Artificial Sequence
  Synthetic Construct
gcccaatattctacgacggctgagtatgcacag

SEQ ID NO: 4263 - DNA, 33 bp, Artificial Sequence
  Synthetic Construct
gcccaaccgctggatcggacgggtgaggcacag

SEQ ID NO: 4264 - DNA, 33 bp, Artificial Sequence
  Synthetic Construct
gcccaaggccccggcgaagtcaaaatcgcacag

SEQ ID NO: 4265 - DNA, 33 bp, Artificial Sequence
  Synthetic Construct
gcccaactcagaaacctcgacctcaacgcacag

SEQ ID NO: 4266 - DNA, 33 bp, Artificial Sequence
  Synthetic Construct
gcccaactggggtctactttgactaaggcacag

SEQ ID NO: 4267 - DNA, 33 bp, Artificial Sequence
  Synthetic Construct
gcccaattgaggcctgtgagtgagcatgcacag

SEQ ID NO: 4268 - DNA, 33 bp, Artificial Sequence
  Synthetic Construct
gcccaaagtaggagtctgactgagatggcacag

SEQ ID NO: 4269 - DNA, 33 bp, Artificial Sequence
  Synthetic Construct
gcccaaaacggcctcagcaccaccatggcacag

SEQ ID NO: 4270 - DNA, 33 bp, Artificial Sequence
  Synthetic Construct
gcccaacatgataagacgtatgcgatggcacag

SEQ ID NO: 4271 - DNA, 33 bp, Artificial Sequence
  Synthetic Construct
gcccaagttccgtcggataagatgcgtgcacag

SEQ ID NO: 4272 - DNA, 33 bp, Artificial Sequence
  Synthetic Construct
gcccaaggcgcccacaacctcctcaccgcacag

SEQ ID NO: 4273 - DNA, 33 bp, Artificial Sequence
  Synthetic Construct
gcccaaagcaccagcaccatggtcatggcacag

SEQ ID NO: 4274 - DNA, 33 bp, Artificial Sequence
  Synthetic Construct
gcccaaaacatggcccacgaaagcaaagcacag

SEQ ID NO: 4275 - DNA, 33 bp, Artificial Sequence
  Synthetic Construct
gcccaatatcttggggtgggtgctactgcacag

SEQ ID NO: 4276 - DNA, 33 bp, Artificial Sequence
  Synthetic Construct
gcccaagccagcgaatacaaccaacacgcacag

SEQ ID NO: 4277 - DNA, 33 bp, Artificial Sequence
  Synthetic Construct
gcccaaagagccgaaggcgacaaaatcgcacag

SEQ ID NO: 4278 - DNA, 33 bp, Artificial Sequence
  Synthetic Construct
gcccaatctagtggtagtagttttcatgcacag

SEQ ID NO: 4279 - DNA, 33 bp, Artificial Sequence
  Synthetic Construct
gcccaatggggcaaagaatacaccggcgcacag

SEQ ID NO: 4280 - DNA, 33 bp, Artificial Sequence
  Synthetic Construct
gcccaacctgcttcgggggctatgcctgcacag

SEQ ID NO: 4281 - DNA, 33 bp, Artificial Sequence
  Synthetic Construct
gcccaaaggggggcggttgttgtggctgcacag

SEQ ID NO: 4282 - DNA, 33 bp, Artificial Sequence
  Synthetic Construct
gcccaagtgatgatgcagaatcatgctgcacag

SEQ ID NO: 4283 - DNA, 33 bp, Artificial Sequence
  Synthetic Construct
gcccaacaagacagactccaaagcagagcacag

SEQ ID NO: 4284 - DNA, 33 bp, Artificial Sequence
  Synthetic Construct
gcccaaggtcatgctgctgtttctgtggcacag

SEQ ID NO: 4285 - DNA, 33 bp, Artificial Sequence
  Synthetic Construct
gcccaagacaaaaccgacagcacccccgcacag

SEQ ID NO: 4286 - DNA, 33 bp, Artificial Sequence
  Synthetic Construct
gcccaagtgcctccgacttcttttactgcacag

SEQ ID NO: 4287 - DNA, 33 bp, Artificial Sequence
  Synthetic Construct
gcccaagtcggccccaacgcccaacacgcacag

SEQ ID NO: 4288 - DNA, 33 bp, Artificial Sequence
  Synthetic Construct
gcccaacatcatggtcgggctgatactgcacag

SEQ ID NO: 4289 - DNA, 33 bp, Artificial Sequence
  Synthetic Construct
gcccaacatgttaatatgggtccggcggcacag

SEQ ID NO: 4290 - DNA, 33 bp, Artificial Sequence
  Synthetic Construct
gcccaacacgccaccaaagaaaccagcgcacag

SEQ ID NO: 4291 - DNA, 33 bp, Artificial Sequence
  Synthetic Construct
gcccaattggctacgggtgtgagtaatgcacag

SEQ ID NO: 4292 - DNA, 33 bp, Artificial Sequence
  Synthetic Construct
gcccaaagcctcggcagctaccccaccgcacag

SEQ ID NO: 4293 - DNA, 33 bp, Artificial Sequence
  Synthetic Construct
gcccaaggcagcaaagcctacgtcggcgcacag

SEQ ID NO: 4294 - DNA, 33 bp, Artificial Sequence
  Synthetic Construct
gcccaacaagacagaatgagcgtcaacgcacag

SEQ ID NO: 4295 - DNA, 33 bp, Artificial Sequence
  Synthetic Construct
gcccaatggtcggattctctgagggatgcacag

SEQ ID NO: 4296 - DNA, 33 bp, Artificial Sequence
  Synthetic Construct
gcccaaacgaaggtgcctatgactcaggcacag

SEQ ID NO: 4297 - DNA, 33 bp, Artificial Sequence
  Synthetic Construct
gcccaatctccgttgtctgatcggttggcacag

SEQ ID NO: 4298 - DNA, 33 bp, Artificial Sequence
  Synthetic Construct
gcccaactgtatggtagttcggttgttgcacag

SEQ ID NO: 4299 - DNA, 33 bp, Artificial Sequence
  Synthetic Construct
gcccaaccgacgcagactgttagttcggcacag

SEQ ID NO: 4300 - DNA, 33 bp, Artificial Sequence
  Synthetic Construct
gcccaactgaataagctgcttggggcggcacag

SEQ ID NO: 4301 - DNA, 33 bp, Artificial Sequence
  Synthetic Construct
gcccaacattctaatcaggagcctcgggcacag

SEQ ID NO: 4302 - DNA, 33 bp, Artificial Sequence
  Synthetic Construct
gcccaaaacggcgccagcatccacagcgcacag

SEQ ID NO: 4303 - DNA, 33 bp, Artificial Sequence
  Synthetic Construct
gcccaactcagccaacaaagactccaagcacag

SEQ ID NO: 4304 - DNA, 33 bp, Artificial Sequence
  Synthetic Construct
gcccaactcccccacggcaccatgaacgcacag

SEQ ID NO: 4305 - DNA, 33 bp, Artificial Sequence
  Synthetic Construct
gcccaaagcagccccgacgccaaatacgcacag

SEQ ID NO: 4306 - DNA, 33 bp, Artificial Sequence
  Synthetic Construct
gcccaattccacacccccgccggcaacgcacag

SEQ ID NO: 4307 - DNA, 33 bp, Artificial Sequence
  Synthetic Construct
gcccaaagaaccaccgccaacagcctcgcacag

SEQ ID NO: 4308 - DNA, 33 bp, Artificial Sequence
  Synthetic Construct
gcccaattggataagactattcctcaggcacag

SEQ ID NO: 4309 - DNA, 33 bp, Artificial Sequence
  Synthetic Construct
gcccaatggcaaggcaacagacaagccgcacag

SEQ ID NO: 4310 - DNA, 33 bp, Artificial Sequence
  Synthetic Construct
gcccaagggtatggtacgattacgcctgcacag

SEQ ID NO: 4311 - DNA, 33 bp, Artificial Sequence
  Synthetic Construct
gcccaaatgagagaacaaaacaaagccgcacag

SEQ ID NO: 4312 - DNA, 33 bp, Artificial Sequence
  Synthetic Construct
gcccaaaacctcgccggcctcaccggcgcacag

SEQ ID NO: 4313 - DNA, 33 bp, Artificial Sequence
  Synthetic Construct
gcccaatggtttaaggctgggagtgctgcacag

SEQ ID NO: 4314 - DNA, 33 bp, Artificial Sequence
  Synthetic Construct
gcccaaatcaacgtcgccccctacaaagcacag

SEQ ID NO: 4315 - DNA, 33 bp, Artificial Sequence
  Synthetic Construct
gcccaaggggtgcattcgaatggtcaggcacag

SEQ ID NO: 4316 - DNA, 33 bp, Artificial Sequence
  Synthetic Construct
gcccaaatgagcgccagcaccaacaccgcacag

SEQ ID NO: 4317 - DNA, 33 bp, Artificial Sequence
  Synthetic Construct
gcccaaggcagccacaacgcccaaggcgcacag

SEQ ID NO: 4318 - DNA, 33 bp, Artificial Sequence
  Synthetic Construct
gcccaaatcagcgccgtccccaaaaacgcacag

SEQ ID NO: 4319 - DNA, 33 bp, Artificial Sequence
  Synthetic Construct
gcccaagccggcggcggcatgcaaaacgcacag

SEQ ID NO: 4320 - DNA, 33 bp, Artificial Sequence
  Synthetic Construct
gcccaactcctcaacaccaccagcaccgcacag

SEQ ID NO: 4321 - DNA, 33 bp, Artificial Sequence
  Synthetic Construct
gcccaaactaatactgtgagtgctagtgcacag

SEQ ID NO: 4322 - DNA, 33 bp, Artificial Sequence
  Synthetic Construct
gcccaacagttgtctccgattgctatggcacag

SEQ ID NO: 4323 - DNA, 33 bp, Artificial Sequence
  Synthetic Construct
gcccaagcgccgcggggtgttaatttggcacag

SEQ ID NO: 4324 - DNA, 33 bp, Artificial Sequence
  Synthetic Construct
gcccaacttactcgtacgtcggtggatgcacag

SEQ ID NO: 4325 - DNA, 33 bp, Artificial Sequence
  Synthetic Construct
gcccaactggggcagaaggcgcctactgcacag

SEQ ID NO: 4326 - DNA, 33 bp, Artificial Sequence
  Synthetic Construct
gcccaaaagaatgcgccgcctctgacggcacag

SEQ ID NO: 4327 - DNA, 33 bp, Artificial Sequence
  Synthetic Construct
gcccaagtcagaaacgccgtccacgccgcacag

SEQ ID NO: 4328 - DNA, 33 bp, Artificial Sequence
  Synthetic Construct
gcccaaatcagacacatggacgcccccgcacag

SEQ ID NO: 4329 - DNA, 33 bp, Artificial Sequence
  Synthetic Construct
gcccaaggtgctcctttggttgctactgcacag

SEQ ID NO: 4330 - DNA, 33 bp, Artificial Sequence
  Synthetic Construct
gcccaatctgatcataatgctcgtggggcacag

SEQ ID NO: 4331 - DNA, 33 bp, Artificial Sequence
  Synthetic Construct
gcccaaatcagcgacaccctccactacgcacag

SEQ ID NO: 4332 - DNA, 33 bp, Artificial Sequence
  Synthetic Construct
gcccaaaacaacagaggcagcatcagcgcacag

SEQ ID NO: 4333 - DNA, 33 bp, Artificial Sequence
  Synthetic Construct
gcccaacaaagagaaagagacggcgtcgcacag

SEQ ID NO: 4334 - DNA, 33 bp, Artificial Sequence
  Synthetic Construct
gcccaaagtaagcaggatgtgcgtgctgcacag

SEQ ID NO: 4335 - DNA, 33 bp, Artificial Sequence
  Synthetic Construct
gcccaaaacagcggcagactcaacgtcgcacag

SEQ ID NO: 4336 - DNA, 33 bp, Artificial Sequence
  Synthetic Construct
gcccaaggccccagcgtcgaaagcaacgcacag

SEQ ID NO: 4337 - DNA, 33 bp, Artificial Sequence
  Synthetic Construct
gcccaattgctttcttcttcgccttctgcacag

SEQ ID NO: 4338 - DNA, 33 bp, Artificial Sequence
  Synthetic Construct
gcccaaaaagtcctcgtcagcggcagcgcacag

SEQ ID NO: 4339 - DNA, 33 bp, Artificial Sequence
  Synthetic Construct
gcccaagatgtgcggaatactattgctgcacag

SEQ ID NO: 4340 - DNA, 33 bp, Artificial Sequence
  Synthetic Construct
gcccaacataagttggtgacgaaggatgcacag

SEQ ID NO: 4341 - DNA, 33 bp, Artificial Sequence
  Synthetic Construct
gcccaaccgtatgtttcgggtgttcctgcacag

SEQ ID NO: 4342 - DNA, 33 bp, Artificial Sequence
  Synthetic Construct
gcccaaacgactaaggcttcgtttactgcacag

SEQ ID NO: 4343 - DNA, 33 bp, Artificial Sequence
  Synthetic Construct
gcccaaaccccccacggccccgacgccgcacag

SEQ ID NO: 4344 - DNA, 33 bp, Artificial Sequence
  Synthetic Construct
gcccaagattatcgtcagactgatcatgcacag

SEQ ID NO: 4345 - DNA, 33 bp, Artificial Sequence
  Synthetic Construct
gcccaacacagccccaaacccgaccacgcacag

SEQ ID NO: 4346 - DNA, 33 bp, Artificial Sequence
  Synthetic Construct
gcccaagcgtatggtcaggtgcctcctgcacag

SEQ ID NO: 4347 - DNA, 33 bp, Artificial Sequence
  Synthetic Construct
gcccaaagcaaccaaggcctcgccggcgcacag

SEQ ID NO: 4348 - DNA, 33 bp, Artificial Sequence
  Synthetic Construct
gcccaaatcaacagccccatcggcaacgcacag

SEQ ID NO: 4349 - DNA, 33 bp, Artificial Sequence
  Synthetic Construct
gcccaacaaaaccaaatcatgagcggcgcacag

SEQ ID NO: 4350 - DNA, 33 bp, Artificial Sequence
  Synthetic Construct
gcccaagtctaccaaggcaaccaaaacgcacag

SEQ ID NO: 4351 - DNA, 33 bp, Artificial Sequence
  Synthetic Construct
gcccaaggcagcaacagccaacacaccgcacag

SEQ ID NO: 4352 - DNA, 33 bp, Artificial Sequence
  Synthetic Construct
gcccaaaagcaggagccgtcggatagggcacag

SEQ ID NO: 4353 - DNA, 33 bp, Artificial Sequence
  Synthetic Construct
gcccaacacagaagcagccccgccgccgcacag

SEQ ID NO: 4354 - DNA, 33 bp, Artificial Sequence
  Synthetic Construct
gcccaaaatgaggggaattcgatgaaggcacag

SEQ ID NO: 4355 - DNA, 33 bp, Artificial Sequence
  Synthetic Construct
gcccaaagacccgacaaaggccccatggcacag

SEQ ID NO: 4356 - DNA, 33 bp, Artificial Sequence
  Synthetic Construct
gcccaagcgattgtgtctcatccgctggcacag

SEQ ID NO: 4357 - DNA, 33 bp, Artificial Sequence
  Synthetic Construct
gcccaaacccaaggcgaaagacccgtcgcacag

SEQ ID NO: 4358 - DNA, 33 bp, Artificial Sequence
  Synthetic Construct
gcccaatacgtcaacagcgcccccaaagcacag

SEQ ID NO: 4359 - DNA, 33 bp, Artificial Sequence
  Synthetic Construct
gcccaaccttcggggacttcgattgtggcacag

SEQ ID NO: 4360 - DNA, 33 bp, Artificial Sequence
  Synthetic Construct
gcccaaagcgtcggcgccaacagaagcgcacag

SEQ ID NO: 4361 - DNA, 33 bp, Artificial Sequence
  Synthetic Construct
gcccaatctgcgcattttaatcattcggcacag

SEQ ID NO: 4362 - DNA, 33 bp, Artificial Sequence
  Synthetic Construct
gcccaaaaagtcaacagcgcccacctcgcacag

SEQ ID NO: 4363 - DNA, 33 bp, Artificial Sequence
  Synthetic Construct
gcccaaggttttgggaatatgggggctgcacag

SEQ ID NO: 4364 - DNA, 33 bp, Artificial Sequence
  Synthetic Construct
gcccaaaatcttaagcctgagactgatgcacag

SEQ ID NO: 4365 - DNA, 33 bp, Artificial Sequence
  Synthetic Construct
gcccaaccgaattcgaatactgcgtttgcacag

SEQ ID NO: 4366 - DNA, 33 bp, Artificial Sequence
  Synthetic Construct
gcccaacatgatactctgaggactcctgcacag

SEQ ID NO: 4367 - DNA, 33 bp, Artificial Sequence
  Synthetic Construct
gcccaaaggtttccgcaggcgcctccggcacag

SEQ ID NO: 4368 - DNA, 33 bp, Artificial Sequence
  Synthetic Construct
gcccaatcgtcgggtaataagtcggatgcacag

SEQ ID NO: 4369 - DNA, 33 bp, Artificial Sequence
  Synthetic Construct
gcccaaatgtcgaagatggcggatcgggcacag

SEQ ID NO: 4370 - DNA, 33 bp, Artificial Sequence
  Synthetic Construct
gcccaagaacacagagaaaccagcatcgcacag

SEQ ID NO: 4371 - DNA, 33 bp, Artificial Sequence
  Synthetic Construct
gcccaaagcaccgaataccccgtccccgcacag

SEQ ID NO: 4372 - DNA, 33 bp, Artificial Sequence
  Synthetic Construct
gcccaagacaaaagcatgaaccccagcgcacag

SEQ ID NO: 4373 - DNA, 33 bp, Artificial Sequence
  Synthetic Construct
gcccaagaataccacaacaacctcaaagcacag

SEQ ID NO: 4374 - DNA, 33 bp, Artificial Sequence
  Synthetic Construct
gcccaaatttttacgaatacgggtcatgcacag

SEQ ID NO: 4375 - DNA, 33 bp, Artificial Sequence
  Synthetic Construct
gcccaaaaaagcaacagccccctcgccgcacag

SEQ ID NO: 4376 - DNA, 33 bp, Artificial Sequence
  Synthetic Construct
gcccaatacagcagcggctacaacgccgcacag

SEQ ID NO: 4377 - DNA, 33 bp, Artificial Sequence
  Synthetic Construct
gcccaaggttctaagacgcagggggatgcacag

SEQ ID NO: 4378 - DNA, 33 bp, Artificial Sequence
  Synthetic Construct
gcccaaattgtttctgggtcgagtcaggcacag

SEQ ID NO: 4379 - DNA, 33 bp, Artificial Sequence
  Synthetic Construct
gcccaaagcctcatcaacagcacctacgcacag

SEQ ID NO: 4380 - DNA, 33 bp, Artificial Sequence
  Synthetic Construct
gcccaaaacatgaaaatccaacacgtcgcacag

SEQ ID NO: 4381 - DNA, 33 bp, Artificial Sequence
  Synthetic Construct
gcccaagattcgacgaagttgggtcatgcacag

SEQ ID NO: 4382 - DNA, 33 bp, Artificial Sequence
  Synthetic Construct
gcccaacagtcgcatgggacgtctagtgcacag

SEQ ID NO: 4383 - DNA, 33 bp, Artificial Sequence
  Synthetic Construct
gcccaaaaagacaacaacagaagcgccgcacag

SEQ ID NO: 4384 - DNA, 33 bp, Artificial Sequence
  Synthetic Construct
gcccaattccaacccagctacgccgccgcacag

SEQ ID NO: 4385 - DNA, 33 bp, Artificial Sequence
  Synthetic Construct
gcccaacccaccgtccaaatgaaagccgcacag

SEQ ID NO: 4386 - DNA, 33 bp, Artificial Sequence
  Synthetic Construct
gcccaatcgccgacgagtagtacttttgcacag

SEQ ID NO: 4387 - DNA, 33 bp, Artificial Sequence
  Synthetic Construct
gcccaaggcagagacgccaacgtccccgcacag

SEQ ID NO: 4388 - DNA, 33 bp, Artificial Sequence
  Synthetic Construct
gcccaaaccctcatgagcaccagccccgcacag

SEQ ID NO: 4389 - DNA, 33 bp, Artificial Sequence
  Synthetic Construct
gcccaactgcatggggctactacgactgcacag

SEQ ID NO: 4390 - DNA, 33 bp, Artificial Sequence
  Synthetic Construct
gcccaaaggactaatgaggttatgcgggcacag

SEQ ID NO: 4391 - DNA, 33 bp, Artificial Sequence
  Synthetic Construct
gcccaagataatctgagggttacggcggcacag

SEQ ID NO: 4392 - DNA, 33 bp, Artificial Sequence
  Synthetic Construct
gcccaaaggcaggcgggggatcagcttgcacag

SEQ ID NO: 4393 - DNA, 33 bp, Artificial Sequence
  Synthetic Construct
gcccaagtcggccaacacctcacccacgcacag

SEQ ID NO: 4394 - DNA, 33 bp, Artificial Sequence
  Synthetic Construct
gcccaactcagcgccgccagcggcatcgcacag

SEQ ID NO: 4395 - DNA, 33 bp, Artificial Sequence
  Synthetic Construct
gcccaaagcagccacaacggcttcatcgcacag

SEQ ID NO: 4396 - DNA, 33 bp, Artificial Sequence
  Synthetic Construct
gcccaaaacgccaccagacaatacagcgcacag

SEQ ID NO: 4397 - DNA, 33 bp, Artificial Sequence
  Synthetic Construct
gcccaagtcagcagacaaagcctcggcgcacag

SEQ ID NO: 4398 - DNA, 33 bp, Artificial Sequence
  Synthetic Construct
gcccaagacgtcgtcaaaccccacggcgcacag

SEQ ID NO: 4399 - DNA, 33 bp, Artificial Sequence
  Synthetic Construct
gcccaagggattgggggtattagttctgcacag

SEQ ID NO: 4400 - DNA, 33 bp, Artificial Sequence
  Synthetic Construct
gcccaaactaataatagtctgcgtgaggcacag

SEQ ID NO: 4401 - DNA, 33 bp, Artificial Sequence
  Synthetic Construct
gcccaaacgcgtacggcttcggcgctggcacag

SEQ ID NO: 4402 - DNA, 33 bp, Artificial Sequence
  Synthetic Construct
gcccaaactacgacggctccgagtccggcacag

SEQ ID NO: 4403 - DNA, 33 bp, Artificial Sequence
  Synthetic Construct
gcccaaaacgccagcatgagcagcatcgcacag

SEQ ID NO: 4404 - DNA, 33 bp, Artificial Sequence
  Synthetic Construct
gcccaaacccaaccccacagaggcctcgcacag

SEQ ID NO: 4405 - DNA, 33 bp, Artificial Sequence
  Synthetic Construct
gcccaaagactcgaccaccacagcagcgcacag

SEQ ID NO: 4406 - DNA, 33 bp, Artificial Sequence
  Synthetic Construct
gcccaagaaaacaccaccagaatcgccgcacag

SEQ ID NO: 4407 - DNA, 33 bp, Artificial Sequence
  Synthetic Construct
gcccaaagcctcagaggcaacgaagccgcacag

SEQ ID NO: 4408 - DNA, 33 bp, Artificial Sequence
  Synthetic Construct
gcccaacctaatgttccttcgcattctgcacag

SEQ ID NO: 4409 - DNA, 33 bp, Artificial Sequence
  Synthetic Construct
gcccaagggatgcctttgatgaagatggcacag

SEQ ID NO: 4410 - DNA, 33 bp, Artificial Sequence
  Synthetic Construct
gcccaacagaagactgagcggacggttgcacag

SEQ ID NO: 4411 - DNA, 33 bp, Artificial Sequence
  Synthetic Construct
gcccaaaaccacaccaaccacagcagcgcacag

SEQ ID NO: 4412 - DNA, 33 bp, Artificial Sequence
  Synthetic Construct
gcccaagggctggggaataggtctgctgcacag

SEQ ID NO: 4413 - DNA, 33 bp, Artificial Sequence
  Synthetic Construct
gcccaagacctcgacaaaagaggcctcgcacag

SEQ ID NO: 4414 - DNA, 33 bp, Artificial Sequence
  Synthetic Construct
gcccaactcaccaacgcccaacccgacgcacag

SEQ ID NO: 4415 - DNA, 33 bp, Artificial Sequence
  Synthetic Construct
gcccaaacgaagcctgattatctggttgcacag

SEQ ID NO: 4416 - DNA, 33 bp, Artificial Sequence
  Synthetic Construct
gcccaaaagttgcagttgcatgaggttgcacag

SEQ ID NO: 4417 - DNA, 33 bp, Artificial Sequence
  Synthetic Construct
gcccaaacgtctgtgacgatttcgagtgcacag

SEQ ID NO: 4418 - DNA, 33 bp, Artificial Sequence
  Synthetic Construct
gcccaaaattcgagtaatagggctgaggcacag

SEQ ID NO: 4419 - DNA, 33 bp, Artificial Sequence
  Synthetic Construct
gcccaactcgaacacggcaccagaatcgcacag

SEQ ID NO: 4420 - DNA, 33 bp, Artificial Sequence
  Synthetic Construct
gcccaaaccctccaaatgagagaacacgcacag

SEQ ID NO: 4421 - DNA, 33 bp, Artificial Sequence
  Synthetic Construct
gcccaaggcagccccaccgcccaaaccgcacag

SEQ ID NO: 4422 - DNA, 33 bp, Artificial Sequence
  Synthetic Construct
gcccaaaataaggggcagacgcttactgcacag

SEQ ID NO: 4423 - DNA, 33 bp, Artificial Sequence
  Synthetic Construct
gcccaatcggtgggtcatcgggatatggcacag

SEQ ID NO: 4424 - DNA, 33 bp, Artificial Sequence
  Synthetic Construct
gcccaaagagacaaaagcagcatgcacgcacag

SEQ ID NO: 4425 - DNA, 33 bp, Artificial Sequence
  Synthetic Construct
gcccaagtcagcgtcatcaacaacaccgcacag

SEQ ID NO: 4426 - DNA, 33 bp, Artificial Sequence
  Synthetic Construct
gcccaacttcctaattctgcttttagtgcacag

SEQ ID NO: 4427 - DNA, 33 bp, Artificial Sequence
  Synthetic Construct
gcccaacgtacggtgtctacggatgatgcacag

SEQ ID NO: 4428 - DNA, 33 bp, Artificial Sequence
  Synthetic Construct
gcccaactcatggacagaatggccagcgcacag

SEQ ID NO: 4429 - DNA, 33 bp, Artificial Sequence
  Synthetic Construct
gcccaaccgagtgggtttaatactttggcacag

SEQ ID NO: 4430 - DNA, 33 bp, Artificial Sequence
  Synthetic Construct
gcccaaaaaagcgcccaacccatgagcgcacag

SEQ ID NO: 4431 - DNA, 33 bp, Artificial Sequence
  Synthetic Construct
gcccaaaccggcctcagcgtccaaaaagcacag

SEQ ID NO: 4432 - DNA, 33 bp, Artificial Sequence
  Synthetic Construct
gcccaacacggcttccccgccggccccgcacag

SEQ ID NO: 4433 - DNA, 33 bp, Artificial Sequence
  Synthetic Construct
gcccaaagctacgaagccgtcggcatcgcacag

SEQ ID NO: 4434 - DNA, 33 bp, Artificial Sequence
  Synthetic Construct
gcccaaaccgccaaaggcgtcctcagcgcacag

SEQ ID NO: 4435 - DNA, 33 bp, Artificial Sequence
  Synthetic Construct
gcccaaggcgccagcacccacaacgccgcacag

SEQ ID NO: 4436 - DNA, 33 bp, Artificial Sequence
  Synthetic Construct
gcccaaatcatcaaagaaatccccgccgcacag

SEQ ID NO: 4437 - DNA, 33 bp, Artificial Sequence
  Synthetic Construct
gcccaaaaccacgtcatcagcaacggcgcacag

SEQ ID NO: 4438 - DNA, 33 bp, Artificial Sequence
  Synthetic Construct
gcccaatacaccaacatggccggcgtcgcacag

SEQ ID NO: 4439 - DNA, 33 bp, Artificial Sequence
  Synthetic Construct
gcccaattcaacagaatcggcgccggcgcacag

SEQ ID NO: 4440 - DNA, 33 bp, Artificial Sequence
  Synthetic Construct
gcccaatggagcaccatgatgaaaagcgcacag

SEQ ID NO: 4441 - DNA, 33 bp, Artificial Sequence
  Synthetic Construct
gcccaaaccgcccccgccaaccacgtcgcacag

SEQ ID NO: 4442 - DNA, 33 bp, Artificial Sequence
  Synthetic Construct
gcccaaatgcatgggggttcggagctggcacag

SEQ ID NO: 4443 - DNA, 33 bp, Artificial Sequence
  Synthetic Construct
gcccaaatgagtaggatgggggtggcggcacag

SEQ ID NO: 4444 - DNA, 33 bp, Artificial Sequence
  Synthetic Construct
gcccaaactcggattagtgaggttcttgcacag

SEQ ID NO: 4445 - DNA, 33 bp, Artificial Sequence
  Synthetic Construct
gcccaaagcggccccggcctcagaaccgcacag

SEQ ID NO: 4446 - DNA, 33 bp, Artificial Sequence
  Synthetic Construct
gcccaagataagcgtcatcatgcggaggcacag

SEQ ID NO: 4447 - DNA, 33 bp, Artificial Sequence
  Synthetic Construct
gcccaattgacgcagaatgatcggcctgcacag

SEQ ID NO: 4448 - DNA, 33 bp, Artificial Sequence
  Synthetic Construct
gcccaaagcgtcaccaccagccacgtcgcacag

SEQ ID NO: 4449 - DNA, 33 bp, Artificial Sequence
  Synthetic Construct
gcccaaatgctcaccggcggcaccaacgcacag

SEQ ID NO: 4450 - DNA, 33 bp, Artificial Sequence
  Synthetic Construct
gcccaagacaacgtcgccaacgccggcgcacag

SEQ ID NO: 4451 - DNA, 33 bp, Artificial Sequence
  Synthetic Construct
gcccaaatgaccaccaacagcatcgccgcacag

SEQ ID NO: 4452 - DNA, 33 bp, Artificial Sequence
  Synthetic Construct
gcccaaatgcgtacgcagtctctgtcggcacag

SEQ ID NO: 4453 - DNA, 33 bp, Artificial Sequence
  Synthetic Construct
gcccaatacggcagcttcaccggccaagcacag

SEQ ID NO: 4454 - DNA, 33 bp, Artificial Sequence
  Synthetic Construct
gcccaaggccccatgctcctcaaagccgcacag

SEQ ID NO: 4455 - DNA, 33 bp, Artificial Sequence
  Synthetic Construct
gcccaaatgacccaaaaagcccccgtcgcacag

SEQ ID NO: 4456 - DNA, 33 bp, Artificial Sequence
  Synthetic Construct
gcccaaagcgccaacgccaccaaactcgcacag

SEQ ID NO: 4457 - DNA, 33 bp, Artificial Sequence
  Synthetic Construct
gcccaattcaacggcagcctcgccatggcacag

SEQ ID NO: 4458 - DNA, 33 bp, Artificial Sequence
  Synthetic Construct
gcccaaattgttaatgctaagcttactgcacag

SEQ ID NO: 4459 - DNA, 33 bp, Artificial Sequence
  Synthetic Construct
gcccaaatgttcagcggcctccaagccgcacag

SEQ ID NO: 4460 - DNA, 33 bp, Artificial Sequence
  Synthetic Construct
gcccaagtggattatcgggtgaatggtgcacag

SEQ ID NO: 4461 - DNA, 33 bp, Artificial Sequence
  Synthetic Construct
gcccaactggcttcggctggtaatggtgcacag

SEQ ID NO: 4462 - DNA, 33 bp, Artificial Sequence
  Synthetic Construct
gcccaacgtgatcttcattctaaggatgcacag

SEQ ID NO: 4463 - DNA, 33 bp, Artificial Sequence
  Synthetic Construct
gcccaaagccacgtcagcagaaccgccgcacag

SEQ ID NO: 4464 - DNA, 33 bp, Artificial Sequence
  Synthetic Construct
gcccaaacccccgtccaaagcctcagcgcacag

SEQ ID NO: 4465 - DNA, 33 bp, Artificial Sequence
  Synthetic Construct
gcccaatacctcaacggcagcgaactcgcacag

SEQ ID NO: 4466 - DNA, 33 bp, Artificial Sequence
  Synthetic Construct
gcccaacctgctttgaagactcatgaggcacag

SEQ ID NO: 4467 - DNA, 33 bp, Artificial Sequence
  Synthetic Construct
gcccaaaataagtctctgacttctgatgcacag

SEQ ID NO: 4468 - DNA, 33 bp, Artificial Sequence
  Synthetic Construct
gcccaatataatgctactaagtcgagtgcacag

SEQ ID NO: 4469 - DNA, 33 bp, Artificial Sequence
  Synthetic Construct
gcccaaatgcgggataagagtcatgatgcacag

SEQ ID NO: 4470 - DNA, 33 bp, Artificial Sequence
  Synthetic Construct
gcccaacacagaaccgaaggccaaaacgcacag

SEQ ID NO: 4471 - DNA, 33 bp, Artificial Sequence
  Synthetic Construct
gcccaactccacaaacccgacgaattcgcacag

SEQ ID NO: 4472 - DNA, 33 bp, Artificial Sequence
  Synthetic Construct
gcccaaattgctgcgaggcctccttcggcacag

SEQ ID NO: 4473 - DNA, 33 bp, Artificial Sequence
  Synthetic Construct
gcccaaacgcctacgcattattctcatgcacag

SEQ ID NO: 4474 - DNA, 33 bp, Artificial Sequence
  Synthetic Construct
gcccaatcgactttttcggctgatagggcacag

SEQ ID NO: 4475 - DNA, 33 bp, Artificial Sequence
  Synthetic Construct
gcccaacagtcggtgcaggtgacggctgcacag

SEQ ID NO: 4476 - DNA, 33 bp, Artificial Sequence
  Synthetic Construct
gcccaactcgacagcagcagaaacagagcacag

SEQ ID NO: 4477 - DNA, 33 bp, Artificial Sequence
  Synthetic Construct
gcccaaagacaaccccaaagcaccgtcgcacag

SEQ ID NO: 4478 - DNA, 33 bp, Artificial Sequence
  Synthetic Construct
gcccaaagagtcgacgacggcgtcagagcacag

SEQ ID NO: 4479 - DNA, 33 bp, Artificial Sequence
  Synthetic Construct
gcccaaaaaatcaccaacacctacagcgcacag

SEQ ID NO: 4480 - DNA, 33 bp, Artificial Sequence
  Synthetic Construct
gcccaacctgggaaggcgactcctcctgcacag

SEQ ID NO: 4481 - DNA, 33 bp, Artificial Sequence
  Synthetic Construct
gcccaattcagcacccacaccccccccgcacag

SEQ ID NO: 4482 - DNA, 33 bp, Artificial Sequence
  Synthetic Construct
gcccaactcgcccccaacatgagactcgcacag

SEQ ID NO: 4483 - DNA, 33 bp, Artificial Sequence
  Synthetic Construct
gcccaaaacctccccagaaccaacgtcgcacag

SEQ ID NO: 4484 - DNA, 33 bp, Artificial Sequence
  Synthetic Construct
gcccaagagacgagtaatgtgaatcgtgcacag

SEQ ID NO: 4485 - DNA, 33 bp, Artificial Sequence
  Synthetic Construct
gcccaaggcagcaccgaccacagactcgcacag

SEQ ID NO: 4486 - DNA, 33 bp, Artificial Sequence
  Synthetic Construct
gcccaagtcaacaccgccatgcccgccgcacag

SEQ ID NO: 4487 - DNA, 33 bp, Artificial Sequence
  Synthetic Construct
gcccaaatggttgctcgggatcagaatgcacag

SEQ ID NO: 4488 - DNA, 33 bp, Artificial Sequence
  Synthetic Construct
gcccaaaaaaacaaccccgtcctccacgcacag

SEQ ID NO: 4489 - DNA, 33 bp, Artificial Sequence
  Synthetic Construct
gcccaagattcgacgacggttaggcttgcacag

SEQ ID NO: 4490 - DNA, 33 bp, Artificial Sequence
  Synthetic Construct
gcccaaaaactcaacgtcatgaacgacgcacag

SEQ ID NO: 4491 - DNA, 33 bp, Artificial Sequence
  Synthetic Construct
gcccaaagcctcagagacaaaaacgccgcacag

SEQ ID NO: 4492 - DNA, 33 bp, Artificial Sequence
  Synthetic Construct
gcccaaggtgttggtaatagtctgagtgcacag

SEQ ID NO: 4493 - DNA, 33 bp, Artificial Sequence
  Synthetic Construct
gcccaattcagcaaaaccaacttcaacgcacag

SEQ ID NO: 4494 - DNA, 33 bp, Artificial Sequence
  Synthetic Construct
gcccaagctaatcggccttcgctgcctgcacag

SEQ ID NO: 4495 - DNA, 33 bp, Artificial Sequence
  Synthetic Construct
gcccaagacagccaaaccaacagagtcgcacag

SEQ ID NO: 4496 - DNA, 33 bp, Artificial Sequence
  Synthetic Construct
gcccaaatttcgacgtcgtctccggttgcacag

SEQ ID NO: 4497 - DNA, 33 bp, Artificial Sequence
  Synthetic Construct
gcccaaatcctcaaaatcaccgaaggcgcacag

SEQ ID NO: 4498 - DNA, 33 bp, Artificial Sequence
  Synthetic Construct
gcccaatttcgtccggcgtctgagattgcacag

SEQ ID NO: 4499 - DNA, 33 bp, Artificial Sequence
  Synthetic Construct
gcccaaaaaaaagacagcgaacccctcgcacag

SEQ ID NO: 4500 - DNA, 33 bp, Artificial Sequence
  Synthetic Construct
gcccaaaacgccagacccctcaccgccgcacag

SEQ ID NO: 4501 - DNA, 33 bp, Artificial Sequence
  Synthetic Construct
gcccaaaaggcggctaggatggagactgcacag

SEQ ID NO: 4502 - DNA, 33 bp, Artificial Sequence
  Synthetic Construct
gcccaacacgccaacgtcagcagcagagcacag

SEQ ID NO: 4503 - DNA, 33 bp, Artificial Sequence
  Synthetic Construct
gcccaaaccagcaccacccaaaccagcgcacag

SEQ ID NO: 4504 - DNA, 33 bp, Artificial Sequence
  Synthetic Construct
gcccaaagtgcgttgtcgctgagtccggcacag

SEQ ID NO: 4505 - DNA, 33 bp, Artificial Sequence
  Synthetic Construct
gcccaagctaatgttcagattcagtcggcacag

SEQ ID NO: 4506 - DNA, 33 bp, Artificial Sequence
  Synthetic Construct
gcccaaacccccagcagcaacagcctcgcacag

SEQ ID NO: 4507 - DNA, 33 bp, Artificial Sequence
  Synthetic Construct
gcccaaacgatgacggggcctggtcatgcacag

SEQ ID NO: 4508 - DNA, 33 bp, Artificial Sequence
  Synthetic Construct
gcccaaattactgctcagattacgaatgcacag

SEQ ID NO: 4509 - DNA, 33 bp, Artificial Sequence
  Synthetic Construct
gcccaacttcctaatccttcgtctcgggcacag

SEQ ID NO: 4510 - DNA, 33 bp, Artificial Sequence
  Synthetic Construct
gcccaaaagatggggactatgacgcctgcacag

SEQ ID NO: 4511 - DNA, 33 bp, Artificial Sequence
  Synthetic Construct
gcccaatacaccaacggcagaatcaacgcacag

SEQ ID NO: 4512 - DNA, 33 bp, Artificial Sequence
  Synthetic Construct
gcccaagatgggagtaatgtggtgaaggcacag

SEQ ID NO: 4513 - DNA, 33 bp, Artificial Sequence
  Synthetic Construct
gcccaactccccctcagcatccccgccgcacag

SEQ ID NO: 4514 - DNA, 33 bp, Artificial Sequence
  Synthetic Construct
gcccaagaaagcagactcagcagcagcgcacag

SEQ ID NO: 4515 - DNA, 33 bp, Artificial Sequence
  Synthetic Construct
gcccaaatgagtccttctcggggtaatgcacag

SEQ ID NO: 4516 - DNA, 33 bp, Artificial Sequence
  Synthetic Construct
gcccaaagcgtccacgccgccaaacaagcacag

SEQ ID NO: 4517 - DNA, 33 bp, Artificial Sequence
  Synthetic Construct
gcccaagcgttttctagtggtacttcggcacag

SEQ ID NO: 4518 - DNA, 33 bp, Artificial Sequence
  Synthetic Construct
gcccaaactgggtggtctccttcgcctgcacag

SEQ ID NO: 4519 - DNA, 33 bp, Artificial Sequence
  Synthetic Construct
gcccaagcgtcgcatagtgcgagtggtgcacag

SEQ ID NO: 4520 - DNA, 33 bp, Artificial Sequence
  Synthetic Construct
gcccaagtcacccccagaagccccctcgcacag

SEQ ID NO: 4521 - DNA, 33 bp, Artificial Sequence
  Synthetic Construct
gcccaaactgagcgtgatactagtcgtgcacag

SEQ ID NO: 4522 - DNA, 33 bp, Artificial Sequence
  Synthetic Construct
gcccaatacaccctcaccggcaccaccgcacag

SEQ ID NO: 4523 - DNA, 33 bp, Artificial Sequence
  Synthetic Construct
gcccaagacctcagagtcagcagagacgcacag

SEQ ID NO: 4524 - DNA, 33 bp, Artificial Sequence
  Synthetic Construct
gcccaacttattgcgtcgcatacggcggcacag

SEQ ID NO: 4525 - DNA, 33 bp, Artificial Sequence
  Synthetic Construct
gcccaacagcgttctgagaattcgcatgcacag

SEQ ID NO: 4526 - DNA, 33 bp, Artificial Sequence
  Synthetic Construct
gcccaaagtgcgagtaatcagacttatgcacag

SEQ ID NO: 4527 - DNA, 33 bp, Artificial Sequence
  Synthetic Construct
gcccaattggagaaggtgctgcagccggcacag

SEQ ID NO: 4528 - DNA, 33 bp, Artificial Sequence
  Synthetic Construct
gcccaaaatagtggtccgttggtgattgcacag

SEQ ID NO: 4529 - DNA, 33 bp, Artificial Sequence
  Synthetic Construct
gcccaaggcaccatccacagccccgtcgcacag

SEQ ID NO: 4530 - DNA, 33 bp, Artificial Sequence
  Synthetic Construct
gcccaaaacaaaaacggcgaagtcctcgcacag

SEQ ID NO: 4531 - DNA, 33 bp, Artificial Sequence
  Synthetic Construct
gcccaacccatgaacgaaagagaaagagcacag

SEQ ID NO: 4532 - DNA, 33 bp, Artificial Sequence
  Synthetic Construct
gcccaaggcagcaacaacctccaccccgcacag

SEQ ID NO: 4533 - DNA, 33 bp, Artificial Sequence
  Synthetic Construct
gcccaaatgagcctccacgccaaaagcgcacag

SEQ ID NO: 4534 - DNA, 33 bp, Artificial Sequence
  Synthetic Construct
gcccaacaagaaaaagccctcgccagagcacag

SEQ ID NO: 4535 - DNA, 33 bp, Artificial Sequence
  Synthetic Construct
gcccaagatcgtagtacgcatgctaaggcacag

SEQ ID NO: 4536 - DNA, 33 bp, Artificial Sequence
  Synthetic Construct
gcccaaattgtgaggggtgatacgtctgcacag

SEQ ID NO: 4537 - DNA, 33 bp, Artificial Sequence
  Synthetic Construct
gcccaaagcagcggcggcatgaacgaagcacag

SEQ ID NO: 4538 - DNA, 33 bp, Artificial Sequence
  Synthetic Construct
gcccaaaagttgcatgctgttgaggctgcacag

SEQ ID NO: 4539 - DNA, 33 bp, Artificial Sequence
  Synthetic Construct
gcccaaatgttcgccgaaggcaccgtcgcacag

SEQ ID NO: 4540 - DNA, 33 bp, Artificial Sequence
  Synthetic Construct
gcccaaaccctcggcagagtcccccaagcacag

SEQ ID NO: 4541 - DNA, 33 bp, Artificial Sequence
  Synthetic Construct
gcccaactcctcggcaacaaagacaaagcacag

SEQ ID NO: 4542 - DNA, 33 bp, Artificial Sequence
  Synthetic Construct
gcccaaagagtcaacaccagcaccgacgcacag

SEQ ID NO: 4543 - DNA, 33 bp, Artificial Sequence
  Synthetic Construct
gcccaaccccaaggcgtcagccccgccgcacag

SEQ ID NO: 4544 - DNA, 33 bp, Artificial Sequence
  Synthetic Construct
gcccaaggcgccgtcctcagcaaagccgcacag

SEQ ID NO: 4545 - DNA, 33 bp, Artificial Sequence
  Synthetic Construct
gcccaactcggccacgccgccaccagcgcacag

SEQ ID NO: 4546 - DNA, 33 bp, Artificial Sequence
  Synthetic Construct
gcccaaagcggcttcagcagcaccgccgcacag

SEQ ID NO: 4547 - DNA, 33 bp, Artificial Sequence
  Synthetic Construct
gcccaattggtgaatcagcctcagtcggcacag

SEQ ID NO: 4548 - DNA, 33 bp, Artificial Sequence
  Synthetic Construct
gcccaaggtcgtgcggaggtggggattgcacag

SEQ ID NO: 4549 - DNA, 33 bp, Artificial Sequence
  Synthetic Construct
gcccaagtcctcgccaccaaaaacagcgcacag

SEQ ID NO: 4550 - DNA, 33 bp, Artificial Sequence
  Synthetic Construct
gcccaacaggctcatgcgtttgcggatgcacag

SEQ ID NO: 4551 - DNA, 33 bp, Artificial Sequence
  Synthetic Construct
gcccaaaacctcgacaccgtcaaaaccgcacag

SEQ ID NO: 4552 - DNA, 33 bp, Artificial Sequence
  Synthetic Construct
gcccaacgtccgcagactctgccgaatgcacag

SEQ ID NO: 4553 - DNA, 33 bp, Artificial Sequence
  Synthetic Construct
gcccaaaaccccagaaacagccccaccgcacag

SEQ ID NO: 4554 - DNA, 33 bp, Artificial Sequence
  Synthetic Construct
gcccaacatgtgcagatggatgcggatgcacag

SEQ ID NO: 4555 - DNA, 33 bp, Artificial Sequence
  Synthetic Construct
gcccaaacttatcggactgagccggtggcacag

SEQ ID NO: 4556 - DNA, 33 bp, Artificial Sequence
  Synthetic Construct
gcccaacccggcctcgtcaacatgagcgcacag

SEQ ID NO: 4557 - DNA, 33 bp, Artificial Sequence
  Synthetic Construct
gcccaaagcctcagccaaggccccgccgcacag

SEQ ID NO: 4558 - DNA, 33 bp, Artificial Sequence
  Synthetic Construct
gcccaactgggtgcttctggttatacggcacag

SEQ ID NO: 4559 - DNA, 33 bp, Artificial Sequence
  Synthetic Construct
gcccaaagcgccgtcaccaccatgcccgcacag

SEQ ID NO: 4560 - DNA, 33 bp, Artificial Sequence
  Synthetic Construct
gcccaaaaggtgaatgctgagcttcttgcacag

SEQ ID NO: 4561 - DNA, 33 bp, Artificial Sequence
  Synthetic Construct
gcccaaccgtttacgcctaagttgagtgcacag

SEQ ID NO: 4562 - DNA, 33 bp, Artificial Sequence
  Synthetic Construct
gcccaaatgagaagcaccaacgccagcgcacag

SEQ ID NO: 4563 - DNA, 33 bp, Artificial Sequence
  Synthetic Construct
gcccaagtgatgtatgcgcgtggggatgcacag

SEQ ID NO: 4564 - DNA, 33 bp, Artificial Sequence
  Synthetic Construct
gcccaacgggttggtagtacgatgcaggcacag

SEQ ID NO: 4565 - DNA, 33 bp, Artificial Sequence
  Synthetic Construct
gcccaattgacggtggcggttgagactgcacag

SEQ ID NO: 4566 - DNA, 33 bp, Artificial Sequence
  Synthetic Construct
gcccaatggactaattctggtagttctgcacag

SEQ ID NO: 4567 - DNA, 33 bp, Artificial Sequence
  Synthetic Construct
gcccaacacgccatgagaggcaccggcgcacag

SEQ ID NO: 4568 - DNA, 33 bp, Artificial Sequence
  Synthetic Construct
gcccaacaccaagacgtcagaggcagcgcacag

SEQ ID NO: 4569 - DNA, 33 bp, Artificial Sequence
  Synthetic Construct
gcccaaagcttccaaagagaaatccccgcacag

SEQ ID NO: 4570 - DNA, 33 bp, Artificial Sequence
  Synthetic Construct
gcccaactccaaagagccgccctcaacgcacag

SEQ ID NO: 4571 - DNA, 33 bp, Artificial Sequence
  Synthetic Construct
gcccaaagcgacgccaccatcagacccgcacag

SEQ ID NO: 4572 - DNA, 33 bp, Artificial Sequence
  Synthetic Construct
gcccaacaaatgagcaccggcagagtcgcacag

SEQ ID NO: 4573 - DNA, 33 bp, Artificial Sequence
  Synthetic Construct
gcccaaagaagcacccaagccatccccgcacag

SEQ ID NO: 4574 - DNA, 33 bp, Artificial Sequence
  Synthetic Construct
gcccaacaaatcagagacgccaacgccgcacag

SEQ ID NO: 4575 - DNA, 33 bp, Artificial Sequence
  Synthetic Construct
gcccaactccacaccagcaacgcctacgcacag

SEQ ID NO: 4576 - DNA, 33 bp, Artificial Sequence
  Synthetic Construct
gcccaatcttctgggctggggacgcctgcacag

SEQ ID NO: 4577 - DNA, 33 bp, Artificial Sequence
  Synthetic Construct
gcccaagaccacaaacccgtcagagacgcacag

SEQ ID NO: 4578 - DNA, 33 bp, Artificial Sequence
  Synthetic Construct
gcccaaatgaaactcgtcagcgtcggcgcacag

SEQ ID NO: 4579 - DNA, 33 bp, Artificial Sequence
  Synthetic Construct
gcccaaggtgagcagagtcttaaggcggcacag

SEQ ID NO: 4580 - DNA, 33 bp, Artificial Sequence
  Synthetic Construct
gcccaaatgaccagcggcaccaacggcgcacag

SEQ ID NO: 4581 - DNA, 33 bp, Artificial Sequence
  Synthetic Construct
gcccaacatgcggctaagggtgttgttgcacag

SEQ ID NO: 4582 - DNA, 33 bp, Artificial Sequence
  Synthetic Construct
gcccaaagcagcagacaaaacgaacccgcacag

SEQ ID NO: 4583 - DNA, 33 bp, Artificial Sequence
  Synthetic Construct
gcccaagccctcatcaacagacccaacgcacag

SEQ ID NO: 4584 - DNA, 33 bp, Artificial Sequence
  Synthetic Construct
gcccaattgaggtcttctatggcgtctgcacag

SEQ ID NO: 4585 - DNA, 33 bp, Artificial Sequence
  Synthetic Construct
gcccaaaataatgagtattcgaagctggcacag

SEQ ID NO: 4586 - DNA, 33 bp, Artificial Sequence
  Synthetic Construct
gcccaaactgggcgtttgaatggggaggcacag

SEQ ID NO: 4587 - DNA, 33 bp, Artificial Sequence
  Synthetic Construct
gcccaaaccaacagccacgccgtcagagcacag

SEQ ID NO: 4588 - DNA, 33 bp, Artificial Sequence
  Synthetic Construct
gcccaaatcgtcaccaaccacagccacgcacag

SEQ ID NO: 4589 - DNA, 33 bp, Artificial Sequence
  Synthetic Construct
gcccaagccctcaccagagacatcaccgcacag

SEQ ID NO: 4590 - DNA, 33 bp, Artificial Sequence
  Synthetic Construct
gcccaaggcatcgccaaccaaggcgtcgcacag

SEQ ID NO: 4591 - DNA, 33 bp, Artificial Sequence
  Synthetic Construct
gcccaaaatactgtgcgttctcagcaggcacag

SEQ ID NO: 4592 - DNA, 33 bp, Artificial Sequence
  Synthetic Construct
gcccaaatggagaattcgaataaggctgcacag

SEQ ID NO: 4593 - DNA, 33 bp, Artificial Sequence
  Synthetic Construct
gcccaaggtacggttagggtgcaggctgcacag

SEQ ID NO: 4594 - DNA, 33 bp, Artificial Sequence
  Synthetic Construct
gcccaaaccaccagccacctcatcgacgcacag

SEQ ID NO: 4595 - DNA, 33 bp, Artificial Sequence
  Synthetic Construct
gcccaaggtacgcaggcgcatcagggtgcacag

SEQ ID NO: 4596 - DNA, 33 bp, Artificial Sequence
  Synthetic Construct
gcccaaaaaatgagcgccagcagcgtcgcacag

SEQ ID NO: 4597 - DNA, 33 bp, Artificial Sequence
  Synthetic Construct
gcccaaagcctcaaagtcaaccccggcgcacag

SEQ ID NO: 4598 - DNA, 33 bp, Artificial Sequence
  Synthetic Construct
gcccaatcgactgggacgtctactcttgcacag

SEQ ID NO: 4599 - DNA, 33 bp, Artificial Sequence
  Synthetic Construct
gcccaagttttgacgaatcgtgagcaggcacag

SEQ ID NO: 4600 - DNA, 33 bp, Artificial Sequence
  Synthetic Construct
gcccaactcgacgtcagcagaaccctcgcacag

SEQ ID NO: 4601 - DNA, 33 bp, Artificial Sequence
  Synthetic Construct
gcccaatcgtttgggactgagagtcgtgcacag

SEQ ID NO: 4602 - DNA, 33 bp, Artificial Sequence
  Synthetic Construct
gcccaacagcttgcgaaggggaattatgcacag

SEQ ID NO: 4603 - DNA, 33 bp, Artificial Sequence
  Synthetic Construct
gcccaagccaaaaacgaccccagagccgcacag

SEQ ID NO: 4604 - DNA, 33 bp, Artificial Sequence
  Synthetic Construct
gcccaactcacccaagtcggcggcaccgcacag

SEQ ID NO: 4605 - DNA, 33 bp, Artificial Sequence
  Synthetic Construct
gcccaaaagcagaatactacttctctggcacag

SEQ ID NO: 4606 - DNA, 33 bp, Artificial Sequence
  Synthetic Construct
gcccaactttcgactagggctgaggatgcacag

SEQ ID NO: 4607 - DNA, 33 bp, Artificial Sequence
  Synthetic Construct
gcccaaaccgtccccaacatccccatggcacag

SEQ ID NO: 4608 - DNA, 33 bp, Artificial Sequence
  Synthetic Construct
gcccaaaattcgttgtctaagctgtcggcacag

SEQ ID NO: 4609 - DNA, 33 bp, Artificial Sequence
  Synthetic Construct
gcccaaatgaatgagcatcagatgaaggcacag

SEQ ID NO: 4610 - DNA, 33 bp, Artificial Sequence
  Synthetic Construct
gcccaagacgtcaaaggccaccaaagcgcacag

SEQ ID NO: 4611 - DNA, 33 bp, Artificial Sequence
  Synthetic Construct
gcccaagacgtcagcctccaaaaagacgcacag

SEQ ID NO: 4612 - DNA, 33 bp, Artificial Sequence
  Synthetic Construct
gcccaaaccagacccagcggcacctacgcacag

SEQ ID NO: 4613 - DNA, 33 bp, Artificial Sequence
  Synthetic Construct
gcccaagttaaggggccggattctcttgcacag

SEQ ID NO: 4614 - DNA, 33 bp, Artificial Sequence
  Synthetic Construct
gcccaaaaccacagcagctacgaactcgcacag

SEQ ID NO: 4615 - DNA, 33 bp, Artificial Sequence
  Synthetic Construct
gcccaaaccgtcagaacccccctcatcgcacag

SEQ ID NO: 4616 - DNA, 33 bp, Artificial Sequence
  Synthetic Construct
gcccaagccagcatcgacagccaacacgcacag

SEQ ID NO: 4617 - DNA, 33 bp, Artificial Sequence
  Synthetic Construct
gcccaagatcagaagaattctgggcatgcacag

SEQ ID NO: 4618 - DNA, 33 bp, Artificial Sequence
  Synthetic Construct
gcccaactcgacaccaacaacaaagccgcacag

SEQ ID NO: 4619 - DNA, 33 bp, Artificial Sequence
  Synthetic Construct
gcccaagcgagtgctcatgcgcaggttgcacag

SEQ ID NO: 4620 - DNA, 33 bp, Artificial Sequence
  Synthetic Construct
gcccaagacagcggcaaacacaacgacgcacag

SEQ ID NO: 4621 - DNA, 33 bp, Artificial Sequence
  Synthetic Construct
gcccaacttaatcggaatagtggtatggcacag

SEQ ID NO: 4622 - DNA, 33 bp, Artificial Sequence
  Synthetic Construct
gcccaacccaccatgctccccgacaaagcacag

SEQ ID NO: 4623 - DNA, 33 bp, Artificial Sequence
  Synthetic Construct
gcccaaagcacccaagtcagcaactacgcacag

SEQ ID NO: 4624 - DNA, 33 bp, Artificial Sequence
  Synthetic Construct
gcccaatctaatcagacgctgatgagtgcacag

SEQ ID NO: 4625 - DNA, 33 bp, Artificial Sequence
  Synthetic Construct
gcccaaagaaaccccggcagcaccagcgcacag

SEQ ID NO: 4626 - DNA, 33 bp, Artificial Sequence
  Synthetic Construct
gcccaacgtatggctcagggttatagtgcacag

SEQ ID NO: 4627 - DNA, 33 bp, Artificial Sequence
  Synthetic Construct
gcccaacaggttatgcgtcagagtagtgcacag

SEQ ID NO: 4628 - DNA, 33 bp, Artificial Sequence
  Synthetic Construct
gcccaaaagaatacgacggttagtgatgcacag

SEQ ID NO: 4629 - DNA, 33 bp, Artificial Sequence
  Synthetic Construct
gcccaaaccggcaaaaccgccagagacgcacag

SEQ ID NO: 4630 - DNA, 33 bp, Artificial Sequence
  Synthetic Construct
gcccaaatcctcagaaccctcaccgaagcacag

SEQ ID NO: 4631 - DNA, 33 bp, Artificial Sequence
  Synthetic Construct
gcccaaagactcgacaacgccggcatggcacag

SEQ ID NO: 4632 - DNA, 33 bp, Artificial Sequence
  Synthetic Construct
gcccaaagtggtactggtaggcagcaggcacag

SEQ ID NO: 4633 - DNA, 33 bp, Artificial Sequence
  Synthetic Construct
gcccaactcggcaaagacaccttcagcgcacag

SEQ ID NO: 4634 - DNA, 33 bp, Artificial Sequence
  Synthetic Construct
gcccaacggtatgatgggtctgtggctgcacag

SEQ ID NO: 4635 - DNA, 33 bp, Artificial Sequence
  Synthetic Construct
gcccaagcccactaccccgccagcaccgcacag

SEQ ID NO: 4636 - DNA, 33 bp, Artificial Sequence
  Synthetic Construct
gcccaaaaaagcaacggcagccccctcgcacag

SEQ ID NO: 4637 - DNA, 33 bp, Artificial Sequence
  Synthetic Construct
gcccaaagagacctcgtcctcaccaaagcacag

SEQ ID NO: 4638 - DNA, 33 bp, Artificial Sequence
  Synthetic Construct
gcccaaaccagcaaccccggcaacatggcacag

SEQ ID NO: 4639 - DNA, 33 bp, Artificial Sequence
  Synthetic Construct
gcccaattgccgaggccgagtaatacggcacag

SEQ ID NO: 4640 - DNA, 33 bp, Artificial Sequence
  Synthetic Construct
gcccaaaccggcggcggcagcttcagcgcacag

SEQ ID NO: 4641 - DNA, 33 bp, Artificial Sequence
  Synthetic Construct
gcccaataccccaacaaagaactcagcgcacag

SEQ ID NO: 4642 - DNA, 33 bp, Artificial Sequence
  Synthetic Construct
gcccaaacgatggtgcatcaggagtctgcacag

SEQ ID NO: 4643 - DNA, 33 bp, Artificial Sequence
  Synthetic Construct
gcccaagttaatagtaataattcgatggcacag

SEQ ID NO: 4644 - DNA, 33 bp, Artificial Sequence
  Synthetic Construct
gcccaaaacggcgtccacgtcacccccgcacag

SEQ ID NO: 4645 - DNA, 33 bp, Artificial Sequence
  Synthetic Construct
gcccaagccaaatacctcaacagcaacgcacag

SEQ ID NO: 4646 - DNA, 33 bp, Artificial Sequence
  Synthetic Construct
gcccaaggtatgacgaagaatggtggggcacag

SEQ ID NO: 4647 - DNA, 33 bp, Artificial Sequence
  Synthetic Construct
gcccaacgggcgcgtgatgagggtatggcacag

SEQ ID NO: 4648 - DNA, 33 bp, Artificial Sequence
  Synthetic Construct
gcccaagtccccagccccggcgccaccgcacag

SEQ ID NO: 4649 - DNA, 33 bp, Artificial Sequence
  Synthetic Construct
gcccaaaaaacccaactcggccaaatggcacag

SEQ ID NO: 4650 - DNA, 33 bp, Artificial Sequence
  Synthetic Construct
gcccaatctacttcgacgattcagccggcacag

SEQ ID NO: 4651 - DNA, 33 bp, Artificial Sequence
  Synthetic Construct
gcccaacgtaaggagaatgctagttatgcacag

SEQ ID NO: 4652 - DNA, 33 bp, Artificial Sequence
  Synthetic Construct
gcccaactgacgaatcatgggaatgttgcacag

SEQ ID NO: 4653 - DNA, 33 bp, Artificial Sequence
  Synthetic Construct
gcccaactcgacaacgtccacagccacgcacag

SEQ ID NO: 4654 - DNA, 33 bp, Artificial Sequence
  Synthetic Construct
gcccaacccaccatggccgtcacccccgcacag

SEQ ID NO: 4655 - DNA, 33 bp, Artificial Sequence
  Synthetic Construct
gcccaaaagcctgagcgtactgaggcggcacag

SEQ ID NO: 4656 - DNA, 33 bp, Artificial Sequence
  Synthetic Construct
gcccaaaccggcgacagaaaaagcggcgcacag

SEQ ID NO: 4657 - DNA, 33 bp, Artificial Sequence
  Synthetic Construct
gcccaagctaagcatacttcgtttcctgcacag

SEQ ID NO: 4658 - DNA, 33 bp, Artificial Sequence
  Synthetic Construct
gcccaagggttggttgcgtcgttgggggcacag

SEQ ID NO: 4659 - DNA, 33 bp, Artificial Sequence
  Synthetic Construct
gcccaatctgttcctaggtcggagttggcacag

SEQ ID NO: 4660 - DNA, 33 bp, Artificial Sequence
  Synthetic Construct
gcccaagctgagaggattggtatgggtgcacag

SEQ ID NO: 4661 - DNA, 33 bp, Artificial Sequence
  Synthetic Construct
gcccaatctctggttcggcagtctgatgcacag

SEQ ID NO: 4662 - DNA, 33 bp, Artificial Sequence
  Synthetic Construct
gcccaacacgtcaaagccaaccccatcgcacag

SEQ ID NO: 4663 - DNA, 33 bp, Artificial Sequence
  Synthetic Construct
gcccaagtcgtcgacaccctcaaaaacgcacag

SEQ ID NO: 4664 - DNA, 33 bp, Artificial Sequence
  Synthetic Construct
gcccaacagattccttataattcgtcggcacag

SEQ ID NO: 4665 - DNA, 33 bp, Artificial Sequence
  Synthetic Construct
gcccaagctgatcattctatgcatgttgcacag

SEQ ID NO: 4666 - DNA, 33 bp, Artificial Sequence
  Synthetic Construct
gcccaaaaccacgtcaccgcccaagccgcacag

SEQ ID NO: 4667 - DNA, 33 bp, Artificial Sequence
  Synthetic Construct
gcccaaaccaacttcaccaaaagcggcgcacag

SEQ ID NO: 4668 - DNA, 33 bp, Artificial Sequence
  Synthetic Construct
gcccaatatggtcattcgatgactaatgcacag

SEQ ID NO: 4669 - DNA, 33 bp, Artificial Sequence
  Synthetic Construct
gcccaaatgagacccgacctcaaaaccgcacag

SEQ ID NO: 4670 - DNA, 33 bp, Artificial Sequence
  Synthetic Construct
gcccaaggccccggcaccagcttcaaagcacag

SEQ ID NO: 4671 - DNA, 33 bp, Artificial Sequence
  Synthetic Construct
gcccaaagttctacgactcctgggcttgcacag

SEQ ID NO: 4672 - DNA, 33 bp, Artificial Sequence
  Synthetic Construct
gcccaatcggtgaaggctaatcctactgcacag

SEQ ID NO: 4673 - DNA, 33 bp, Artificial Sequence
  Synthetic Construct
gcccaaacccccaccgtcttcacccccgcacag

SEQ ID NO: 4674 - DNA, 33 bp, Artificial Sequence
  Synthetic Construct
gcccaaatgctgcctagtcctgggtcggcacag

SEQ ID NO: 4675 - DNA, 33 bp, Artificial Sequence
  Synthetic Construct
gcccaaaacttcgactacgccaaacccgcacag

SEQ ID NO: 4676 - DNA, 33 bp, Artificial Sequence
  Synthetic Construct
gcccaaaccctcaacaccagccccatggcacag

SEQ ID NO: 4677 - DNA, 33 bp, Artificial Sequence
  Synthetic Construct
gcccaaaccaacagccccaaaagcaccgcacag

SEQ ID NO: 4678 - DNA, 33 bp, Artificial Sequence
  Synthetic Construct
gcccaagtcacccccggcagatacagcgcacag

SEQ ID NO: 4679 - DNA, 33 bp, Artificial Sequence
  Synthetic Construct
gcccaaaccagagtcagcaacctcgacgcacag

SEQ ID NO: 4680 - DNA, 33 bp, Artificial Sequence
  Synthetic Construct
gcccaaagtcatggtcctgataggacggcacag

SEQ ID NO: 4681 - DNA, 33 bp, Artificial Sequence
  Synthetic Construct
gcccaaaatattcatacggctacgactgcacag

SEQ ID NO: 4682 - DNA, 33 bp, Artificial Sequence
  Synthetic Construct
gcccaattgcttccgcagactacgcttgcacag

SEQ ID NO: 4683 - DNA, 33 bp, Artificial Sequence
  Synthetic Construct
gcccaacgtactaatgatacttcggcggcacag

SEQ ID NO: 4684 - DNA, 33 bp, Artificial Sequence
  Synthetic Construct
gcccaagaaagaaacggcagccacgaagcacag

SEQ ID NO: 4685 - DNA, 33 bp, Artificial Sequence
  Synthetic Construct
gcccaaaacaccagagaagccttcatcgcacag

SEQ ID NO: 4686 - DNA, 33 bp, Artificial Sequence
  Synthetic Construct
gcccaagtcggccaatacgccagccccgcacag

SEQ ID NO: 4687 - DNA, 33 bp, Artificial Sequence
  Synthetic Construct
gcccaagtcgccgaaaccggcagaaccgcacag

SEQ ID NO: 4688 - DNA, 33 bp, Artificial Sequence
  Synthetic Construct
gcccaaatgagcgccggcagcaacagcgcacag

SEQ ID NO: 4689 - DNA, 33 bp, Artificial Sequence
  Synthetic Construct
gcccaactcagccccaaaaacgcccaagcacag

SEQ ID NO: 4690 - DNA, 33 bp, Artificial Sequence
  Synthetic Construct
gcccaaagcggcaccagccaactccccgcacag

SEQ ID NO: 4691 - DNA, 33 bp, Artificial Sequence
  Synthetic Construct
gcccaaagactccaagacaaaccccaagcacag

SEQ ID NO: 4692 - DNA, 33 bp, Artificial Sequence
  Synthetic Construct
gcccaaaacgtccccagaagcagcgtcgcacag

SEQ ID NO: 4693 - DNA, 33 bp, Artificial Sequence
  Synthetic Construct
gcccaagccctcggcagccccagacccgcacag

SEQ ID NO: 4694 - DNA, 33 bp, Artificial Sequence
  Synthetic Construct
gcccaagcgaaggagcctatgagtgcggcacag

SEQ ID NO: 4695 - DNA, 33 bp, Artificial Sequence
  Synthetic Construct
gcccaagccgtcagcggcgccgcccacgcacag

SEQ ID NO: 4696 - DNA, 33 bp, Artificial Sequence
  Synthetic Construct
gcccaatacaacaacaaaagcgccgccgcacag

SEQ ID NO: 4697 - DNA, 33 bp, Artificial Sequence
  Synthetic Construct
gcccaacaagtcagcgtcagaaacctcgcacag

SEQ ID NO: 4698 - DNA, 33 bp, Artificial Sequence
  Synthetic Construct
gcccaaaagggtactcatcctccggctgcacag

SEQ ID NO: 4699 - DNA, 33 bp, Artificial Sequence
  Synthetic Construct
gcccaacagtatcctaatagtaaggttgcacag

SEQ ID NO: 4700 - DNA, 33 bp, Artificial Sequence
  Synthetic Construct
gcccaacataatgcttcgaattctggggcacag

SEQ ID NO: 4701 - DNA, 33 bp, Artificial Sequence
  Synthetic Construct
gcccaagaactcaaccccaaattcatcgcacag

SEQ ID NO: 4702 - DNA, 33 bp, Artificial Sequence
  Synthetic Construct
gcccaatcgcgtgagactcctgggactgcacag

SEQ ID NO: 4703 - DNA, 33 bp, Artificial Sequence
  Synthetic Construct
gcccaaaattttaagccgcagaatgaggcacag

SEQ ID NO: 4704 - DNA, 33 bp, Artificial Sequence
  Synthetic Construct
gcccaagctatgacttcggggtcggcggcacag

SEQ ID NO: 4705 - DNA, 33 bp, Artificial Sequence
  Synthetic Construct
gcccaaaaggatccgaggagtacgttggcacag

SEQ ID NO: 4706 - DNA, 33 bp, Artificial Sequence
  Synthetic Construct
gcccaagacagaggcaccagaaccgtcgcacag

SEQ ID NO: 4707 - DNA, 33 bp, Artificial Sequence
  Synthetic Construct
gcccaaagcctcgccagaaacaacgtcgcacag

SEQ ID NO: 4708 - DNA, 33 bp, Artificial Sequence
  Synthetic Construct
gcccaagccatcagattcaacgaacccgcacag

SEQ ID NO: 4709 - DNA, 33 bp, Artificial Sequence
  Synthetic Construct
gcccaacaacaccacatcgccacccccgcacag

SEQ ID NO: 4710 - DNA, 33 bp, Artificial Sequence
  Synthetic Construct
gcccaacagattttgagggagccggtggcacag

SEQ ID NO: 4711 - DNA, 33 bp, Artificial Sequence
  Synthetic Construct
gcccaaactgttgttaataagcttagtgcacag

SEQ ID NO: 4712 - DNA, 33 bp, Artificial Sequence
  Synthetic Construct
gcccaaagagacaacaccaccaaattcgcacag

SEQ ID NO: 4713 - DNA, 33 bp, Artificial Sequence
  Synthetic Construct
gcccaaagcctcctcagcaccctcggcgcacag

SEQ ID NO: 4714 - DNA, 33 bp, Artificial Sequence
  Synthetic Construct
gcccaaggccaagtccccgtcaccagagcacag

SEQ ID NO: 4715 - DNA, 33 bp, Artificial Sequence
  Synthetic Construct
gcccaaatccaaaacagcctcatgcccgcacag

SEQ ID NO: 4716 - DNA, 33 bp, Artificial Sequence
  Synthetic Construct
gcccaacagcataatacgcagaatactgcacag

SEQ ID NO: 4717 - DNA, 33 bp, Artificial Sequence
  Synthetic Construct
gcccaagtcggccccaccatgacccacgcacag

SEQ ID NO: 4718 - DNA, 33 bp, Artificial Sequence
  Synthetic Construct
gcccaaaccaacgtcaccatggccagagcacag

SEQ ID NO: 4719 - DNA, 33 bp, Artificial Sequence
  Synthetic Construct
gcccaaagcgcccacttcaccggcaccgcacag

SEQ ID NO: 4720 - DNA, 33 bp, Artificial Sequence
  Synthetic Construct
gcccaaagatacagcgtcaacgacaaagcacag

SEQ ID NO: 4721 - DNA, 33 bp, Artificial Sequence
  Synthetic Construct
gcccaagtctacaaaagcgccgaccccgcacag

SEQ ID NO: 4722 - DNA, 33 bp, Artificial Sequence
  Synthetic Construct
gcccaagtccacaccgccctccccatggcacag

SEQ ID NO: 4723 - DNA, 33 bp, Artificial Sequence
  Synthetic Construct
gcccaaactattagtagtgctggtattgcacag

SEQ ID NO: 4724 - DNA, 33 bp, Artificial Sequence
  Synthetic Construct
gcccaaaggttgccttcgactcaggcggcacag

SEQ ID NO: 4725 - DNA, 33 bp, Artificial Sequence
  Synthetic Construct
gcccaaagccaagaaagagccatgagcgcacag

SEQ ID NO: 4726 - DNA, 33 bp, Artificial Sequence
  Synthetic Construct
gcccaaatgaatcagcttgcgaatcctgcacag

SEQ ID NO: 4727 - DNA, 33 bp, Artificial Sequence
  Synthetic Construct
gcccaatttggggcgactagtgggcaggcacag

SEQ ID NO: 4728 - DNA, 33 bp, Artificial Sequence
  Synthetic Construct
gcccaaacgcttcttcgttctcctgctgcacag

SEQ ID NO: 4729 - DNA, 33 bp, Artificial Sequence
  Synthetic Construct
gcccaacttaggtcgaatgtgtcgaatgcacag

SEQ ID NO: 4730 - DNA, 33 bp, Artificial Sequence
  Synthetic Construct
gcccaaatcgccaacagccaagccgccgcacag

SEQ ID NO: 4731 - DNA, 33 bp, Artificial Sequence
  Synthetic Construct
gcccaatctaatcgtattgtgcctgttgcacag

SEQ ID NO: 4732 - DNA, 33 bp, Artificial Sequence
  Synthetic Construct
gcccaatctccgaatccttctaatgcggcacag

SEQ ID NO: 4733 - DNA, 33 bp, Artificial Sequence
  Synthetic Construct
gcccaaaaatgggacagcgccaacgaagcacag

SEQ ID NO: 4734 - DNA, 33 bp, Artificial Sequence
  Synthetic Construct
gcccaagcttctcgtcagggtgaggctgcacag

SEQ ID NO: 4735 - DNA, 33 bp, Artificial Sequence
  Synthetic Construct
gcccaagttcctgggaatagtcctcatgcacag

SEQ ID NO: 4736 - DNA, 33 bp, Artificial Sequence
  Synthetic Construct
gcccaaagcgccaccaccaacagcgtcgcacag

SEQ ID NO: 4737 - DNA, 33 bp, Artificial Sequence
  Synthetic Construct
gcccaacacatcggcgccagacaagtcgcacag

SEQ ID NO: 4738 - DNA, 33 bp, Artificial Sequence
  Synthetic Construct
gcccaacttacggatcgttctcctatggcacag

SEQ ID NO: 4739 - DNA, 33 bp, Artificial Sequence
  Synthetic Construct
gcccaaaatccgacgcaggctgttttggcacag

SEQ ID NO: 4740 - DNA, 33 bp, Artificial Sequence
  Synthetic Construct
gcccaaaccaaaaacgaaaccggcaccgcacag

SEQ ID NO: 4741 - DNA, 33 bp, Artificial Sequence
  Synthetic Construct
gcccaactcaccgccaccctcaccagcgcacag

SEQ ID NO: 4742 - DNA, 33 bp, Artificial Sequence
  Synthetic Construct
gcccaatataaggctagttatgctgcggcacag

SEQ ID NO: 4743 - DNA, 33 bp, Artificial Sequence
  Synthetic Construct
gcccaaactcttcctgataaggtgtcggcacag

SEQ ID NO: 4744 - DNA, 33 bp, Artificial Sequence
  Synthetic Construct
gcccaaaataatcatattcctttggctgcacag

SEQ ID NO: 4745 - DNA, 33 bp, Artificial Sequence
  Synthetic Construct
gcccaatctaatctgacgtctaatcctgcacag

SEQ ID NO: 4746 - DNA, 33 bp, Artificial Sequence
  Synthetic Construct
gcccaacaacaaaacgacagaaacgccgcacag

SEQ ID NO: 4747 - DNA, 33 bp, Artificial Sequence
  Synthetic Construct
gcccaaatgctcagcaccaacagaagcgcacag

SEQ ID NO: 4748 - DNA, 33 bp, Artificial Sequence
  Synthetic Construct
gcccaaatcaccagcgccaccctcagcgcacag

SEQ ID NO: 4749 - DNA, 33 bp, Artificial Sequence
  Synthetic Construct
gcccaagtcgacgccatgcaaagacccgcacag

SEQ ID NO: 4750 - DNA, 33 bp, Artificial Sequence
  Synthetic Construct
gcccaaagagaagccaactacgccagcgcacag

SEQ ID NO: 4751 - DNA, 33 bp, Artificial Sequence
  Synthetic Construct
gcccaacgtagtaataatgctgatctggcacag

SEQ ID NO: 4752 - DNA, 33 bp, Artificial Sequence
  Synthetic Construct
gcccaaggcctcgacaaaatgggcagcgcacag

SEQ ID NO: 4753 - DNA, 33 bp, Artificial Sequence
  Synthetic Construct
gcccaattcaccaccagccacgcccccgcacag

SEQ ID NO: 4754 - DNA, 33 bp, Artificial Sequence
  Synthetic Construct
gcccaagacaaaagcgtcaaattcgccgcacag

SEQ ID NO: 4755 - DNA, 33 bp, Artificial Sequence
  Synthetic Construct
gcccaacacgccaaaaaagaactccaagcacag

SEQ ID NO: 4756 - DNA, 33 bp, Artificial Sequence
  Synthetic Construct
gcccaagtcgaaagcaaaggcgccagcgcacag

SEQ ID NO: 4757 - DNA, 33 bp, Artificial Sequence
  Synthetic Construct
gcccaaaaaaccgcccccagcatgggcgcacag

SEQ ID NO: 4758 - DNA, 33 bp, Artificial Sequence
  Synthetic Construct
gcccaaggcctcagaaccgacaacagagcacag

SEQ ID NO: 4759 - DNA, 33 bp, Artificial Sequence
  Synthetic Construct
gcccaacgtattgcggggaataatcctgcacag

SEQ ID NO: 4760 - DNA, 33 bp, Artificial Sequence
  Synthetic Construct
gcccaaaaagacccccaccaagtcgtcgcacag

SEQ ID NO: 4761 - DNA, 33 bp, Artificial Sequence
  Synthetic Construct
gcccaagagcagactccgcataattcggcacag

SEQ ID NO: 4762 - DNA, 33 bp, Artificial Sequence
  Synthetic Construct
gcccaagggctggataaggggaattgggcacag

SEQ ID NO: 4763 - DNA, 33 bp, Artificial Sequence
  Synthetic Construct
gcccaaccttcgaatgggaattattcggcacag

SEQ ID NO: 4764 - DNA, 33 bp, Artificial Sequence
  Synthetic Construct
gcccaaggcagacccggcatcggcagcgcacag

SEQ ID NO: 4765 - DNA, 33 bp, Artificial Sequence
  Synthetic Construct
gcccaaaggacgtctcctggggtgtcggcacag

SEQ ID NO: 4766 - DNA, 33 bp, Artificial Sequence
  Synthetic Construct
gcccaagtcaacgccagcctcatcagcgcacag

SEQ ID NO: 4767 - DNA, 33 bp, Artificial Sequence
  Synthetic Construct
gcccaaaaaaccagcaccaacctccaagcacag

SEQ ID NO: 4768 - DNA, 33 bp, Artificial Sequence
  Synthetic Construct
gcccaaatggatatgaagcagaatatggcacag

SEQ ID NO: 4769 - DNA, 33 bp, Artificial Sequence
  Synthetic Construct
gcccaagatcttaatgggattaatgttgcacag

SEQ ID NO: 4770 - DNA, 33 bp, Artificial Sequence
  Synthetic Construct
gcccaacgtacgcctccgagttttgaggcacag

SEQ ID NO: 4771 - DNA, 33 bp, Artificial Sequence
  Synthetic Construct
gcccaagacttccacgacagaaaaggcgcacag

SEQ ID NO: 4772 - DNA, 33 bp, Artificial Sequence
  Synthetic Construct
gcccaactccacacccaaacccaaaccgcacag

SEQ ID NO: 4773 - DNA, 33 bp, Artificial Sequence
  Synthetic Construct
gcccaactcggcgccagcaacaacgccgcacag

SEQ ID NO: 4774 - DNA, 33 bp, Artificial Sequence
  Synthetic Construct
gcccaaatcgccagcgtccccagagacgcacag

SEQ ID NO: 4775 - DNA, 33 bp, Artificial Sequence
  Synthetic Construct
gcccaaaaagccaaagacgtcggcgacgcacag

SEQ ID NO: 4776 - DNA, 33 bp, Artificial Sequence
  Synthetic Construct
gcccaaagcgccttcgccgccaaacaagcacag

SEQ ID NO: 4777 - DNA, 33 bp, Artificial Sequence
  Synthetic Construct
gcccaagtctaccaaggccaacacctcgcacag

SEQ ID NO: 4778 - DNA, 33 bp, Artificial Sequence
  Synthetic Construct
gcccaatacctccccgccgccagcagcgcacag

SEQ ID NO: 4779 - DNA, 33 bp, Artificial Sequence
  Synthetic Construct
gcccaaagccccagcaccgtcatcagcgcacag

SEQ ID NO: 4780 - DNA, 33 bp, Artificial Sequence
  Synthetic Construct
gcccaaggcaccaacaaaccccccgacgcacag

SEQ ID NO: 4781 - DNA, 33 bp, Artificial Sequence
  Synthetic Construct
gcccaagaaagcaccggcgccatcagagcacag

SEQ ID NO: 4782 - DNA, 33 bp, Artificial Sequence
  Synthetic Construct
gcccaactcatgaacaccaccatcgccgcacag

SEQ ID NO: 4783 - DNA, 33 bp, Artificial Sequence
  Synthetic Construct
gcccaaatggcgggtgttgctcagcctgcacag

SEQ ID NO: 4784 - DNA, 33 bp, Artificial Sequence
  Synthetic Construct
gcccaacggccggagcttaagcgtgaggcacag

SEQ ID NO: 4785 - DNA, 33 bp, Artificial Sequence
  Synthetic Construct
gcccaaaaagcccaagacacccccaccgcacag

SEQ ID NO: 4786 - DNA, 33 bp, Artificial Sequence
  Synthetic Construct
gcccaaagcaccaaccacagcaccagcgcacag

SEQ ID NO: 4787 - DNA, 33 bp, Artificial Sequence
  Synthetic Construct
gcccaattccccagaaccaccaccgacgcacag

SEQ ID NO: 4788 - DNA, 33 bp, Artificial Sequence
  Synthetic Construct
gcccaatcgcgtgctcataatttggatgcacag

SEQ ID NO: 4789 - DNA, 33 bp, Artificial Sequence
  Synthetic Construct
gcccaacgtactattcaggaggggattgcacag

SEQ ID NO: 4790 - DNA, 33 bp, Artificial Sequence
  Synthetic Construct
gcccaaggcggcaaaagcttcgcccaagcacag

SEQ ID NO: 4791 - DNA, 33 bp, Artificial Sequence
  Synthetic Construct
gcccaaggcagacccagcagcacccaagcacag

SEQ ID NO: 4792 - DNA, 33 bp, Artificial Sequence
  Synthetic Construct
gcccaaaaccccctcaacaccagcaccgcacag

SEQ ID NO: 4793 - DNA, 33 bp, Artificial Sequence
  Synthetic Construct
gcccaagaaaacctcagcaacggcagagcacag

SEQ ID NO: 4794 - DNA, 33 bp, Artificial Sequence
  Synthetic Construct
gcccaagagaatactattcggatgagtgcacag

SEQ ID NO: 4795 - DNA, 33 bp, Artificial Sequence
  Synthetic Construct
gcccaaccccccagaagcatgcccatggcacag

SEQ ID NO: 4796 - DNA, 33 bp, Artificial Sequence
  Synthetic Construct
gcccaactcctcagcagcaacctccccgcacag

SEQ ID NO: 4797 - DNA, 33 bp, Artificial Sequence
  Synthetic Construct
gcccaaagagtccaaagcctcaacgaagcacag

SEQ ID NO: 4798 - DNA, 33 bp, Artificial Sequence
  Synthetic Construct
gcccaaccgaggagggcgcaggatgatgcacag

SEQ ID NO: 4799 - DNA, 33 bp, Artificial Sequence
  Synthetic Construct
gcccaacaaggcaacgtcaacgtcggcgcacag

SEQ ID NO: 4800 - DNA, 33 bp, Artificial Sequence
  Synthetic Construct
gcccaaagcggcgaaaccctcagaggcgcacag

SEQ ID NO: 4801 - DNA, 33 bp, Artificial Sequence
  Synthetic Construct
gcccaacacgtcagccacaacaccgacgcacag

SEQ ID NO: 4802 - DNA, 33 bp, Artificial Sequence
  Synthetic Construct
gcccaatttggtggggggtcgctggttgcacag

SEQ ID NO: 4803 - DNA, 33 bp, Artificial Sequence
  Synthetic Construct
gcccaacccagcctcagaagcgaaggcgcacag

SEQ ID NO: 4804 - DNA, 33 bp, Artificial Sequence
  Synthetic Construct
gcccaagtgcgtagtgagaatggtgtggcacag

SEQ ID NO: 4805 - DNA, 33 bp, Artificial Sequence
  Synthetic Construct
gcccaaaccctcaaagtcaccggcgacgcacag

SEQ ID NO: 4806 - DNA, 33 bp, Artificial Sequence
  Synthetic Construct
gcccaagtccccaaagtctacctcgacgcacag

SEQ ID NO: 4807 - DNA, 33 bp, Artificial Sequence
  Synthetic Construct
gcccaaactagtatgcggaatacggaggcacag

SEQ ID NO: 4808 - DNA, 33 bp, Artificial Sequence
  Synthetic Construct
gcccaaggctacagccacggcagcatggcacag

SEQ ID NO: 4809 - DNA, 33 bp, Artificial Sequence
  Synthetic Construct
gcccaagccaccttccccgaaaaacaagcacag

SEQ ID NO: 4810 - DNA, 33 bp, Artificial Sequence
  Synthetic Construct
gcccaaaccggccccacccacggcaccgcacag

SEQ ID NO: 4811 - DNA, 33 bp, Artificial Sequence
  Synthetic Construct
gcccaaaccaacgacagacacgcccccgcacag

SEQ ID NO: 4812 - DNA, 33 bp, Artificial Sequence
  Synthetic Construct
gcccaaagacacctcgccagcgtcgacgcacag

SEQ ID NO: 4813 - DNA, 33 bp, Artificial Sequence
  Synthetic Construct
gcccaaaatatgattcagcctagtaatgcacag

SEQ ID NO: 4814 - DNA, 33 bp, Artificial Sequence
  Synthetic Construct
gcccaaaacctcagcggcagccccgccgcacag

SEQ ID NO: 4815 - DNA, 33 bp, Artificial Sequence
  Synthetic Construct
gcccaacaaaccgtcggccccctccccgcacag

SEQ ID NO: 4816 - DNA, 33 bp, Artificial Sequence
  Synthetic Construct
gcccaagtcggccacctcagcagagacgcacag

SEQ ID NO: 4817 - DNA, 33 bp, Artificial Sequence
  Synthetic Construct
gcccaacaaaacttcaacgccggccacgcacag

SEQ ID NO: 4818 - DNA, 33 bp, Artificial Sequence
  Synthetic Construct
gcccaactcaccggcgccgccagagtcgcacag

SEQ ID NO: 4819 - DNA, 33 bp, Artificial Sequence
  Synthetic Construct
gcccaagggactcgtccgactgcgacggcacag

SEQ ID NO: 4820 - DNA, 33 bp, Artificial Sequence
  Synthetic Construct
gcccaaatgcccctcagcgtcgcccccgcacag

SEQ ID NO: 4821 - DNA, 33 bp, Artificial Sequence
  Synthetic Construct
gcccaagacagagtccaacaattcagcgcacag

SEQ ID NO: 4822 - DNA, 33 bp, Artificial Sequence
  Synthetic Construct
gcccaaaacaacgacaccagcaccaaagcacag

SEQ ID NO: 4823 - DNA, 33 bp, Artificial Sequence
  Synthetic Construct
gcccaaccttcgaagaatactcatattgcacag

SEQ ID NO: 4824 - DNA, 33 bp, Artificial Sequence
  Synthetic Construct
gcccaaccttttaaggctgatgttacggcacag

SEQ ID NO: 4825 - DNA, 33 bp, Artificial Sequence
  Synthetic Construct
gcccaacctaagactcctacttatgtggcacag

SEQ ID NO: 4826 - DNA, 33 bp, Artificial Sequence
  Synthetic Construct
gcccaactcaccaacatgaccacccccgcacag

SEQ ID NO: 4827 - DNA, 33 bp, Artificial Sequence
  Synthetic Construct
gcccaaggtagtaaggtgcatctttctgcacag

SEQ ID NO: 4828 - DNA, 33 bp, Artificial Sequence
  Synthetic Construct
gcccaatctattccgggttataataatgcacag

SEQ ID NO: 4829 - DNA, 33 bp, Artificial Sequence
  Synthetic Construct
gcccaaatgaaaaccgccgaaagctacgcacag

SEQ ID NO: 4830 - DNA, 33 bp, Artificial Sequence
  Synthetic Construct
gcccaaaacggcgacagactcctcaacgcacag

SEQ ID NO: 4831 - DNA, 33 bp, Artificial Sequence
  Synthetic Construct
gcccaaggcaccacccacaccagcctcgcacag

SEQ ID NO: 4832 - DNA, 33 bp, Artificial Sequence
  Synthetic Construct
gcccaactcggccccagcacccaaagcgcacag

SEQ ID NO: 4833 - DNA, 33 bp, Artificial Sequence
  Synthetic Construct
gcccaaatgaacgccctcaccgacaaagcacag

SEQ ID NO: 4834 - DNA, 33 bp, Artificial Sequence
  Synthetic Construct
gcccaaagcagcaaagaaatcagcctcgcacag

SEQ ID NO: 4835 - DNA, 33 bp, Artificial Sequence
  Synthetic Construct
gcccaactcgacaacggcaccaccagagcacag

SEQ ID NO: 4836 - DNA, 33 bp, Artificial Sequence
  Synthetic Construct
gcccaacgtgtgaattttaattcggatgcacag

SEQ ID NO: 4837 - DNA, 33 bp, Artificial Sequence
  Synthetic Construct
gcccaaaacatgcaagccatcagcaacgcacag

SEQ ID NO: 4838 - DNA, 33 bp, Artificial Sequence
  Synthetic Construct
gcccaaaacaccaaccccagaagcatcgcacag

SEQ ID NO: 4839 - DNA, 33 bp, Artificial Sequence
  Synthetic Construct
gcccaaaaaatcaacagcaacagccccgcacag

SEQ ID NO: 4840 - DNA, 33 bp, Artificial Sequence
  Synthetic Construct
gcccaagtccccctcggcaaagccagcgcacag

SEQ ID NO: 4841 - DNA, 33 bp, Artificial Sequence
  Synthetic Construct
gcccaacggctgaatcataattcgcctgcacag

SEQ ID NO: 4842 - DNA, 33 bp, Artificial Sequence
  Synthetic Construct
gcccaacaactcaacaccgtcctccccgcacag

SEQ ID NO: 4843 - DNA, 33 bp, Artificial Sequence
  Synthetic Construct
gcccaagacagcttcggcaaaagcctcgcacag

SEQ ID NO: 4844 - DNA, 33 bp, Artificial Sequence
  Synthetic Construct
gcccaaaagccgcctaagttggttgatgcacag

SEQ ID NO: 4845 - DNA, 33 bp, Artificial Sequence
  Synthetic Construct
gcccaacaaatcaccgtcggcaaacccgcacag

SEQ ID NO: 4846 - DNA, 33 bp, Artificial Sequence
  Synthetic Construct
gcccaacaacacccccacggccaacaagcacag

SEQ ID NO: 4847 - DNA, 33 bp, Artificial Sequence
  Synthetic Construct
gcccaaacttcgactaatatggcggctgcacag

SEQ ID NO: 4848 - DNA, 33 bp, Artificial Sequence
  Synthetic Construct
gcccaacaaggcggcctcgccgtcgtcgcacag

SEQ ID NO: 4849 - DNA, 33 bp, Artificial Sequence
  Synthetic Construct
gcccaagggaggggtagtcttccgtttgcacag

SEQ ID NO: 4850 - DNA, 33 bp, Artificial Sequence
  Synthetic Construct
gcccaaagcggcaaacccgccagcgaagcacag

SEQ ID NO: 4851 - DNA, 33 bp, Artificial Sequence
  Synthetic Construct
gcccaacggtctgttagtgtgaattctgcacag

SEQ ID NO: 4852 - DNA, 33 bp, Artificial Sequence
  Synthetic Construct
gcccaagacagaggcggcgtcgtcgccgcacag

SEQ ID NO: 4853 - DNA, 33 bp, Artificial Sequence
  Synthetic Construct
gcccaaggtcgtgagactggtttttcggcacag

SEQ ID NO: 4854 - DNA, 33 bp, Artificial Sequence
  Synthetic Construct
gcccaacagattgttccgtcgaatccggcacag

SEQ ID NO: 4855 - DNA, 33 bp, Artificial Sequence
  Synthetic Construct
gcccaaacgacgttgggtcatagttattcacag

SEQ ID NO: 4856 - DNA, 33 bp, Artificial Sequence
  Synthetic Construct
gcccaaagcagagaattccaactcgccgcacag

SEQ ID NO: 4857 - DNA, 33 bp, Artificial Sequence
  Synthetic Construct
gcccaaggcagagaccacaacatcggcgcacag

SEQ ID NO: 4858 - DNA, 33 bp, Artificial Sequence
  Synthetic Construct
gcccaatcgaataattctcggccgaatgcacag

SEQ ID NO: 4859 - DNA, 33 bp, Artificial Sequence
  Synthetic Construct
gcccaaaaaaaccaaagcagcgacctcgcacag

SEQ ID NO: 4860 - DNA, 33 bp, Artificial Sequence
  Synthetic Construct
gcccaacccaacgacagagcccacggcgcacag

SEQ ID NO: 4861 - DNA, 33 bp, Artificial Sequence
  Synthetic Construct
gcccaagctctgactaggactcagtctgcacag

SEQ ID NO: 4862 - DNA, 33 bp, Artificial Sequence
  Synthetic Construct
gcccaaatgagaccccccagcgacaaagcacag

SEQ ID NO: 4863 - DNA, 33 bp, Artificial Sequence
  Synthetic Construct
gcccaaacgaattcgactacgaagtcggcacag

SEQ ID NO: 4864 - DNA, 33 bp, Artificial Sequence
  Synthetic Construct
gcccaaggcagacacggcatgaccgccgcacag

SEQ ID NO: 4865 - DNA, 33 bp, Artificial Sequence
  Synthetic Construct
gcccaagtcagccacatcagccccgccgcacag

SEQ ID NO: 4866 - DNA, 33 bp, Artificial Sequence
  Synthetic Construct
gcccaaaaggttactagtaatagttcggcacag

SEQ ID NO: 4867 - DNA, 33 bp, Artificial Sequence
  Synthetic Construct
gcccaaatgtacggccccggcgccagcgcacag

SEQ ID NO: 4868 - DNA, 33 bp, Artificial Sequence
  Synthetic Construct
gcccaagtcctcagaagcaacacccccgcacag

SEQ ID NO: 4869 - DNA, 33 bp, Artificial Sequence
  Synthetic Construct
gcccaaaatagtagttctagtaataaggcacag

SEQ ID NO: 4870 - DNA, 33 bp, Artificial Sequence
  Synthetic Construct
gcccaaagcaccgaaaaaagcaccagcgcacag

SEQ ID NO: 4871 - DNA, 33 bp, Artificial Sequence
  Synthetic Construct
gcccaaaacaccaacggcaacaaaggcgcacag

SEQ ID NO: 4872 - DNA, 33 bp, Artificial Sequence
  Synthetic Construct
gcccaaattacgactaatctgggggcggcacag

SEQ ID NO: 4873 - DNA, 33 bp, Artificial Sequence
  Synthetic Construct
gcccaaatccaaaaaccccaaagcagcgcacag

SEQ ID NO: 4874 - DNA, 33 bp, Artificial Sequence
  Synthetic Construct
gcccaagtgagggatgcggcttatacggcacag

SEQ ID NO: 4875 - DNA, 33 bp, Artificial Sequence
  Synthetic Construct
gcccaagccagaagcagcaccggcgccgcacag

SEQ ID NO: 4876 - DNA, 33 bp, Artificial Sequence
  Synthetic Construct
gcccaaacgtctgttcataataaggttgcacag

SEQ ID NO: 4877 - DNA, 33 bp, Artificial Sequence
  Synthetic Construct
gcccaaactatttcgactcatggtactgcacag

SEQ ID NO: 4878 - DNA, 33 bp, Artificial Sequence
  Synthetic Construct
gcccaaaccgtcaccaacatcaacttcgcacag

SEQ ID NO: 4879 - DNA, 33 bp, Artificial Sequence
  Synthetic Construct
gcccaaagcatcaacagcaaccacatcgcacag

SEQ ID NO: 4880 - DNA, 33 bp, Artificial Sequence
  Synthetic Construct
gcccaacaaaaagccggctacagcaacgcacag

SEQ ID NO: 4881 - DNA, 33 bp, Artificial Sequence
  Synthetic Construct
gcccaagccagagacaccgtcagaaccgcacag

SEQ ID NO: 4882 - DNA, 33 bp, Artificial Sequence
  Synthetic Construct
gcccaatataaggatcagacgaaggttgcacag

SEQ ID NO: 4883 - DNA, 33 bp, Artificial Sequence
  Synthetic Construct
gcccaaaacatcggcctcaaccccatggcacag

SEQ ID NO: 4884 - DNA, 33 bp, Artificial Sequence
  Synthetic Construct
gcccaaggcagcaccaacatgatctacgcacag

SEQ ID NO: 4885 - DNA, 33 bp, Artificial Sequence
  Synthetic Construct
gcccaaatcgacgccaaaggcctcaaagcacag

SEQ ID NO: 4886 - DNA, 33 bp, Artificial Sequence
  Synthetic Construct
gcccaagtcgtcagccacaacctcaccgcacag

SEQ ID NO: 4887 - DNA, 33 bp, Artificial Sequence
  Synthetic Construct
gcccaaactgtgtctctgaagactgcggcacag

SEQ ID NO: 4888 - DNA, 33 bp, Artificial Sequence
  Synthetic Construct
gcccaatacagcggcagcaactaccacgcacag

SEQ ID NO: 4889 - DNA, 33 bp, Artificial Sequence
  Synthetic Construct
gcccaaccgagtgatgctacgatgggggcacag

SEQ ID NO: 4890 - DNA, 33 bp, Artificial Sequence
  Synthetic Construct
gcccaatggggggagactacgaatggtgcacag

SEQ ID NO: 4891 - DNA, 33 bp, Artificial Sequence
  Synthetic Construct
gcccaaaattatcataagacgatgccggcacag

SEQ ID NO: 4892 - DNA, 33 bp, Artificial Sequence
  Synthetic Construct
gcccaagccagacacgaactccccgtcgcacag

SEQ ID NO: 4893 - DNA, 33 bp, Artificial Sequence
  Synthetic Construct
gcccaacacaacctcaccagaaacctcgcacag

SEQ ID NO: 4894 - DNA, 33 bp, Artificial Sequence
  Synthetic Construct
gcccaaggtccgcagattggtacggtggcacag

SEQ ID NO: 4895 - DNA, 33 bp, Artificial Sequence
  Synthetic Construct
gcccaaatgagagccgacagcaacgtcgcacag

SEQ ID NO: 4896 - DNA, 33 bp, Artificial Sequence
  Synthetic Construct
gcccaagtcgccaacggccccaccaccgcacag

SEQ ID NO: 4897 - DNA, 33 bp, Artificial Sequence
  Synthetic Construct
gcccaaaccaaaaacctcaacacctacgcacag

SEQ ID NO: 4898 - DNA, 33 bp, Artificial Sequence
  Synthetic Construct
gcccaagacagactcggcgccagaagcgcacag

SEQ ID NO: 4899 - DNA, 33 bp, Artificial Sequence
  Synthetic Construct
gcccaaaacatcggcagcggccaaaaagcacag

SEQ ID NO: 4900 - DNA, 33 bp, Artificial Sequence
  Synthetic Construct
gcccaaggtagggagatgacgaatccggcacag

SEQ ID NO: 4901 - DNA, 33 bp, Artificial Sequence
  Synthetic Construct
gcccaaattatggctgctgcgcattcggcacag

SEQ ID NO: 4902 - DNA, 33 bp, Artificial Sequence
  Synthetic Construct
gcccaaagcgaccaaagaatccaccccgcacag

SEQ ID NO: 4903 - DNA, 33 bp, Artificial Sequence
  Synthetic Construct
gcccaagtttctggtcagacgaatatggcacag

SEQ ID NO: 4904 - DNA, 33 bp, Artificial Sequence
  Synthetic Construct
gcccaatacagcctcggcagcgaacccgcacag

SEQ ID NO: 4905 - DNA, 33 bp, Artificial Sequence
  Synthetic Construct
gcccaatctacgctgaaggctctgacggcacag

SEQ ID NO: 4906 - DNA, 33 bp, Artificial Sequence
  Synthetic Construct
gcccaaagcgccctcatccccagccccgcacag

SEQ ID NO: 4907 - DNA, 33 bp, Artificial Sequence
  Synthetic Construct
gcccaaaccagccaagccggcaaccaagcacag

SEQ ID NO: 4908 - DNA, 33 bp, Artificial Sequence
  Synthetic Construct
gcccaaaaacacgccagcctccccatcgcacag

SEQ ID NO: 4909 - DNA, 33 bp, Artificial Sequence
  Synthetic Construct
gcccaactcgaccaactcaccaaaaacgcacag

SEQ ID NO: 4910 - DNA, 33 bp, Artificial Sequence
  Synthetic Construct
gcccaaatggccagaagcaccgacagagcacag

SEQ ID NO: 4911 - DNA, 33 bp, Artificial Sequence
  Synthetic Construct
gcccaaagttataatcatattgagaaggcacag

SEQ ID NO: 4912 - DNA, 33 bp, Artificial Sequence
  Synthetic Construct
gcccaagtcaaccacatccaacccatggcacag

SEQ ID NO: 4913 - DNA, 33 bp, Artificial Sequence
  Synthetic Construct
gcccaaagcagagccgaacccaaactcgcacag

SEQ ID NO: 4914 - DNA, 33 bp, Artificial Sequence
  Synthetic Construct
gcccaagccagccacatcggcaacagcgcacag

SEQ ID NO: 4915 - DNA, 33 bp, Artificial Sequence
  Synthetic Construct
gcccaacatcagggttttgcgagtgctgcacag

SEQ ID NO: 4916 - DNA, 33 bp, Artificial Sequence
  Synthetic Construct
gcccaagagggtaagtctattatgccggcacag

SEQ ID NO: 4917 - DNA, 33 bp, Artificial Sequence
  Synthetic Construct
gcccaactcaccggcatgcacagcaccgcacag

SEQ ID NO: 4918 - DNA, 33 bp, Artificial Sequence
  Synthetic Construct
gcccaaagtaatcctagtactattcatgcacag

SEQ ID NO: 4919 - DNA, 33 bp, Artificial Sequence
  Synthetic Construct
gcccaaagcagagaccaacccaccagcgcacag

SEQ ID NO: 4920 - DNA, 33 bp, Artificial Sequence
  Synthetic Construct
gcccaaaaaaccgccgaaccctacaccgcacag

SEQ ID NO: 4921 - DNA, 33 bp, Artificial Sequence
  Synthetic Construct
gcccaaattggttctaatcctgataaggcacag

SEQ ID NO: 4922 - DNA, 33 bp, Artificial Sequence
  Synthetic Construct
gcccaactcgccagcaccttcagccccgcacag

SEQ ID NO: 4923 - DNA, 33 bp, Artificial Sequence
  Synthetic Construct
gcccaacttgttaggcttaatacttctgcacag

SEQ ID NO: 4924 - DNA, 33 bp, Artificial Sequence
  Synthetic Construct
gcccaatttcaggatctgcgtgcgcaagcacag

SEQ ID NO: 4925 - DNA, 33 bp, Artificial Sequence
  Synthetic Construct
gcccaaatcagccacagcccccaaaccgcacag

SEQ ID NO: 4926 - DNA, 33 bp, Artificial Sequence
  Synthetic Construct
gcccaattccaagacggccaaagagaagcacag

SEQ ID NO: 4927 - DNA, 33 bp, Artificial Sequence
  Synthetic Construct
gcccaagacaccagagaagccttcagagcacag

SEQ ID NO: 4928 - DNA, 33 bp, Artificial Sequence
  Synthetic Construct
gcccaattggttgctgatgcgcgtcctgcacag

SEQ ID NO: 4929 - DNA, 33 bp, Artificial Sequence
  Synthetic Construct
gcccaaagcttcagcagcggcgccggcgcacag

SEQ ID NO: 4930 - DNA, 33 bp, Artificial Sequence
  Synthetic Construct
gcccaagatgtgttgactgggaagagtgcacag

SEQ ID NO: 4931 - DNA, 33 bp, Artificial Sequence
  Synthetic Construct
gcccaaaagatggtgttgaataatgctgcacag

SEQ ID NO: 4932 - DNA, 33 bp, Artificial Sequence
  Synthetic Construct
gcccaacggaagattgatacgatgtctgcacag

SEQ ID NO: 4933 - DNA, 33 bp, Artificial Sequence
  Synthetic Construct
gcccaaatgtctcaggtgattactggggcacag

SEQ ID NO: 4934 - DNA, 33 bp, Artificial Sequence
  Synthetic Construct
gcccaaacgtatgatacgcggaatactgcacag

SEQ ID NO: 4935 - DNA, 33 bp, Artificial Sequence
  Synthetic Construct
gcccaatatagggatggttcgggtagtgcacag

SEQ ID NO: 4936 - DNA, 33 bp, Artificial Sequence
  Synthetic Construct
gcccaagggaatattagtcctgcgggggcacag

SEQ ID NO: 4937 - DNA, 33 bp, Artificial Sequence
  Synthetic Construct
gcccaaaaagccggcctcggcctcagcgcacag

SEQ ID NO: 4938 - DNA, 33 bp, Artificial Sequence
  Synthetic Construct
gcccaacgtcatgtggagaaggatactgcacag

SEQ ID NO: 4939 - DNA, 33 bp, Artificial Sequence
  Synthetic Construct
gcccaaaaagaagtcagagccaacgccgcacag

SEQ ID NO: 4940 - DNA, 33 bp, Artificial Sequence
  Synthetic Construct
gcccaagagagtaagcctcttcctgcggcacag

SEQ ID NO: 4941 - DNA, 33 bp, Artificial Sequence
  Synthetic Construct
gcccaaacgttgagtcataatagtatggcacag

SEQ ID NO: 4942 - DNA, 33 bp, Artificial Sequence
  Synthetic Construct
gcccaagtcggcagctacaccgtcagcgcacag

SEQ ID NO: 4943 - DNA, 33 bp, Artificial Sequence
  Synthetic Construct
gcccaacaaagcgccaccagcctcaccgcacag

SEQ ID NO: 4944 - DNA, 33 bp, Artificial Sequence
  Synthetic Construct
gcccaacacgccaacggcctcagagacgcacag

SEQ ID NO: 4945 - DNA, 33 bp, Artificial Sequence
  Synthetic Construct
gcccaaagaatgagccacgacagccccgcacag

SEQ ID NO: 4946 - DNA, 33 bp, Artificial Sequence
  Synthetic Construct
gcccaaaagcatagtggtcttgagtctgcacag

SEQ ID NO: 4947 - DNA, 33 bp, Artificial Sequence
  Synthetic Construct
gcccaaaaactcagcaccgccatcgaagcacag

SEQ ID NO: 4948 - DNA, 33 bp, Artificial Sequence
  Synthetic Construct
gcccaaaacagcaaacaactcctcctcgcacag

SEQ ID NO: 4949 - DNA, 33 bp, Artificial Sequence
  Synthetic Construct
gcccaatcgcttcataataatcgtgtggcacag

SEQ ID NO: 4950 - DNA, 33 bp, Artificial Sequence
  Synthetic Construct
gcccaaagcgccgacagaagcatcaccgcacag

SEQ ID NO: 4951 - DNA, 33 bp, Artificial Sequence
  Synthetic Construct
gcccaacccaccggcagaccccaagaagcacag

SEQ ID NO: 4952 - DNA, 33 bp, Artificial Sequence
  Synthetic Construct
gcccaaaagactgttcaggagcctttggcacag

SEQ ID NO: 4953 - DNA, 33 bp, Artificial Sequence
  Synthetic Construct
gcccaaagcaccaaagccctcagcaacgcacag

SEQ ID NO: 4954 - DNA, 33 bp, Artificial Sequence
  Synthetic Construct
gcccaaagcaaccaaagcaccagaagcgcacag

SEQ ID NO: 4955 - DNA, 33 bp, Artificial Sequence
  Synthetic Construct
gcccaaggtgttgaggggagttcgcgggcacag

SEQ ID NO: 4956 - DNA, 33 bp, Artificial Sequence
  Synthetic Construct
gcccaactccaccaaggccccagcagcgcacag

SEQ ID NO: 4957 - DNA, 33 bp, Artificial Sequence
  Synthetic Construct
gcccaagtcgacagcagaaacgtcgtcgcacag

SEQ ID NO: 4958 - DNA, 33 bp, Artificial Sequence
  Synthetic Construct
gcccaacttgggaagcagacggctttggcacag

SEQ ID NO: 4959 - DNA, 33 bp, Artificial Sequence
  Synthetic Construct
gcccaaagcggcaacagaaccaacatggcacag

SEQ ID NO: 4960 - DNA, 33 bp, Artificial Sequence
  Synthetic Construct
gcccaagtcaaaggctacgccagcaccgcacag

SEQ ID NO: 4961 - DNA, 33 bp, Artificial Sequence
  Synthetic Construct
gcccaagcttctgttagttcgtcgagtgcacag

SEQ ID NO: 4962 - DNA, 33 bp, Artificial Sequence
  Synthetic Construct
gcccaactccaactcaaaagcggcatggcacag

SEQ ID NO: 4963 - DNA, 33 bp, Artificial Sequence
  Synthetic Construct
gcccaagatatgcgtgcgtctgggagtgcacag

SEQ ID NO: 4964 - DNA, 33 bp, Artificial Sequence
  Synthetic Construct
gcccaattgactgctacgctgccttatgcacag

SEQ ID NO: 4965 - DNA, 33 bp, Artificial Sequence
  Synthetic Construct
gcccaaagtaatgctcctaattcgtatgcacag

SEQ ID NO: 4966 - DNA, 33 bp, Artificial Sequence
  Synthetic Construct
gcccaaaaagtcgaaagcagcagagccgcacag

SEQ ID NO: 4967 - DNA, 33 bp, Artificial Sequence
  Synthetic Construct
gcccaatggagcaacagcaccaccgtcgcacag

SEQ ID NO: 4968 - DNA, 33 bp, Artificial Sequence
  Synthetic Construct
gcccaatctcttattcatacgcgtcctgcacag

SEQ ID NO: 4969 - DNA, 33 bp, Artificial Sequence
  Synthetic Construct
gcccaaacgctttctagtcctcataatgcacag

SEQ ID NO: 4970 - DNA, 33 bp, Artificial Sequence
  Synthetic Construct
gcccaagtgcctaggtttaatggtaatgcacag

SEQ ID NO: 4971 - DNA, 33 bp, Artificial Sequence
  Synthetic Construct
gcccaattcaaccacagcggcagcggcgcacag

SEQ ID NO: 4972 - DNA, 33 bp, Artificial Sequence
  Synthetic Construct
gcccaatgggtcgacaccaacagcaaagcacag

SEQ ID NO: 4973 - DNA, 33 bp, Artificial Sequence
  Synthetic Construct
gcccaacattcggatggttctaggcttgcacag

SEQ ID NO: 4974 - DNA, 33 bp, Artificial Sequence
  Synthetic Construct
gcccaaaggcaggcggttcagacttctgcacag

SEQ ID NO: 4975 - DNA, 33 bp, Artificial Sequence
  Synthetic Construct
gcccaaatgcacagcggcatccccaccgcacag

SEQ ID NO: 4976 - DNA, 33 bp, Artificial Sequence
  Synthetic Construct
gcccaagtgaaggatcaggggcgttctgcacag

SEQ ID NO: 4977 - DNA, 33 bp, Artificial Sequence
  Synthetic Construct
gcccaaagacccaccctcagcaaccaagcacag

SEQ ID NO: 4978 - DNA, 33 bp, Artificial Sequence
  Synthetic Construct
gcccaagtcagcaaaagcgccgccctcgcacag

SEQ ID NO: 4979 - DNA, 33 bp, Artificial Sequence
  Synthetic Construct
gcccaaaaggatagtcatctgtcgtcggcacag

SEQ ID NO: 4980 - DNA, 33 bp, Artificial Sequence
  Synthetic Construct
gcccaagtcggcgtcagaatgaccggcgcacag

SEQ ID NO: 4981 - DNA, 33 bp, Artificial Sequence
  Synthetic Construct
gcccaagctgatcggcttttgaattcggcacag

SEQ ID NO: 4982 - DNA, 33 bp, Artificial Sequence
  Synthetic Construct
gcccaaggcagcgaactcagaaccggcgcacag

SEQ ID NO: 4983 - DNA, 33 bp, Artificial Sequence
  Synthetic Construct
gcccaaatgaaactcagcaccagcagcgcacag

SEQ ID NO: 4984 - DNA, 33 bp, Artificial Sequence
  Synthetic Construct
gcccaacaagcctacaacatcgtccccgcacag

SEQ ID NO: 4985 - DNA, 33 bp, Artificial Sequence
  Synthetic Construct
gcccaagtcggcggcaacatcagaaccgcacag

SEQ ID NO: 4986 - DNA, 33 bp, Artificial Sequence
  Synthetic Construct
gcccaaagttatcagcagacgttgggggcacag

SEQ ID NO: 4987 - DNA, 33 bp, Artificial Sequence
  Synthetic Construct
gcccaaatgagacccacccccaccgacgcacag

SEQ ID NO: 4988 - DNA, 33 bp, Artificial Sequence
  Synthetic Construct
gcccaaaggaaggcgaatgatctgaatgcacag

SEQ ID NO: 4989 - DNA, 33 bp, Artificial Sequence
  Synthetic Construct
gcccaaatcagcggcaccgccagcaccgcacag

SEQ ID NO: 4990 - DNA, 33 bp, Artificial Sequence
  Synthetic Construct
gcccaatacgtccaactcaacaacgccgcacag

SEQ ID NO: 4991 - DNA, 33 bp, Artificial Sequence
  Synthetic Construct
gcccaaaccgaaaaaggctggggccccgcacag

SEQ ID NO: 4992 - DNA, 33 bp, Artificial Sequence
  Synthetic Construct
gcccaatctccgcagaggcataatagtgcacag

SEQ ID NO: 4993 - DNA, 33 bp, Artificial Sequence
  Synthetic Construct
gcccaatacacccacatgaccgaaagagcacag

SEQ ID NO: 4994 - DNA, 33 bp, Artificial Sequence
  Synthetic Construct
gcccaagatcggtctatgcagcaggctgcacag

SEQ ID NO: 4995 - DNA, 33 bp, Artificial Sequence
  Synthetic Construct
gcccaagacaccatgaacgccatgagagcacag

SEQ ID NO: 4996 - DNA, 33 bp, Artificial Sequence
  Synthetic Construct
gcccaactcaaacccggccacatggtcgcacag

SEQ ID NO: 4997 - DNA, 33 bp, Artificial Sequence
  Synthetic Construct
gcccaacaattcaacagcaaagacaccgcacag

SEQ ID NO: 4998 - DNA, 33 bp, Artificial Sequence
  Synthetic Construct
gcccaatggaccaacagcagacccatggcacag

SEQ ID NO: 4999 - DNA, 33 bp, Artificial Sequence
  Synthetic Construct
gcccaattgctgacgacttcttctgaggcacag

SEQ ID NO: 5000 - DNA, 33 bp, Artificial Sequence
  Synthetic Construct
gcccaacagcgtgcttcttctggttctgcacag

SEQ ID NO: 5001 - DNA, 33 bp, Artificial Sequence
  Synthetic Construct
gcccaacccaaagaaagcaacaacatggcacag

SEQ ID NO: 5002 - DNA, 33 bp, Artificial Sequence
  Synthetic Construct
gcccaagccaaacacgtcgccaccgaagcacag

SEQ ID NO: 5003 - DNA, 33 bp, Artificial Sequence
  Synthetic Construct
gcccaaactcagtcgagtacgtattcggcacag

SEQ ID NO: 5004 - DNA, 33 bp, Artificial Sequence
  Synthetic Construct
gcccaacccagaaccagcaccaacatcgcacag

SEQ ID NO: 5005 - DNA, 33 bp, Artificial Sequence
  Synthetic Construct
gcccaaagactcgccagcaacagcgacgcacag

SEQ ID NO: 5006 - DNA, 33 bp, Artificial Sequence
  Synthetic Construct
gcccaaggccccctccaaaccaacgccgcacag

SEQ ID NO: 5007 - DNA, 33 bp, Artificial Sequence
  Synthetic Construct
gcccaaaaagtcagcgccatgagcgacgcacag

SEQ ID NO: 5008 - DNA, 33 bp, Artificial Sequence
  Synthetic Construct
gcccaagctgggaagtatgttaattctgcacag

SEQ ID NO: 5009 - DNA, 33 bp, Artificial Sequence
  Synthetic Construct
gcccaacccaaaagcggcagccccagcgcacag

SEQ ID NO: 5010 - DNA, 33 bp, Artificial Sequence
  Synthetic Construct
gcccaatttatttctaatgggagttcggcacag

SEQ ID NO: 5011 - DNA, 33 bp, Artificial Sequence
  Synthetic Construct
gcccaaaatctgaatgcgatgcataaggcacag

SEQ ID NO: 5012 - DNA, 33 bp, Artificial Sequence
  Synthetic Construct
gcccaagagtcgcatgcgcgggagggggcacag

SEQ ID NO: 5013 - DNA, 33 bp, Artificial Sequence
  Synthetic Construct
gcccaaactgtggttggggttaggggtgcacag

SEQ ID NO: 5014 - DNA, 33 bp, Artificial Sequence
  Synthetic Construct
gcccaagccaaagccaccgtccccagcgcacag

SEQ ID NO: 5015 - DNA, 33 bp, Artificial Sequence
  Synthetic Construct
gcccaaaccaaaaccgtcaacatgaccgcacag

SEQ ID NO: 5016 - DNA, 33 bp, Artificial Sequence
  Synthetic Construct
gcccaacaaagcagcctcaaactcaccgcacag

SEQ ID NO: 5017 - DNA, 33 bp, Artificial Sequence
  Synthetic Construct
gcccaaaacgcccaaagaaccggccccgcacag

SEQ ID NO: 5018 - DNA, 33 bp, Artificial Sequence
  Synthetic Construct
gcccaaaacagaagagacgccacccccgcacag

SEQ ID NO: 5019 - DNA, 33 bp, Artificial Sequence
  Synthetic Construct
gcccaaggcaaccaaaacaccctcctcgcacag

SEQ ID NO: 5020 - DNA, 33 bp, Artificial Sequence
  Synthetic Construct
gcccaaaccagagtcagcggcagcgccgcacag

SEQ ID NO: 5021 - DNA, 33 bp, Artificial Sequence
  Synthetic Construct
gcccaagttacgacggcgatgatgtcggcacag

SEQ ID NO: 5022 - DNA, 33 bp, Artificial Sequence
  Synthetic Construct
gcccaagacagaacccccatcgcccacgcacag

SEQ ID NO: 5023 - DNA, 33 bp, Artificial Sequence
  Synthetic Construct
gcccaactccccctcaacagcagacccgcacag

SEQ ID NO: 5024 - DNA, 33 bp, Artificial Sequence
  Synthetic Construct
gcccaaccgcaggcttcgcaggctaatgcacag

SEQ ID NO: 5025 - DNA, 33 bp, Artificial Sequence
  Synthetic Construct
gcccaaacggcgaggaatgttcctaatgcacag

SEQ ID NO: 5026 - DNA, 33 bp, Artificial Sequence
  Synthetic Construct
gcccaactcaacggcatcctcagccaagcacag

SEQ ID NO: 5027 - DNA, 33 bp, Artificial Sequence
  Synthetic Construct
gcccaactgcaggataagactcttaatgcacag

SEQ ID NO: 5028 - DNA, 33 bp, Artificial Sequence
  Synthetic Construct
gcccaatatcggggtgagaataatcctgcacag

SEQ ID NO: 5029 - DNA, 33 bp, Artificial Sequence
  Synthetic Construct
gcccaagtcaacaaacaactcaacagcgcacag

SEQ ID NO: 5030 - DNA, 33 bp, Artificial Sequence
  Synthetic Construct
gcccaagtcctcaaagacgacggccacgcacag

SEQ ID NO: 5031 - DNA, 33 bp, Artificial Sequence
  Synthetic Construct
gcccaaactcggggggaggtttcgctggcacag

SEQ ID NO: 5032 - DNA, 33 bp, Artificial Sequence
  Synthetic Construct
gcccaagagtttcagaggatgcatccggcacag

SEQ ID NO: 5033 - DNA, 33 bp, Artificial Sequence
  Synthetic Construct
gcccaaatcagccccatgagcaccagcgcacag

SEQ ID NO: 5034 - DNA, 33 bp, Artificial Sequence
  Synthetic Construct
gcccaactcggccacgaccacgccaccgcacag

SEQ ID NO: 5035 - DNA, 33 bp, Artificial Sequence
  Synthetic Construct
gcccaactcagccccggcccccaacaagcacag

SEQ ID NO: 5036 - DNA, 33 bp, Artificial Sequence
  Synthetic Construct
gcccaaaagtttaggggggaggagcctgcacag

SEQ ID NO: 5037 - DNA, 33 bp, Artificial Sequence
  Synthetic Construct
gcccaacagggttctcgtctggcttcggcacag

SEQ ID NO: 5038 - DNA, 33 bp, Artificial Sequence
  Synthetic Construct
gcccaatgggagcgttctcagttgtctgcacag

SEQ ID NO: 5039 - DNA, 33 bp, Artificial Sequence
  Synthetic Construct
gcccaacagcagaaggcggctaatggggcacag

SEQ ID NO: 5040 - DNA, 33 bp, Artificial Sequence
  Synthetic Construct
gcccaatatacgctgagtctgagtagtgcacag

SEQ ID NO: 5041 - DNA, 33 bp, Artificial Sequence
  Synthetic Construct
gcccaaggcctcatccccaacaacagcgcacag

SEQ ID NO: 5042 - DNA, 33 bp, Artificial Sequence
  Synthetic Construct
gcccaaagcgtccccgtcagcagaaccgcacag

SEQ ID NO: 5043 - DNA, 33 bp, Artificial Sequence
  Synthetic Construct
gcccaaaataagcagcagtctcagacggcacag

SEQ ID NO: 5044 - DNA, 33 bp, Artificial Sequence
  Synthetic Construct
gcccaaagcaaacacagcgtccaagtcgcacag

SEQ ID NO: 5045 - DNA, 33 bp, Artificial Sequence
  Synthetic Construct
gcccaaaatcgtccttctcagcagggggcacag

SEQ ID NO: 5046 - DNA, 33 bp, Artificial Sequence
  Synthetic Construct
gcccaacaagaatacagaaacaccctcgcacag

SEQ ID NO: 5047 - DNA, 33 bp, Artificial Sequence
  Synthetic Construct
gcccaattcgaaagagacagaatgggcgcacag

SEQ ID NO: 5048 - DNA, 33 bp, Artificial Sequence
  Synthetic Construct
gcccaaagcaccagcagcaacctcagcgcacag

SEQ ID NO: 5049 - DNA, 33 bp, Artificial Sequence
  Synthetic Construct
gcccaaagaagcctcgaaggcatcgtcgcacag

SEQ ID NO: 5050 - DNA, 33 bp, Artificial Sequence
  Synthetic Construct
gcccaaggcaacagcagactcgaccccgcacag

SEQ ID NO: 5051 - DNA, 33 bp, Artificial Sequence
  Synthetic Construct
gcccaaatcgacaccatcggcaaagccgcacag

SEQ ID NO: 5052 - DNA, 33 bp, Artificial Sequence
  Synthetic Construct
gcccaactggatcatacgagtcgtgcggcacag

SEQ ID NO: 5053 - DNA, 33 bp, Artificial Sequence
  Synthetic Construct
gcccaatggggccaaaccaacagcagcgcacag

SEQ ID NO: 5054 - DNA, 33 bp, Artificial Sequence
  Synthetic Construct
gcccaagcgcggggtaatctgtcgagtgcacag

SEQ ID NO: 5055 - DNA, 33 bp, Artificial Sequence
  Synthetic Construct
gcccaagacaacatgaaactccacgtcgcacag

SEQ ID NO: 5056 - DNA, 33 bp, Artificial Sequence
  Synthetic Construct
gcccaagaaaaaacccaacaaagctacgcacag

SEQ ID NO: 5057 - DNA, 33 bp, Artificial Sequence
  Synthetic Construct
gcccaatcgaatggtttggcgcggaatgcacag

SEQ ID NO: 5058 - DNA, 33 bp, Artificial Sequence
  Synthetic Construct
gcccaagtcgtcagccacagacccgccgcacag

SEQ ID NO: 5059 - DNA, 33 bp, Artificial Sequence
  Synthetic Construct
gcccaaagtttgggtgttagtcggaatgcacag

SEQ ID NO: 5060 - DNA, 33 bp, Artificial Sequence
  Synthetic Construct
gcccaagaccacagccacggcagagacgcacag

SEQ ID NO: 5061 - DNA, 33 bp, Artificial Sequence
  Synthetic Construct
gcccaatcgactcatcaggtggcgaatgcacag

SEQ ID NO: 5062 - DNA, 33 bp, Artificial Sequence
  Synthetic Construct
gcccaaaatcagagtgcgagtagtcgggcacag

SEQ ID NO: 5063 - DNA, 33 bp, Artificial Sequence
  Synthetic Construct
gcccaagtcaccgtcggcagccacatggcacag

SEQ ID NO: 5064 - DNA, 33 bp, Artificial Sequence
  Synthetic Construct
gcccaaagcagcaacatcgcccaaaacgcacag

SEQ ID NO: 5065 - DNA, 33 bp, Artificial Sequence
  Synthetic Construct
gcccaattgaatgagatggctactcctgcacag

SEQ ID NO: 5066 - DNA, 33 bp, Artificial Sequence
  Synthetic Construct
gcccaaagcaccaaaatcgaaagagacgcacag

SEQ ID NO: 5067 - DNA, 33 bp, Artificial Sequence
  Synthetic Construct
gcccaaaacctcgtcgacgccagaatcgcacag

SEQ ID NO: 5068 - DNA, 33 bp, Artificial Sequence
  Synthetic Construct
gcccaatacagcaccggcaaagacgccgcacag

SEQ ID NO: 5069 - DNA, 33 bp, Artificial Sequence
  Synthetic Construct
gcccaaacccaaggcatcgtcaccagcgcacag

SEQ ID NO: 5070 - DNA, 33 bp, Artificial Sequence
  Synthetic Construct
gcccaatcttttggggctacgagtttggcacag

SEQ ID NO: 5071 - DNA, 33 bp, Artificial Sequence
  Synthetic Construct
gcccaaactgcggggatgtcttcgcgggcacag

SEQ ID NO: 5072 - DNA, 33 bp, Artificial Sequence
  Synthetic Construct
gcccaaagagacaacagcctcatccccgcacag

SEQ ID NO: 5073 - DNA, 33 bp, Artificial Sequence
  Synthetic Construct
gcccaaaagactaatgctgattatggggcacag

SEQ ID NO: 5074 - DNA, 33 bp, Artificial Sequence
  Synthetic Construct
gcccaagtcaacccccacagaaccatggcacag

SEQ ID NO: 5075 - DNA, 33 bp, Artificial Sequence
  Synthetic Construct
gcccaagatattcgtgggaggcctactgcacag

SEQ ID NO: 5076 - DNA, 33 bp, Artificial Sequence
  Synthetic Construct
gcccaacgtgaggtttcgagtacttctgcacag

SEQ ID NO: 5077 - DNA, 33 bp, Artificial Sequence
  Synthetic Construct
gcccaagtcagccaaggcaccagagtcgcacag

SEQ ID NO: 5078 - DNA, 33 bp, Artificial Sequence
  Synthetic Construct
gcccaaaagacgcctattatgcatgcggcacag

SEQ ID NO: 5079 - DNA, 33 bp, Artificial Sequence
  Synthetic Construct
gcccaactggagtcgcgggatacggttgcacag

SEQ ID NO: 5080 - DNA, 33 bp, Artificial Sequence
  Synthetic Construct
gcccaagtcctcaacagcagcatgaccgcacag

SEQ ID NO: 5081 - DNA, 33 bp, Artificial Sequence
  Synthetic Construct
gcccaatttcggactgtgacgcaggcggcacag

SEQ ID NO: 5082 - DNA, 33 bp, Artificial Sequence
  Synthetic Construct
gcccaaaccggcgccatgaacatgaccgcacag

SEQ ID NO: 5083 - DNA, 33 bp, Artificial Sequence
  Synthetic Construct
gcccaattgaagactcagaattattctgcacag

SEQ ID NO: 5084 - DNA, 33 bp, Artificial Sequence
  Synthetic Construct
gcccaacagaagacgatgttgactgctgcacag

SEQ ID NO: 5085 - DNA, 33 bp, Artificial Sequence
  Synthetic Construct
gcccaaagtaatattattggttcggatgcacag

SEQ ID NO: 5086 - DNA, 33 bp, Artificial Sequence
  Synthetic Construct
gcccaatcggtgtcggtttcgaagatggcacag

SEQ ID NO: 5087 - DNA, 33 bp, Artificial Sequence
  Synthetic Construct
gcccaagcggcgcaggtttcgcatgctgcacag

SEQ ID NO: 5088 - DNA, 33 bp, Artificial Sequence
  Synthetic Construct
gcccaaattaatgtggttgagaaggctgcacag

SEQ ID NO: 5089 - DNA, 33 bp, Artificial Sequence
  Synthetic Construct
gcccaaatgctcagaggcgacctccccgcacag

SEQ ID NO: 5090 - DNA, 33 bp, Artificial Sequence
  Synthetic Construct
gcccaaaacctccccaccatgcaacccgcacag

SEQ ID NO: 5091 - DNA, 33 bp, Artificial Sequence
  Synthetic Construct
gcccaattccaagacaaaatcaacagagcacag

SEQ ID NO: 5092 - DNA, 33 bp, Artificial Sequence
  Synthetic Construct
gcccaaagcagacaaaccatcgaaaccgcacag

SEQ ID NO: 5093 - DNA, 33 bp, Artificial Sequence
  Synthetic Construct
gcccaactccacagcaaactcaacggcgcacag

SEQ ID NO: 5094 - DNA, 33 bp, Artificial Sequence
  Synthetic Construct
gcccaaacccccagcgccagcaacatggcacag

SEQ ID NO: 5095 - DNA, 33 bp, Artificial Sequence
  Synthetic Construct
gcccaagctaatacggctattaggactgcacag

SEQ ID NO: 5096 - DNA, 33 bp, Artificial Sequence
  Synthetic Construct
gcccaaagcccctacaaccaaaacaacgcacag

SEQ ID NO: 5097 - DNA, 33 bp, Artificial Sequence
  Synthetic Construct
gcccaatcggggaagcagcagacgactgcacag

SEQ ID NO: 5098 - DNA, 33 bp, Artificial Sequence
  Synthetic Construct
gcccaaaatcttccggtgcaggggagtgcacag

SEQ ID NO: 5099 - DNA, 33 bp, Artificial Sequence
  Synthetic Construct
gcccaacccaacctcaccaccgaaagagcacag

SEQ ID NO: 5100 - DNA, 33 bp, Artificial Sequence
  Synthetic Construct
gcccaagctagtcttgttaatactgctgcacag

SEQ ID NO: 5101 - DNA, 33 bp, Artificial Sequence
  Synthetic Construct
gcccaatctactgcgggggatactcgggcacag

SEQ ID NO: 5102 - DNA, 33 bp, Artificial Sequence
  Synthetic Construct
gcccaactcagagacaccagaaccgacgcacag

SEQ ID NO: 5103 - DNA, 33 bp, Artificial Sequence
  Synthetic Construct
gcccaactccaacaagcccaaccccaagcacag

SEQ ID NO: 5104 - DNA, 33 bp, Artificial Sequence
  Synthetic Construct
gcccaatattctcctcatgttacgcctgcacag

SEQ ID NO: 5105 - DNA, 33 bp, Artificial Sequence
  Synthetic Construct
gcccaactccaaatcaaaaccagccccgcacag

SEQ ID NO: 5106 - DNA, 33 bp, Artificial Sequence
  Synthetic Construct
gcccaaagggtgcctccgaatctgcaggcacag

SEQ ID NO: 5107 - DNA, 33 bp, Artificial Sequence
  Synthetic Construct
gcccaacttgctgagcatccgaagacggcacag

SEQ ID NO: 5108 - DNA, 33 bp, Artificial Sequence
  Synthetic Construct
gcccaaattgcggcgcgtagtccgttggcacag

SEQ ID NO: 5109 - DNA, 33 bp, Artificial Sequence
  Synthetic Construct
gcccaaagtggtaagcagcatgaggatgcacag

SEQ ID NO: 5110 - DNA, 33 bp, Artificial Sequence
  Synthetic Construct
gcccaaattgggaatctgcaggcgacggcacag

SEQ ID NO: 5111 - DNA, 33 bp, Artificial Sequence
  Synthetic Construct
gcccaacctgatgcttctcagcgggttgcacag

SEQ ID NO: 5112 - DNA, 33 bp, Artificial Sequence
  Synthetic Construct
gcccaagctgtggataggatgacgcctgcacag

SEQ ID NO: 5113 - DNA, 33 bp, Artificial Sequence
  Synthetic Construct
gcccaatttgggcgtgagaagccggctgcacag

SEQ ID NO: 5114 - DNA, 33 bp, Artificial Sequence
  Synthetic Construct
gcccaacttaataataggccgcagttggcacag

SEQ ID NO: 5115 - DNA, 33 bp, Artificial Sequence
  Synthetic Construct
gcccaaaattttcatggtcggactgatgcacag

SEQ ID NO: 5116 - DNA, 33 bp, Artificial Sequence
  Synthetic Construct
gcccaaggcgtcagactcagcagcaccgcacag

SEQ ID NO: 5117 - DNA, 33 bp, Artificial Sequence
  Synthetic Construct
gcccaaaccgtcaacagccacagacaagcacag

SEQ ID NO: 5118 - DNA, 33 bp, Artificial Sequence
  Synthetic Construct
gcccaaaatagtaatcatacgcctagggcacag

SEQ ID NO: 5119 - DNA, 33 bp, Artificial Sequence
  Synthetic Construct
gcccaagccaacaccatcaccgtcgtcgcacag

SEQ ID NO: 5120 - DNA, 33 bp, Artificial Sequence
  Synthetic Construct
gcccaagacgtcacccaaagcaaacccgcacag

SEQ ID NO: 5121 - DNA, 33 bp, Artificial Sequence
  Synthetic Construct
gcccaaggtaatcatgcgcgtaatctggcacag

SEQ ID NO: 5122 - DNA, 33 bp, Artificial Sequence
  Synthetic Construct
gcccaacaacacagagacaccagcatggcacag

SEQ ID NO: 5123 - DNA, 33 bp, Artificial Sequence
  Synthetic Construct
gcccaactgcagggtaggctgacgtcggcacag

SEQ ID NO: 5124 - DNA, 33 bp, Artificial Sequence
  Synthetic Construct
gcccaaatttctatgagggagcagtcggcacag

SEQ ID NO: 5125 - DNA, 33 bp, Artificial Sequence
  Synthetic Construct
gcccaaaccagaaacttcgaccacaccgcacag

SEQ ID NO: 5126 - DNA, 33 bp, Artificial Sequence
  Synthetic Construct
gcccaagctagtcatcgggcgcagattgcacag

SEQ ID NO: 5127 - DNA, 33 bp, Artificial Sequence
  Synthetic Construct
gcccaaaatcagcagagtcctcataaggcacag

SEQ ID NO: 5128 - DNA, 33 bp, Artificial Sequence
  Synthetic Construct
gcccaaaggccgggggagtcgaatcctgcacag

SEQ ID NO: 5129 - DNA, 33 bp, Artificial Sequence
  Synthetic Construct
gcccaagcgcgtgatagtagtattatggcacag

SEQ ID NO: 5130 - DNA, 33 bp, Artificial Sequence
  Synthetic Construct
gcccaaaccggcatgagcacccaagtcgcacag

SEQ ID NO: 5131 - DNA, 33 bp, Artificial Sequence
  Synthetic Construct
gcccaaatgggtgtgaaggcggatattgcacag

SEQ ID NO: 5132 - DNA, 33 bp, Artificial Sequence
  Synthetic Construct
gcccaacaattcaaaggcatcacccaagcacag

SEQ ID NO: 5133 - DNA, 33 bp, Artificial Sequence
  Synthetic Construct
gcccaacacaacaacagccccacccacgcacag

SEQ ID NO: 5134 - DNA, 33 bp, Artificial Sequence
  Synthetic Construct
gcccaagacagcaacttcaccagcgccgcacag

SEQ ID NO: 5135 - DNA, 33 bp, Artificial Sequence
  Synthetic Construct
gcccaagcggttccgcatatgggtacggcacag

SEQ ID NO: 5136 - DNA, 33 bp, Artificial Sequence
  Synthetic Construct
gcccaagtcgtcagccccaacctcatggcacag

SEQ ID NO: 5137 - DNA, 33 bp, Artificial Sequence
  Synthetic Construct
gcccaacccttccccaaaaccctcgacgcacag

SEQ ID NO: 5138 - DNA, 33 bp, Artificial Sequence
  Synthetic Construct
gcccaacagagtgcgggtcttgcggaggcacag

SEQ ID NO: 5139 - DNA, 33 bp, Artificial Sequence
  Synthetic Construct
gcccaaggcaaagcccacgacctcgccgcacag

SEQ ID NO: 5140 - DNA, 33 bp, Artificial Sequence
  Synthetic Construct
gcccaacaaagaatcagcaccaacgccgcacag

SEQ ID NO: 5141 - DNA, 33 bp, Artificial Sequence
  Synthetic Construct
gcccaatggctcaccaccggcagcagcgcacag

SEQ ID NO: 5142 - DNA, 33 bp, Artificial Sequence
  Synthetic Construct
gcccaatacagagcccaaggccccctcgcacag

SEQ ID NO: 5143 - DNA, 33 bp, Artificial Sequence
  Synthetic Construct
gcccaagtgatgaagaggtatgatgaggcacag

SEQ ID NO: 5144 - DNA, 33 bp, Artificial Sequence
  Synthetic Construct
gcccaactcgaatacagccaaagagacgcacag

SEQ ID NO: 5145 - DNA, 33 bp, Artificial Sequence
  Synthetic Construct
gcccaactccaaaaagtccacctcggcgcacag

SEQ ID NO: 5146 - DNA, 33 bp, Artificial Sequence
  Synthetic Construct
gcccaacgttctcattcgcatccttcggcacag

SEQ ID NO: 5147 - DNA, 33 bp, Artificial Sequence
  Synthetic Construct
gcccaacacaccttcaccagcaccggcgcacag

SEQ ID NO: 5148 - DNA, 33 bp, Artificial Sequence
  Synthetic Construct
gcccaatctgttggtagtggtcctggtgcacag

SEQ ID NO: 5149 - DNA, 33 bp, Artificial Sequence
  Synthetic Construct
gcccaacaaagcttcaacggcagcaacgcacag

SEQ ID NO: 5150 - DNA, 33 bp, Artificial Sequence
  Synthetic Construct
gcccaagtcaccgccatcagaggcgccgcacag

SEQ ID NO: 5151 - DNA, 33 bp, Artificial Sequence
  Synthetic Construct
gcccaattggggaagacgtcttatagtgcacag

SEQ ID NO: 5152 - DNA, 33 bp, Artificial Sequence
  Synthetic Construct
gcccaaagtacgatggcgatggcttctgcacag

SEQ ID NO: 5153 - DNA, 33 bp, Artificial Sequence
  Synthetic Construct
gcccaagcttctggtaggtcttctgctgcacag

SEQ ID NO: 5154 - DNA, 33 bp, Artificial Sequence
  Synthetic Construct
gcccaaggcagaacccccgccgtcgaagcacag

SEQ ID NO: 5155 - DNA, 33 bp, Artificial Sequence
  Synthetic Construct
gcccaaggcagaatcgacgtcagcagcgcacag

SEQ ID NO: 5156 - DNA, 33 bp, Artificial Sequence
  Synthetic Construct
gcccaaacccccaaagtcaacagcagcgcacag

SEQ ID NO: 5157 - DNA, 33 bp, Artificial Sequence
  Synthetic Construct
gcccaaagtgttcggaattcgactactgcacag

SEQ ID NO: 5158 - DNA, 33 bp, Artificial Sequence
  Synthetic Construct
gcccaagttaatggtgctcagcagattgcacag

SEQ ID NO: 5159 - DNA, 33 bp, Artificial Sequence
  Synthetic Construct
gcccaaaacagagccgaaagcttcagagcacag

SEQ ID NO: 5160 - DNA, 33 bp, Artificial Sequence
  Synthetic Construct
gcccaacacgacagagccagcgtcagagcacag

SEQ ID NO: 5161 - DNA, 33 bp, Artificial Sequence
  Synthetic Construct
gcccaagacagccccagcagaggcagagcacag

SEQ ID NO: 5162 - DNA, 33 bp, Artificial Sequence
  Synthetic Construct
gcccaaagcaacaacatccacagcaaagcacag

SEQ ID NO: 5163 - DNA, 33 bp, Artificial Sequence
  Synthetic Construct
gcccaaatcaacaacatcgtcatccccgcacag

SEQ ID NO: 5164 - DNA, 33 bp, Artificial Sequence
  Synthetic Construct
gcccaaattcggagttctgatgagacggcacag

SEQ ID NO: 5165 - DNA, 33 bp, Artificial Sequence
  Synthetic Construct
gcccaaaacatgcccagcctcgtcgccgcacag

SEQ ID NO: 5166 - DNA, 33 bp, Artificial Sequence
  Synthetic Construct
gcccaaaataggacgctggagtctattgcacag

SEQ ID NO: 5167 - DNA, 33 bp, Artificial Sequence
  Synthetic Construct
gcccaaccccaacacaacaaccaacccgcacag

SEQ ID NO: 5168 - DNA, 33 bp, Artificial Sequence
  Synthetic Construct
gcccaactcggctacaacgcccaccccgcacag

SEQ ID NO: 5169 - DNA, 33 bp, Artificial Sequence
  Synthetic Construct
gcccaactcaaacaccaatacgacggcgcacag

SEQ ID NO: 5170 - DNA, 33 bp, Artificial Sequence
  Synthetic Construct
gcccaacactacagccccaccagagaagcacag

SEQ ID NO: 5171 - DNA, 33 bp, Artificial Sequence
  Synthetic Construct
gcccaaagctacagaagcaccagcgacgcacag

SEQ ID NO: 5172 - DNA, 33 bp, Artificial Sequence
  Synthetic Construct
gcccaagttacgcctactgcggctcttgcacag

SEQ ID NO: 5173 - DNA, 33 bp, Artificial Sequence
  Synthetic Construct
gcccaattggagcagcggtatagttctgcacag

SEQ ID NO: 5174 - DNA, 33 bp, Artificial Sequence
  Synthetic Construct
gcccaaatgaataatattaggcagtctgcacag

SEQ ID NO: 5175 - DNA, 33 bp, Artificial Sequence
  Synthetic Construct
gcccaaagtagtcgtaatgatgcttctgcacag

SEQ ID NO: 5176 - DNA, 33 bp, Artificial Sequence
  Synthetic Construct
gcccaaggcaccgacagaaaacccttcgcacag

SEQ ID NO: 5177 - DNA, 33 bp, Artificial Sequence
  Synthetic Construct
gcccaaagagtcaacaaagaagacagagcacag

SEQ ID NO: 5178 - DNA, 33 bp, Artificial Sequence
  Synthetic Construct
gcccaaaccggcagaagcctcgccaccgcacag

SEQ ID NO: 5179 - DNA, 33 bp, Artificial Sequence
  Synthetic Construct
gcccaaatgaagtcttcgacgtcgaatgcacag

SEQ ID NO: 5180 - DNA, 33 bp, Artificial Sequence
  Synthetic Construct
gcccaaagacacgacctcgccagcaacgcacag

SEQ ID NO: 5181 - DNA, 33 bp, Artificial Sequence
  Synthetic Construct
gcccaattgatggcggtgtctactccggcacag

SEQ ID NO: 5182 - DNA, 33 bp, Artificial Sequence
  Synthetic Construct
gcccaaagagaaggcatctacaccctcgcacag

SEQ ID NO: 5183 - DNA, 33 bp, Artificial Sequence
  Synthetic Construct
gcccaagacaacaaaggcagcctcagcgcacag

SEQ ID NO: 5184 - DNA, 33 bp, Artificial Sequence
  Synthetic Construct
gcccaaaaaggccaagtcacccacggcgcacag

SEQ ID NO: 5185 - DNA, 33 bp, Artificial Sequence
  Synthetic Construct
gcccaaagtaagactctgaataatcttgcacag

SEQ ID NO: 5186 - DNA, 33 bp, Artificial Sequence
  Synthetic Construct
gcccaaaggaatccgcaggttcctactgcacag

SEQ ID NO: 5187 - DNA, 33 bp, Artificial Sequence
  Synthetic Construct
gcccaaagtgcgaatgcgtctaatactgcacag

SEQ ID NO: 5188 - DNA, 33 bp, Artificial Sequence
  Synthetic Construct
gcccaaggctacatgaaacccgccatcgcacag

SEQ ID NO: 5189 - DNA, 33 bp, Artificial Sequence
  Synthetic Construct
gcccaaagcagccacggccccacccccgcacag

SEQ ID NO: 5190 - DNA, 33 bp, Artificial Sequence
  Synthetic Construct
gcccaaagcaccagaaaccccccccaagcacag

SEQ ID NO: 5191 - DNA, 33 bp, Artificial Sequence
  Synthetic Construct
gcccaactcaacagaatcaacgaacaagcacag

SEQ ID NO: 5192 - DNA, 33 bp, Artificial Sequence
  Synthetic Construct
gcccaaggcgccgccaaaagccaaaacgcacag

SEQ ID NO: 5193 - DNA, 33 bp, Artificial Sequence
  Synthetic Construct
gcccaactccccaccctccacggccccgcacag

SEQ ID NO: 5194 - DNA, 33 bp, Artificial Sequence
  Synthetic Construct
gcccaagtccccagcaccatcaaaggcgcacag

SEQ ID NO: 5195 - DNA, 33 bp, Artificial Sequence
  Synthetic Construct
gcccaaacgtcgtctatgcgggagtcggcacag

SEQ ID NO: 5196 - DNA, 33 bp, Artificial Sequence
  Synthetic Construct
gcccaactcatgagcagcaacaacgccgcacag

SEQ ID NO: 5197 - DNA, 33 bp, Artificial Sequence
  Synthetic Construct
gcccaagccaaaacccaaagcgccaccgcacag

SEQ ID NO: 5198 - DNA, 33 bp, Artificial Sequence
  Synthetic Construct
gcccaaaaggaggggcagtctaggtatgcacag

SEQ ID NO: 5199 - DNA, 33 bp, Artificial Sequence
  Synthetic Construct
gcccaaaaagtcaacagcagcgccaccgcacag

SEQ ID NO: 5200 - DNA, 33 bp, Artificial Sequence
  Synthetic Construct
gcccaaagaaccaccagcctcgtcgccgcacag

SEQ ID NO: 5201 - DNA, 33 bp, Artificial Sequence
  Synthetic Construct
gcccaaatgactaatcagagtgcgcatgcacag

SEQ ID NO: 5202 - DNA, 33 bp, Artificial Sequence
  Synthetic Construct
gcccaaccccacatcagaggcgaaaacgcacag

SEQ ID NO: 5203 - DNA, 33 bp, Artificial Sequence
  Synthetic Construct
gcccaaagaacccaaagcagcatcagcgcacag

SEQ ID NO: 5204 - DNA, 33 bp, Artificial Sequence
  Synthetic Construct
gcccaaatgtttacgacgacgggtgcggcacag

SEQ ID NO: 5205 - DNA, 33 bp, Artificial Sequence
  Synthetic Construct
gcccaaagcaacatcaaactcatggccgcacag

SEQ ID NO: 5206 - DNA, 33 bp, Artificial Sequence
  Synthetic Construct
gcccaatcgactcagggtactcgggatgcacag

SEQ ID NO: 5207 - DNA, 33 bp, Artificial Sequence
  Synthetic Construct
gcccaaattttgtcggggcgtaatggtgcacag

SEQ ID NO: 5208 - DNA, 33 bp, Artificial Sequence
  Synthetic Construct
gcccaagggctgaaggtgtctgggtctgcacag

SEQ ID NO: 5209 - DNA, 33 bp, Artificial Sequence
  Synthetic Construct
gcccaaaccggcgccaacctccccaacgcacag

SEQ ID NO: 5210 - DNA, 33 bp, Artificial Sequence
  Synthetic Construct
gcccaatacagcctcagcatgcccaacgcacag

SEQ ID NO: 5211 - DNA, 33 bp, Artificial Sequence
  Synthetic Construct
gcccaaacttttgagaggaaggctgcggcacag

SEQ ID NO: 5212 - DNA, 33 bp, Artificial Sequence
  Synthetic Construct
gcccaactcggcagagccagcagcgtcgcacag

SEQ ID NO: 5213 - DNA, 33 bp, Artificial Sequence
  Synthetic Construct
gcccaaagaaccaaaaccagcgacggcgcacag

SEQ ID NO: 5214 - DNA, 33 bp, Artificial Sequence
  Synthetic Construct
gcccaactcaacccccacctcggccccgcacag

SEQ ID NO: 5215 - DNA, 33 bp, Artificial Sequence
  Synthetic Construct
gcccaaatcatgcccaacaacaccatggcacag

SEQ ID NO: 5216 - DNA, 33 bp, Artificial Sequence
  Synthetic Construct
gcccaacataagagtgatagtggttatgcacag

SEQ ID NO: 5217 - DNA, 33 bp, Artificial Sequence
  Synthetic Construct
gcccaagatcggctgaataagaatagtgcacag

SEQ ID NO: 5218 - DNA, 33 bp, Artificial Sequence
  Synthetic Construct
gcccaaatgagcggcggcagcagcaaagcacag

SEQ ID NO: 5219 - DNA, 33 bp, Artificial Sequence
  Synthetic Construct
gcccaacagcgtgagcaggggaatgctgcacag

SEQ ID NO: 5220 - DNA, 33 bp, Artificial Sequence
  Synthetic Construct
gcccaaggtggtggtaatgtgacgtcggcacag

SEQ ID NO: 5221 - DNA, 33 bp, Artificial Sequence
  Synthetic Construct
gcccaaaatctgaagaatgcgtatgttgcacag

SEQ ID NO: 5222 - DNA, 33 bp, Artificial Sequence
  Synthetic Construct
gcccaaagcaaaaacgacagacccggcgcacag

SEQ ID NO: 5223 - DNA, 33 bp, Artificial Sequence
  Synthetic Construct
gcccaaagaggcagcggccaagacatcgcacag

SEQ ID NO: 5224 - DNA, 33 bp, Artificial Sequence
  Synthetic Construct
gcccaagtcggcagcaacaccagctacgcacag

SEQ ID NO: 5225 - DNA, 33 bp, Artificial Sequence
  Synthetic Construct
gcccaaagccccagaatcggcagcaccgcacag

SEQ ID NO: 5226 - DNA, 33 bp, Artificial Sequence
  Synthetic Construct
gcccaaggtactttgaaggagactagtgcacag

SEQ ID NO: 5227 - DNA, 33 bp, Artificial Sequence
  Synthetic Construct
gcccaaagcatccaaagaaccgtcgccgcacag

SEQ ID NO: 5228 - DNA, 33 bp, Artificial Sequence
  Synthetic Construct
gcccaaagaggcgaaagcaacggcaccgcacag

SEQ ID NO: 5229 - DNA, 33 bp, Artificial Sequence
  Synthetic Construct
gcccaagaacccagcaacgccagagtcgcacag

SEQ ID NO: 5230 - DNA, 33 bp, Artificial Sequence
  Synthetic Construct
gcccaaagccaagccaccatgaacaaagcacag

SEQ ID NO: 5231 - DNA, 33 bp, Artificial Sequence
  Synthetic Construct
gcccaagcccaaggcaccagcaccaccgcacag

SEQ ID NO: 5232 - DNA, 33 bp, Artificial Sequence
  Synthetic Construct
gcccaatacatgagcaaaaacaacctcgcacag

SEQ ID NO: 5233 - DNA, 33 bp, Artificial Sequence
  Synthetic Construct
gcccaaaatacgacgaatatgtcgaaggcacag

SEQ ID NO: 5234 - DNA, 33 bp, Artificial Sequence
  Synthetic Construct
gcccaatcgaaggcttctaagactgaggcacag

SEQ ID NO: 5235 - DNA, 33 bp, Artificial Sequence
  Synthetic Construct
gcccaaatggctggttctattgttactgcacag

SEQ ID NO: 5236 - DNA, 33 bp, Artificial Sequence
  Synthetic Construct
gcccaagtgaattcgagtcagactcctgcacag

SEQ ID NO: 5237 - DNA, 33 bp, Artificial Sequence
  Synthetic Construct
gcccaaactcgtagtgctcttcttgatgcacag

SEQ ID NO: 5238 - DNA, 33 bp, Artificial Sequence
  Synthetic Construct
gcccaagggattagttattcgccttctgcacag

SEQ ID NO: 5239 - DNA, 33 bp, Artificial Sequence
  Synthetic Construct
gcccaacatgggagggaggttccgcaggcacag

SEQ ID NO: 5240 - DNA, 33 bp, Artificial Sequence
  Synthetic Construct
gcccaaaccagaagcgccgacaacagagcacag

SEQ ID NO: 5241 - DNA, 33 bp, Artificial Sequence
  Synthetic Construct
gcccaatctgggaattcgtcgcgtggtgcacag

SEQ ID NO: 5242 - DNA, 33 bp, Artificial Sequence
  Synthetic Construct
gcccaaacgacgaaggggaatccttcggcacag

SEQ ID NO: 5243 - DNA, 33 bp, Artificial Sequence
  Synthetic Construct
gcccaagacatgagaagcaccagagacgcacag

SEQ ID NO: 5244 - DNA, 33 bp, Artificial Sequence
  Synthetic Construct
gcccaactgggtaattcgttgccggctgcacag

SEQ ID NO: 5245 - DNA, 33 bp, Artificial Sequence
  Synthetic Construct
gcccaattgactagtatgtcgattcctgcacag

SEQ ID NO: 5246 - DNA, 33 bp, Artificial Sequence
  Synthetic Construct
gcccaaggcacccacatcaaacaagccgcacag

SEQ ID NO: 5247 - DNA, 33 bp, Artificial Sequence
  Synthetic Construct
gcccaaactcagggtcgtattgttagtgcacag

SEQ ID NO: 5248 - DNA, 33 bp, Artificial Sequence
  Synthetic Construct
gcccaactcggcggcaacaacaccctcgcacag

SEQ ID NO: 5249 - DNA, 33 bp, Artificial Sequence
  Synthetic Construct
gcccaaatgtctgcgaataatggtcgtgcacag

SEQ ID NO: 5250 - DNA, 33 bp, Artificial Sequence
  Synthetic Construct
gcccaagttactaatccgatgagtgcggcacag

SEQ ID NO: 5251 - DNA, 33 bp, Artificial Sequence
  Synthetic Construct
gcccaagaggcttataagtctacgtcggcacag

SEQ ID NO: 5252 - DNA, 33 bp, Artificial Sequence
  Synthetic Construct
gcccaaagacccaacaaccaaggccaagcacag

SEQ ID NO: 5253 - DNA, 33 bp, Artificial Sequence
  Synthetic Construct
gcccaaatgaattttgcgggtagtggtgcacag

SEQ ID NO: 5254 - DNA, 33 bp, Artificial Sequence
  Synthetic Construct
gcccaaaagactaatcatagttcgtctgcacag

SEQ ID NO: 5255 - DNA, 33 bp, Artificial Sequence
  Synthetic Construct
gcccaaaatgggtatgggtcgcagacggcacag

SEQ ID NO: 5256 - DNA, 33 bp, Artificial Sequence
  Synthetic Construct
gcccaaaaaaccggccaccaattcaccgcacag

SEQ ID NO: 5257 - DNA, 33 bp, Artificial Sequence
  Synthetic Construct
gcccaaaccgccagaaccctccaactcgcacag

SEQ ID NO: 5258 - DNA, 33 bp, Artificial Sequence
  Synthetic Construct
gcccaacaagccagcaccacccaaatcgcacag

SEQ ID NO: 5259 - DNA, 33 bp, Artificial Sequence
  Synthetic Construct
gcccaaactgcttttgatacgcgtggtgcacag

SEQ ID NO: 5260 - DNA, 33 bp, Artificial Sequence
  Synthetic Construct
gcccaagtcaacagccacgtcgccagagcacag

SEQ ID NO: 5261 - DNA, 33 bp, Artificial Sequence
  Synthetic Construct
gcccaaagtccgcttcattctaatacggcacag

SEQ ID NO: 5262 - DNA, 33 bp, Artificial Sequence
  Synthetic Construct
gcccaactcagcagagtcaccatcaacgcacag

SEQ ID NO: 5263 - DNA, 33 bp, Artificial Sequence
  Synthetic Construct
gcccaaactcagcataatgtggattcggcacag

SEQ ID NO: 5264 - DNA, 33 bp, Artificial Sequence
  Synthetic Construct
gcccaaaccttccaaaccagcaacagcgcacag

SEQ ID NO: 5265 - DNA, 33 bp, Artificial Sequence
  Synthetic Construct
gcccaaagtaatcatgttagtgttaatgcacag

SEQ ID NO: 5266 - DNA, 33 bp, Artificial Sequence
  Synthetic Construct
gcccaaatgctccacagcagcatcaccgcacag

SEQ ID NO: 5267 - DNA, 33 bp, Artificial Sequence
  Synthetic Construct
gcccaactgaaggctactgatgggtcggcacag

SEQ ID NO: 5268 - DNA, 33 bp, Artificial Sequence
  Synthetic Construct
gcccaactcggcaacatgcacaacatggcacag

SEQ ID NO: 5269 - DNA, 33 bp, Artificial Sequence
  Synthetic Construct
gcccaaatcaacagactcatcagcggcgcacag

SEQ ID NO: 5270 - DNA, 33 bp, Artificial Sequence
  Synthetic Construct
gcccaaaccagaagcaacctcgccagcgcacag

SEQ ID NO: 5271 - DNA, 33 bp, Artificial Sequence
  Synthetic Construct
gcccaacattcgaatggtgttaggggggcacag

SEQ ID NO: 5272 - DNA, 33 bp, Artificial Sequence
  Synthetic Construct
gcccaagccggcaaccccagagaaaaagcacag

SEQ ID NO: 5273 - DNA, 33 bp, Artificial Sequence
  Synthetic Construct
gcccaaagagccagagacgtcgacgaagcacag

SEQ ID NO: 5274 - DNA, 33 bp, Artificial Sequence
  Synthetic Construct
gcccaagtcagcaacggccccagcctcgcacag

SEQ ID NO: 5275 - DNA, 33 bp, Artificial Sequence
  Synthetic Construct
gcccaagcgaatcagaggggtgttggggcacag

SEQ ID NO: 5276 - DNA, 33 bp, Artificial Sequence
  Synthetic Construct
gcccaaatgagaagcgaaaccctcaacgcacag

SEQ ID NO: 5277 - DNA, 33 bp, Artificial Sequence
  Synthetic Construct
gcccaaaaacccagcagccaactcctcgcacag

SEQ ID NO: 5278 - DNA, 33 bp, Artificial Sequence
  Synthetic Construct
gcccaaagcctcagaccccacgacagagcacag

SEQ ID NO: 5279 - DNA, 33 bp, Artificial Sequence
  Synthetic Construct
gcccaaggttcgaatgcttcgaagtatgcacag

SEQ ID NO: 5280 - DNA, 33 bp, Artificial Sequence
  Synthetic Construct
gcccaaaccaacagagacctcggccccgcacag

SEQ ID NO: 5281 - DNA, 33 bp, Artificial Sequence
  Synthetic Construct
gcccaatgggggtctactgcgggtgctgcacag

SEQ ID NO: 5282 - DNA, 33 bp, Artificial Sequence
  Synthetic Construct
gcccaaatcagcggcgccgacagaaccgcacag

SEQ ID NO: 5283 - DNA, 33 bp, Artificial Sequence
  Synthetic Construct
gcccaaagcgccgtcagaagccccatcgcacag

SEQ ID NO: 5284 - DNA, 33 bp, Artificial Sequence
  Synthetic Construct
gcccaaagagtcagccacaccgaaaccgcacag

SEQ ID NO: 5285 - DNA, 33 bp, Artificial Sequence
  Synthetic Construct
gcccaaaaagccaacagccaaatcaccgcacag

SEQ ID NO: 5286 - DNA, 33 bp, Artificial Sequence
  Synthetic Construct
gcccaaccgagtgtgtatcgtgagcctgcacag

SEQ ID NO: 5287 - DNA, 33 bp, Artificial Sequence
  Synthetic Construct
gcccaaaccaccaacttcgtcaccagcgcacag

SEQ ID NO: 5288 - DNA, 33 bp, Artificial Sequence
  Synthetic Construct
gcccaaaacctcatgcccaccgacagagcacag

SEQ ID NO: 5289 - DNA, 33 bp, Artificial Sequence
  Synthetic Construct
gcccaaaccaaccacaccggcagccaagcacag

SEQ ID NO: 5290 - DNA, 33 bp, Artificial Sequence
  Synthetic Construct
gcccaacactggaacggcaccaaccccgcacag

SEQ ID NO: 5291 - DNA, 33 bp, Artificial Sequence
  Synthetic Construct
gcccaacataagtctattggtcaggaggcacag

SEQ ID NO: 5292 - DNA, 33 bp, Artificial Sequence
  Synthetic Construct
gcccaaactcggccgattccgattagtgcacag

SEQ ID NO: 5293 - DNA, 33 bp, Artificial Sequence
  Synthetic Construct
gcccaaaaccccggcatgagcagaatggcacag

SEQ ID NO: 5294 - DNA, 33 bp, Artificial Sequence
  Synthetic Construct
gcccaaattgctaatcgggtgtcgcctgcacag

SEQ ID NO: 5295 - DNA, 33 bp, Artificial Sequence
  Synthetic Construct
gcccaaacggcgttggcgaatcagaaggcacag

SEQ ID NO: 5296 - DNA, 33 bp, Artificial Sequence
  Synthetic Construct
gcccaaacttcgctttcttcttctgctgcacag

SEQ ID NO: 5297 - DNA, 33 bp, Artificial Sequence
  Synthetic Construct
gcccaagctttgactggtaatatgtcggcacag

SEQ ID NO: 5298 - DNA, 33 bp, Artificial Sequence
  Synthetic Construct
gcccaaatgcagacgaagaatgtgccggcacag

SEQ ID NO: 5299 - DNA, 33 bp, Artificial Sequence
  Synthetic Construct
gcccaacaggcgactaagactaatgttgcacag

SEQ ID NO: 5300 - DNA, 33 bp, Artificial Sequence
  Synthetic Construct
gcccaactccacaccaccagcagcgtcgcacag

SEQ ID NO: 5301 - DNA, 33 bp, Artificial Sequence
  Synthetic Construct
gcccaatacgtccaaagcagcagcaacgcacag

SEQ ID NO: 5302 - DNA, 33 bp, Artificial Sequence
  Synthetic Construct
gcccaaacgatgaagattcgtactgaggcacag

SEQ ID NO: 5303 - DNA, 33 bp, Artificial Sequence
  Synthetic Construct
gcccaaaagagtcattcgcctgggtcggcacag

SEQ ID NO: 5304 - DNA, 33 bp, Artificial Sequence
  Synthetic Construct
gcccaaaaggcggtggatcctccgaatgcacag

SEQ ID NO: 5305 - DNA, 33 bp, Artificial Sequence
  Synthetic Construct
gcccaaaatgctcctcctatgagtcctgcacag

SEQ ID NO: 5306 - DNA, 33 bp, Artificial Sequence
  Synthetic Construct
gcccaaatcaacaaaatgttcacccccgcacag

SEQ ID NO: 5307 - DNA, 33 bp, Artificial Sequence
  Synthetic Construct
gcccaatatgctaaggcgactttgggtgcacag

SEQ ID NO: 5308 - DNA, 33 bp, Artificial Sequence
  Synthetic Construct
gcccaacatcttgcgcgtccgtctgaggcacag

SEQ ID NO: 5309 - DNA, 33 bp, Artificial Sequence
  Synthetic Construct
gcccaacaactcaacagcgacagaaacgcacag

SEQ ID NO: 5310 - DNA, 33 bp, Artificial Sequence
  Synthetic Construct
gcccaaatgaggcctgatactagttatgcacag

SEQ ID NO: 5311 - DNA, 33 bp, Artificial Sequence
  Synthetic Construct
gcccaaggcgtcgccatgagcagcggcgcacag

SEQ ID NO: 5312 - DNA, 33 bp, Artificial Sequence
  Synthetic Construct
gcccaaggtcattctaggcctgatcgggcacag

SEQ ID NO: 5313 - DNA, 33 bp, Artificial Sequence
  Synthetic Construct
gcccaagtcttccaagccaccagaaccgcacag

SEQ ID NO: 5314 - DNA, 33 bp, Artificial Sequence
  Synthetic Construct
gcccaaacttcgttgacgtcgtatactgcacag

SEQ ID NO: 5315 - DNA, 33 bp, Artificial Sequence
  Synthetic Construct
gcccaaaaactcaacaccggcgacatcgcacag

SEQ ID NO: 5316 - DNA, 33 bp, Artificial Sequence
  Synthetic Construct
gcccaaagaaccaacgaaaccatcgtcgcacag

SEQ ID NO: 5317 - DNA, 33 bp, Artificial Sequence
  Synthetic Construct
gcccaaagactccaaaacagcacccccgcacag

SEQ ID NO: 5318 - DNA, 33 bp, Artificial Sequence
  Synthetic Construct
gcccaaacgtcgcggcttactagtggggcacag

SEQ ID NO: 5319 - DNA, 33 bp, Artificial Sequence
  Synthetic Construct
gcccaaagcaacaccaccttcagcgccgcacag

SEQ ID NO: 5320 - DNA, 33 bp, Artificial Sequence
  Synthetic Construct
gcccaagaccaaagaagcagccccgccgcacag

SEQ ID NO: 5321 - DNA, 33 bp, Artificial Sequence
  Synthetic Construct
gcccaagttgggagtggtgggtctcgtgcacag

SEQ ID NO: 5322 - DNA, 33 bp, Artificial Sequence
  Synthetic Construct
gcccaaagaagcaccaacgcccccaacgcacag

SEQ ID NO: 5323 - DNA, 33 bp, Artificial Sequence
  Synthetic Construct
gcccaaatggcgggtcagcagcggttggcacag

SEQ ID NO: 5324 - DNA, 33 bp, Artificial Sequence
  Synthetic Construct
gcccaaattaggaattctgctcctcctgcacag

SEQ ID NO: 5325 - DNA, 33 bp, Artificial Sequence
  Synthetic Construct
gcccaactgtcgactaagagttttaatgcacag

SEQ ID NO: 5326 - DNA, 33 bp, Artificial Sequence
  Synthetic Construct
gcccaatggccggggtcgattactgcggcacag

SEQ ID NO: 5327 - DNA, 33 bp, Artificial Sequence
  Synthetic Construct
gcccaaaccggcggcgtccacgcccaagcacag

SEQ ID NO: 5328 - DNA, 33 bp, Artificial Sequence
  Synthetic Construct
gcccaatctgagaggtcgtctatggctgcacag

SEQ ID NO: 5329 - DNA, 33 bp, Artificial Sequence
  Synthetic Construct
gcccaatttcagaatggtcggaataatgcacag

SEQ ID NO: 5330 - DNA, 33 bp, Artificial Sequence
  Synthetic Construct
gcccaaggcggcagcagactcccccaagcacag

SEQ ID NO: 5331 - DNA, 33 bp, Artificial Sequence
  Synthetic Construct
gcccaaggcggcaacagcctcagcgtcgcacag

SEQ ID NO: 5332 - DNA, 33 bp, Artificial Sequence
  Synthetic Construct
gcccaatcgaagaagattgatcatggtgcacag

SEQ ID NO: 5333 - DNA, 33 bp, Artificial Sequence
  Synthetic Construct
gcccaatatcgtgatacgttggcggctgcacag

SEQ ID NO: 5334 - DNA, 33 bp, Artificial Sequence
  Synthetic Construct
gcccaactccacagcggcgaaagaaacgcacag

SEQ ID NO: 5335 - DNA, 33 bp, Artificial Sequence
  Synthetic Construct
gcccaaattatgcctcatggttcgcctgcacag

SEQ ID NO: 5336 - DNA, 33 bp, Artificial Sequence
  Synthetic Construct
gcccaaaccgccagaaccctcaacatggcacag

SEQ ID NO: 5337 - DNA, 33 bp, Artificial Sequence
  Synthetic Construct
gcccaagctagtgttcaggggcatagtgcacag

SEQ ID NO: 5338 - DNA, 33 bp, Artificial Sequence
  Synthetic Construct
gcccaattgaataatgctgggagggcggcacag

SEQ ID NO: 5339 - DNA, 33 bp, Artificial Sequence
  Synthetic Construct
gcccaaggcctcagaggcagccacgccgcacag

SEQ ID NO: 5340 - DNA, 33 bp, Artificial Sequence
  Synthetic Construct
gcccaatttgtgcgtgattcttattcggcacag

SEQ ID NO: 5341 - DNA, 33 bp, Artificial Sequence
  Synthetic Construct
gcccaaggcagattcaccggcaccgaagcacag

SEQ ID NO: 5342 - DNA, 33 bp, Artificial Sequence
  Synthetic Construct
gcccaacgtcagaatccgattgagcttgcacag

SEQ ID NO: 5343 - DNA, 33 bp, Artificial Sequence
  Synthetic Construct
gcccaagtcagagacaaattcggcaccgcacag

SEQ ID NO: 5344 - DNA, 33 bp, Artificial Sequence
  Synthetic Construct
gcccaactccccagcaacagcaacagagcacag

SEQ ID NO: 5345 - DNA, 33 bp, Artificial Sequence
  Synthetic Construct
gcccaagtcagacaagaacacaccagcgcacag

SEQ ID NO: 5346 - DNA, 33 bp, Artificial Sequence
  Synthetic Construct
gcccaaatcagacaaggccccaccaacgcacag

SEQ ID NO: 5347 - DNA, 33 bp, Artificial Sequence
  Synthetic Construct
gcccaagactacagcaaaagcaacaccgcacag

SEQ ID NO: 5348 - DNA, 33 bp, Artificial Sequence
  Synthetic Construct
gcccaaatgtcgaatgttaatgtttcggcacag

SEQ ID NO: 5349 - DNA, 33 bp, Artificial Sequence
  Synthetic Construct
gcccaaatgagcagcggcagaagcctcgcacag

SEQ ID NO: 5350 - DNA, 33 bp, Artificial Sequence
  Synthetic Construct
gcccaaggcctcagagacatcagagccgcacag

SEQ ID NO: 5351 - DNA, 33 bp, Artificial Sequence
  Synthetic Construct
gcccaactgatttctgctcataagggtgcacag

SEQ ID NO: 5352 - DNA, 33 bp, Artificial Sequence
  Synthetic Construct
gcccaacccatcaacacccacgccgccgcacag

SEQ ID NO: 5353 - DNA, 33 bp, Artificial Sequence
  Synthetic Construct
gcccaaatgcctcatgtggggaatgctgcacag

SEQ ID NO: 5354 - DNA, 33 bp, Artificial Sequence
  Synthetic Construct
gcccaatatggttcttctgcgattaatgcacag

SEQ ID NO: 5355 - DNA, 33 bp, Artificial Sequence
  Synthetic Construct
gcccaacatgcttctatgcctagttctgcacag

SEQ ID NO: 5356 - DNA, 33 bp, Artificial Sequence
  Synthetic Construct
gcccaatttggggagaatgctcgttttgcacag

SEQ ID NO: 5357 - DNA, 33 bp, Artificial Sequence
  Synthetic Construct
gcccaatctaggcatgatttgccttctgcacag

SEQ ID NO: 5358 - DNA, 33 bp, Artificial Sequence
  Synthetic Construct
gcccaacggtcgcagggtgcgaatatggcacag

SEQ ID NO: 5359 - DNA, 33 bp, Artificial Sequence
  Synthetic Construct
gcccaagccaacagcaacagccacagcgcacag

SEQ ID NO: 5360 - DNA, 33 bp, Artificial Sequence
  Synthetic Construct
gcccaacaggctaggcagaatcagggtgcacag

SEQ ID NO: 5361 - DNA, 33 bp, Artificial Sequence
  Synthetic Construct
gcccaaggtgtggctagtaatacgacggcacag

SEQ ID NO: 5362 - DNA, 33 bp, Artificial Sequence
  Synthetic Construct
gcccaaaagtatagttcttctcagagtgcacag

SEQ ID NO: 5363 - DNA, 33 bp, Artificial Sequence
  Synthetic Construct
gcccaaagcgccaaaaccctcaacaccgcacag

SEQ ID NO: 5364 - DNA, 33 bp, Artificial Sequence
  Synthetic Construct
gcccaaggcatcagaaccaccaacgccgcacag

SEQ ID NO: 5365 - DNA, 33 bp, Artificial Sequence
  Synthetic Construct
gcccaaatgaatacgacgattaatagggcacag

SEQ ID NO: 5366 - DNA, 33 bp, Artificial Sequence
  Synthetic Construct
gcccaactcaaaaacaccagcctccccgcacag

SEQ ID NO: 5367 - DNA, 33 bp, Artificial Sequence
  Synthetic Construct
gcccaaactaatcgtgctgctacgatggcacag

SEQ ID NO: 5368 - DNA, 33 bp, Artificial Sequence
  Synthetic Construct
gcccaacacggctaccccaacgtccccgcacag

SEQ ID NO: 5369 - DNA, 33 bp, Artificial Sequence
  Synthetic Construct
gcccaatggggctacagaggcgccgaagcacag

SEQ ID NO: 5370 - DNA, 33 bp, Artificial Sequence
  Synthetic Construct
gcccaactcctcgtcaccaacaccagcgcacag

SEQ ID NO: 5371 - DNA, 33 bp, Artificial Sequence
  Synthetic Construct
gcccaaaagaatcgtcttcctcctgatgcacag

SEQ ID NO: 5372 - DNA, 33 bp, Artificial Sequence
  Synthetic Construct
gcccaatatcgttcgcaggagcatccggcacag

SEQ ID NO: 5373 - DNA, 33 bp, Artificial Sequence
  Synthetic Construct
gcccaacacggcggcagagtcagccccgcacag

SEQ ID NO: 5374 - DNA, 33 bp, Artificial Sequence
  Synthetic Construct
gcccaagggcagaataggcttgcttcggcacag

SEQ ID NO: 5375 - DNA, 33 bp, Artificial Sequence
  Synthetic Construct
gcccaacagtcggtttctgctacgagggcacag

SEQ ID NO: 5376 - DNA, 33 bp, Artificial Sequence
  Synthetic Construct
gcccaacaaagacccatcccccaagccgcacag

SEQ ID NO: 5377 - DNA, 33 bp, Artificial Sequence
  Synthetic Construct
gcccaacagagggcgattggtattgaggcacag

SEQ ID NO: 5378 - DNA, 33 bp, Artificial Sequence
  Synthetic Construct
gcccaatttgggcatgtgggtattaatgcacag

SEQ ID NO: 5379 - DNA, 33 bp, Artificial Sequence
  Synthetic Construct
gcccaatttgagcatgttcgttcggaggcacag

SEQ ID NO: 5380 - DNA, 33 bp, Artificial Sequence
  Synthetic Construct
gcccaaaaaagcgtcaccagcaacaccgcacag

SEQ ID NO: 5381 - DNA, 33 bp, Artificial Sequence
  Synthetic Construct
gcccaactcaccggcaacgtcaccgccgcacag

SEQ ID NO: 5382 - DNA, 33 bp, Artificial Sequence
  Synthetic Construct
gcccaaaatcatgcgtatccgtcggcggcacag

SEQ ID NO: 5383 - DNA, 33 bp, Artificial Sequence
  Synthetic Construct
gcccaaatgccgcagggtaagagtgttgcacag

SEQ ID NO: 5384 - DNA, 33 bp, Artificial Sequence
  Synthetic Construct
gcccaactcagaaccgccgccaccagcgcacag

SEQ ID NO: 5385 - DNA, 33 bp, Artificial Sequence
  Synthetic Construct
gcccaagattctcagcatcgggtttctgcacag

SEQ ID NO: 5386 - DNA, 33 bp, Artificial Sequence
  Synthetic Construct
gcccaattcctcaacgaacacaccgtcgcacag

SEQ ID NO: 5387 - DNA, 33 bp, Artificial Sequence
  Synthetic Construct
gcccaaaacagcaccggcaccagcatggcacag

SEQ ID NO: 5388 - DNA, 33 bp, Artificial Sequence
  Synthetic Construct
gcccaacatagtcctcctatgtcggcggcacag

SEQ ID NO: 5389 - DNA, 33 bp, Artificial Sequence
  Synthetic Construct
gcccaattgatgtcgcagcgtcctacggcacag

SEQ ID NO: 5390 - DNA, 33 bp, Artificial Sequence
  Synthetic Construct
gcccaaaacaccaacgtcaacccccccgcacag

SEQ ID NO: 5391 - DNA, 33 bp, Artificial Sequence
  Synthetic Construct
gcccaatggggtggttattcttcggctgcacag

SEQ ID NO: 5392 - DNA, 33 bp, Artificial Sequence
  Synthetic Construct
gcccaatacagcctcaaccccagcggcgcacag

SEQ ID NO: 5393 - DNA, 33 bp, Artificial Sequence
  Synthetic Construct
gcccaaaaagaaagcaaagacagagtcgcacag

SEQ ID NO: 5394 - DNA, 33 bp, Artificial Sequence
  Synthetic Construct
gcccaaaagctggtgtcgagtcctgatgcacag

SEQ ID NO: 5395 - DNA, 33 bp, Artificial Sequence
  Synthetic Construct
gcccaaaacaccgccagccacaacgccgcacag

SEQ ID NO: 5396 - DNA, 33 bp, Artificial Sequence
  Synthetic Construct
gcccaagacatgagcaacaaaacctacgcacag

SEQ ID NO: 5397 - DNA, 33 bp, Artificial Sequence
  Synthetic Construct
gcccaactcgtccacaaagacttccccgcacag

SEQ ID NO: 5398 - DNA, 33 bp, Artificial Sequence
  Synthetic Construct
gcccaaaaacccgccctcgcccaaaacgcacag

SEQ ID NO: 5399 - DNA, 33 bp, Artificial Sequence
  Synthetic Construct
gcccaaggcaacgcccaacccagcaaagcacag

SEQ ID NO: 5400 - DNA, 33 bp, Artificial Sequence
  Synthetic Construct
gcccaaagagtcgcccacaccgaaaacgcacag

SEQ ID NO: 5401 - DNA, 33 bp, Artificial Sequence
  Synthetic Construct
gcccaagtttctgcgtcttttatggcggcacag

SEQ ID NO: 5402 - DNA, 33 bp, Artificial Sequence
  Synthetic Construct
gcccaacgggtgctgacggctgatgctgcacag

SEQ ID NO: 5403 - DNA, 33 bp, Artificial Sequence
  Synthetic Construct
gcccaaaccgtcgtcggcaccaaacaagcacag

SEQ ID NO: 5404 - DNA, 33 bp, Artificial Sequence
  Synthetic Construct
gcccaacttgcgaggacgcagccttctgcacag

SEQ ID NO: 5405 - DNA, 33 bp, Artificial Sequence
  Synthetic Construct
gcccaaatgtcgagtagtcattctgctgcacag

SEQ ID NO: 5406 - DNA, 33 bp, Artificial Sequence
  Synthetic Construct
gcccaaccgtcttcgaagtctccgtcggcacag

SEQ ID NO: 5407 - DNA, 33 bp, Artificial Sequence
  Synthetic Construct
gcccaatattctggtgcgatgtcggtggcacag

SEQ ID NO: 5408 - DNA, 33 bp, Artificial Sequence
  Synthetic Construct
gcccaaccgccgcctacgaagtcgtatgcacag

SEQ ID NO: 5409 - DNA, 33 bp, Artificial Sequence
  Synthetic Construct
gcccaatctgcgccgcatgctacgacggcacag

SEQ ID NO: 5410 - DNA, 33 bp, Artificial Sequence
  Synthetic Construct
gcccaagcttctaagcctatggttgctgcacag

SEQ ID NO: 5411 - DNA, 33 bp, Artificial Sequence
  Synthetic Construct
gcccaaaccctcacctacggcgacagagcacag

SEQ ID NO: 5412 - DNA, 33 bp, Artificial Sequence
  Synthetic Construct
gcccaagccagaagcgacagcaaagacgcacag

SEQ ID NO: 5413 - DNA, 33 bp, Artificial Sequence
  Synthetic Construct
gcccaaatgagcaaagccgccagcctcgcacag

SEQ ID NO: 5414 - DNA, 33 bp, Artificial Sequence
  Synthetic Construct
gcccaaagcacccacaccagcgccgtcgcacag

SEQ ID NO: 5415 - DNA, 33 bp, Artificial Sequence
  Synthetic Construct
gcccaaactgctcgtcttcaggatggtgcacag

SEQ ID NO: 5416 - DNA, 33 bp, Artificial Sequence
  Synthetic Construct
gcccaaagacccgtcctcggccaacccgcacag

SEQ ID NO: 5417 - DNA, 33 bp, Artificial Sequence
  Synthetic Construct
gcccaagccagcttcaaaaccgaagtcgcacag

SEQ ID NO: 5418 - DNA, 33 bp, Artificial Sequence
  Synthetic Construct
gcccaagtcaccagaaccgtcaacgccgcacag

SEQ ID NO: 5419 - DNA, 33 bp, Artificial Sequence
  Synthetic Construct
gcccaagaccacgccagaagcggcggcgcacag

SEQ ID NO: 5420 - DNA, 33 bp, Artificial Sequence
  Synthetic Construct
gcccaaacgacgcatttgacggtgagtgcacag

SEQ ID NO: 5421 - DNA, 33 bp, Artificial Sequence
  Synthetic Construct
gcccaagtccccaaaagcaacggcaccgcacag

SEQ ID NO: 5422 - DNA, 33 bp, Artificial Sequence
  Synthetic Construct
gcccaaagactcggcgtcggccccgaagcacag

SEQ ID NO: 5423 - DNA, 33 bp, Artificial Sequence
  Synthetic Construct
gcccaaaacaacagacaaaccagcgacgcacag

SEQ ID NO: 5424 - DNA, 33 bp, Artificial Sequence
  Synthetic Construct
gcccaaagattcaccaacaacgaagccgcacag

SEQ ID NO: 5425 - DNA, 33 bp, Artificial Sequence
  Synthetic Construct
gcccaaagttcgcatcagatgcggggggcacag

SEQ ID NO: 5426 - DNA, 33 bp, Artificial Sequence
  Synthetic Construct
gcccaaactacgatggggacgatgttggcacag

SEQ ID NO: 5427 - DNA, 33 bp, Artificial Sequence
  Synthetic Construct
gcccaaaccaacggcggcgtccccatcgcacag

SEQ ID NO: 5428 - DNA, 33 bp, Artificial Sequence
  Synthetic Construct
gcccaaaaaagcaacgaaggcaacggcgcacag

SEQ ID NO: 5429 - DNA, 33 bp, Artificial Sequence
  Synthetic Construct
gcccaaaacgtcgccatgaccaccctcgcacag

SEQ ID NO: 5430 - DNA, 33 bp, Artificial Sequence
  Synthetic Construct
gcccaatacagcggccacacccccatggcacag

SEQ ID NO: 5431 - DNA, 33 bp, Artificial Sequence
  Synthetic Construct
gcccaaggtactccgaatcgggcgctggcacag

SEQ ID NO: 5432 - DNA, 33 bp, Artificial Sequence
  Synthetic Construct
gcccaaagaagcggccccacccaacccgcacag

SEQ ID NO: 5433 - DNA, 33 bp, Artificial Sequence
  Synthetic Construct
gcccaaatcttcaacctcaaacaagacgcacag

SEQ ID NO: 5434 - DNA, 33 bp, Artificial Sequence
  Synthetic Construct
gcccaacacgccatgagcctcagccccgcacag

SEQ ID NO: 5435 - DNA, 33 bp, Artificial Sequence
  Synthetic Construct
gcccaaagcgaaagcatgctcagagaagcacag

SEQ ID NO: 5436 - DNA, 33 bp, Artificial Sequence
  Synthetic Construct
gcccaactccccagacccccccaagccgcacag

SEQ ID NO: 5437 - DNA, 33 bp, Artificial Sequence
  Synthetic Construct
gcccaacttggtcttggggctttgtctgcacag

SEQ ID NO: 5438 - DNA, 33 bp, Artificial Sequence
  Synthetic Construct
gcccaaattcctaagtcggcggatattgcacag

SEQ ID NO: 5439 - DNA, 33 bp, Artificial Sequence
  Synthetic Construct
gcccaagctcagtcgttgcgtactatggcacag

SEQ ID NO: 5440 - DNA, 33 bp, Artificial Sequence
  Synthetic Construct
gcccaaatgcttactagttcgttggatgcacag

SEQ ID NO: 5441 - DNA, 33 bp, Artificial Sequence
  Synthetic Construct
gcccaaatctacagagacaacgaaagagcacag

SEQ ID NO: 5442 - DNA, 33 bp, Artificial Sequence
  Synthetic Construct
gcccaaagcccccccaccatgcccgccgcacag

SEQ ID NO: 5443 - DNA, 33 bp, Artificial Sequence
  Synthetic Construct
gcccaacctatgaggagtggtacgcctgcacag

SEQ ID NO: 5444 - DNA, 33 bp, Artificial Sequence
  Synthetic Construct
gcccaactcctcagcaaaagcagcgaagcacag

SEQ ID NO: 5445 - DNA, 33 bp, Artificial Sequence
  Synthetic Construct
gcccaaaccgccaacttccaagaaagagcacag

SEQ ID NO: 5446 - DNA, 33 bp, Artificial Sequence
  Synthetic Construct
gcccaaagcggcaacagacccgtcaccgcacag

SEQ ID NO: 5447 - DNA, 33 bp, Artificial Sequence
  Synthetic Construct
gcccaactgaatcaggttgatagtcgtgcacag

SEQ ID NO: 5448 - DNA, 33 bp, Artificial Sequence
  Synthetic Construct
gcccaaattacgccgagttctagtaaggcacag

SEQ ID NO: 5449 - DNA, 33 bp, Artificial Sequence
  Synthetic Construct
gcccaagatgtttcgcttactaaggcggcacag

SEQ ID NO: 5450 - DNA, 33 bp, Artificial Sequence
  Synthetic Construct
gcccaaatcaacatgagaaccgccgtcgcacag

SEQ ID NO: 5451 - DNA, 33 bp, Artificial Sequence
  Synthetic Construct
gcccaatctaagaatactggtagtgctgcacag

SEQ ID NO: 5452 - DNA, 33 bp, Artificial Sequence
  Synthetic Construct
gcccaaggcagcgcccaccaagaacccgcacag

SEQ ID NO: 5453 - DNA, 33 bp, Artificial Sequence
  Synthetic Construct
gcccaatcgaagaatgctctgaatcatgcacag

SEQ ID NO: 5454 - DNA, 33 bp, Artificial Sequence
  Synthetic Construct
gcccaaggtaaggctgtttctgtgagtgcacag

SEQ ID NO: 5455 - DNA, 33 bp, Artificial Sequence
  Synthetic Construct
gcccaatattcggggactggtacggttgcacag

SEQ ID NO: 5456 - DNA, 33 bp, Artificial Sequence
  Synthetic Construct
gcccaaagtattcctgatcgtcgtggtgcacag

SEQ ID NO: 5457 - DNA, 33 bp, Artificial Sequence
  Synthetic Construct
gcccaaaacatcgccaacctcaacgccgcacag

SEQ ID NO: 5458 - DNA, 33 bp, Artificial Sequence
  Synthetic Construct
gcccaatctggtgcgcgtgagttgaatgcacag

SEQ ID NO: 5459 - DNA, 33 bp, Artificial Sequence
  Synthetic Construct
gcccaaggccacagctacaccaaagaagcacag

SEQ ID NO: 5460 - DNA, 33 bp, Artificial Sequence
  Synthetic Construct
gcccaaaccctcaacagcatcagagccgcacag

SEQ ID NO: 5461 - DNA, 33 bp, Artificial Sequence
  Synthetic Construct
gcccaattgtctctttcttcgattgctgcacag

SEQ ID NO: 5462 - DNA, 33 bp, Artificial Sequence
  Synthetic Construct
gcccaaaatgttagtcgggtgacgaatgcacag

SEQ ID NO: 5463 - DNA, 33 bp, Artificial Sequence
  Synthetic Construct
gcccaatatgatacgacggcgaatcgggcacag

SEQ ID NO: 5464 - DNA, 33 bp, Artificial Sequence
  Synthetic Construct
gcccaaatcgacagactcaacagcagcgcacag

SEQ ID NO: 5465 - DNA, 33 bp, Artificial Sequence
  Synthetic Construct
gcccaaaccaccaccaacagaatcagcgcacag

SEQ ID NO: 5466 - DNA, 33 bp, Artificial Sequence
  Synthetic Construct
gcccaatttaatacggttagggatagggcacag

SEQ ID NO: 5467 - DNA, 33 bp, Artificial Sequence
  Synthetic Construct
gcccaacgtacgttggcggatgagcttgcacag

SEQ ID NO: 5468 - DNA, 33 bp, Artificial Sequence
  Synthetic Construct
gcccaaaggcatactattgagcaggcggcacag

SEQ ID NO: 5469 - DNA, 33 bp, Artificial Sequence
  Synthetic Construct
gcccaacaaaccatgggcagcagcgtcgcacag

SEQ ID NO: 5470 - DNA, 33 bp, Artificial Sequence
  Synthetic Construct
gcccaacttaataggccgcagcatagtgcacag

SEQ ID NO: 5471 - DNA, 33 bp, Artificial Sequence
  Synthetic Construct
gcccaaatgagcgtcgccctcagaggcgcacag

SEQ ID NO: 5472 - DNA, 33 bp, Artificial Sequence
  Synthetic Construct
gcccaagacaacctcgccagaatgggcgcacag

SEQ ID NO: 5473 - DNA, 33 bp, Artificial Sequence
  Synthetic Construct
gcccaaacggcgcataatgctttgctggcacag

SEQ ID NO: 5474 - DNA, 33 bp, Artificial Sequence
  Synthetic Construct
gcccaacatacggatcggtctgggcttgcacag

SEQ ID NO: 5475 - DNA, 33 bp, Artificial Sequence
  Synthetic Construct
gcccaatacgtcggcggcatcgtccccgcacag

SEQ ID NO: 5476 - DNA, 33 bp, Artificial Sequence
  Synthetic Construct
gcccaaaagccgaatcagactccgaatgcacag

SEQ ID NO: 5477 - DNA, 33 bp, Artificial Sequence
  Synthetic Construct
gcccaagccggcagcagcctcctccccgcacag

SEQ ID NO: 5478 - DNA, 33 bp, Artificial Sequence
  Synthetic Construct
gcccaaagtaatgttcatgataggtcggcacag

SEQ ID NO: 5479 - DNA, 33 bp, Artificial Sequence
  Synthetic Construct
gcccaagtcaccaaactcggcagccccgcacag

SEQ ID NO: 5480 - DNA, 33 bp, Artificial Sequence
  Synthetic Construct
gcccaaagaggcgtcgaaagaagcagcgcacag

SEQ ID NO: 5481 - DNA, 33 bp, Artificial Sequence
  Synthetic Construct
gcccaaacgagtcttagtggttcgaatgcacag

SEQ ID NO: 5482 - DNA, 33 bp, Artificial Sequence
  Synthetic Construct
gcccaactcagcctcagcaccaacaacgcacag

SEQ ID NO: 5483 - DNA, 33 bp, Artificial Sequence
  Synthetic Construct
gcccaactcggccaaatcaccagacccgcacag

SEQ ID NO: 5484 - DNA, 33 bp, Artificial Sequence
  Synthetic Construct
gcccaaaatgcgtctcctgggagtagtgcacag

SEQ ID NO: 5485 - DNA, 33 bp, Artificial Sequence
  Synthetic Construct
gcccaaatgaaggcgaatagtctttcggcacag

SEQ ID NO: 5486 - DNA, 33 bp, Artificial Sequence
  Synthetic Construct
gcccaacataaggggatggcgaattcggcacag

SEQ ID NO: 5487 - DNA, 33 bp, Artificial Sequence
  Synthetic Construct
gcccaaggcagaaacaactaccccgacgcacag

SEQ ID NO: 5488 - DNA, 33 bp, Artificial Sequence
  Synthetic Construct
gcccaactccccgaccaaaaatggcaagcacag

SEQ ID NO: 5489 - DNA, 33 bp, Artificial Sequence
  Synthetic Construct
gcccaaggcgtcaacaacagaggcagcgcacag

SEQ ID NO: 5490 - DNA, 33 bp, Artificial Sequence
  Synthetic Construct
gcccaaaacagaatcggcatgcaacccgcacag

SEQ ID NO: 5491 - DNA, 33 bp, Artificial Sequence
  Synthetic Construct
gcccaagagaaggtgccgagtctgaatgcacag

SEQ ID NO: 5492 - DNA, 33 bp, Artificial Sequence
  Synthetic Construct
gcccaaggcagagacagcagcaaccccgcacag

SEQ ID NO: 5493 - DNA, 33 bp, Artificial Sequence
  Synthetic Construct
gcccaaaccggcagacccaacctcatggcacag

SEQ ID NO: 5494 - DNA, 33 bp, Artificial Sequence
  Synthetic Construct
gcccaagtcgccggcagaagccccatggcacag

SEQ ID NO: 5495 - DNA, 33 bp, Artificial Sequence
  Synthetic Construct
gcccaactcccccacgtcagcgtccccgcacag

SEQ ID NO: 5496 - DNA, 33 bp, Artificial Sequence
  Synthetic Construct
gcccaactcagaaccggcagcttcgccgcacag

SEQ ID NO: 5497 - DNA, 33 bp, Artificial Sequence
  Synthetic Construct
gcccaagcgggtgtttctagtgggagtgcacag

SEQ ID NO: 5498 - DNA, 33 bp, Artificial Sequence
  Synthetic Construct
gcccaatggagagacagcggccacggcgcacag

SEQ ID NO: 5499 - DNA, 33 bp, Artificial Sequence
  Synthetic Construct
gcccaaagcttcggcaacagacccgtcgcacag

SEQ ID NO: 5500 - DNA, 33 bp, Artificial Sequence
  Synthetic Construct
gcccaaaaagtcagccacaacggcgacgcacag

SEQ ID NO: 5501 - DNA, 33 bp, Artificial Sequence
  Synthetic Construct
gcccaaaacacccccccctacgtccaagcacag

SEQ ID NO: 5502 - DNA, 33 bp, Artificial Sequence
  Synthetic Construct
gcccaaaagaaggataataatcagccggcacag

SEQ ID NO: 5503 - DNA, 33 bp, Artificial Sequence
  Synthetic Construct
gcccaaactattaagtctttgcctgtggcacag

SEQ ID NO: 5504 - DNA, 33 bp, Artificial Sequence
  Synthetic Construct
gcccaaattaatgcgatgcggtcgcaggcacag

SEQ ID NO: 5505 - DNA, 33 bp, Artificial Sequence
  Synthetic Construct
gcccaaggcaacagcatcgccaaaggcgcacag

SEQ ID NO: 5506 - DNA, 33 bp, Artificial Sequence
  Synthetic Construct
gcccaagttactactcctaaggcttttgcacag

SEQ ID NO: 5507 - DNA, 33 bp, Artificial Sequence
  Synthetic Construct
gcccaaggcagcgtcgccggcagcagagcacag

SEQ ID NO: 5508 - DNA, 33 bp, Artificial Sequence
  Synthetic Construct
gcccaaagtgctaataatgctcctaaggcacag

SEQ ID NO: 5509 - DNA, 33 bp, Artificial Sequence
  Synthetic Construct
gcccaagacagactcaaccccctccccgcacag

SEQ ID NO: 5510 - DNA, 33 bp, Artificial Sequence
  Synthetic Construct
gcccaaagaaaccaacccaccgacgtcgcacag

SEQ ID NO: 5511 - DNA, 33 bp, Artificial Sequence
  Synthetic Construct
gcccaaacccaagtcggcagcggccccgcacag

SEQ ID NO: 5512 - DNA, 33 bp, Artificial Sequence
  Synthetic Construct
gcccaactgagtcaggtttcgaggccggcacag

SEQ ID NO: 5513 - DNA, 33 bp, Artificial Sequence
  Synthetic Construct
gcccaaaacggcgccaacctccaaatggcacag

SEQ ID NO: 5514 - DNA, 33 bp, Artificial Sequence
  Synthetic Construct
gcccaaatgttgacgacgaattctgtggcacag

SEQ ID NO: 5515 - DNA, 33 bp, Artificial Sequence
  Synthetic Construct
gcccaaacttctacgcgtccttctccggcacag

SEQ ID NO: 5516 - DNA, 33 bp, Artificial Sequence
  Synthetic Construct
gcccaaaaatacatcggcagcggcgaagcacag

SEQ ID NO: 5517 - DNA, 33 bp, Artificial Sequence
  Synthetic Construct
gcccaaaataatcttacgagggttacggcacag

SEQ ID NO: 5518 - DNA, 33 bp, Artificial Sequence
  Synthetic Construct
gcccaaaaaatcgaaaccatgatgcccgcacag

SEQ ID NO: 5519 - DNA, 33 bp, Artificial Sequence
  Synthetic Construct
gcccaactcagccaccacaccagagacgcacag

SEQ ID NO: 5520 - DNA, 33 bp, Artificial Sequence
  Synthetic Construct
gcccaaactcggacgaatcctactgaggcacag

SEQ ID NO: 5521 - DNA, 33 bp, Artificial Sequence
  Synthetic Construct
gcccaaagcaccagaaacgtcgtcggcgcacag

SEQ ID NO: 5522 - DNA, 33 bp, Artificial Sequence
  Synthetic Construct
gcccaaagcgtcgacctcagaaaagacgcacag

SEQ ID NO: 5523 - DNA, 33 bp, Artificial Sequence
  Synthetic Construct
gcccaaaacgccgccgcccccgccagagcacag

SEQ ID NO: 5524 - DNA, 33 bp, Artificial Sequence
  Synthetic Construct
gcccaaacccaaatcgccatcagccccgcacag

SEQ ID NO: 5525 - DNA, 33 bp, Artificial Sequence
  Synthetic Construct
gcccaacaaaaaaacctcagccaaagcgcacag

SEQ ID NO: 5526 - DNA, 33 bp, Artificial Sequence
  Synthetic Construct
gcccaaacttctatgggtggtgagcctgcacag

SEQ ID NO: 5527 - DNA, 33 bp, Artificial Sequence
  Synthetic Construct
gcccaatctacgtcgcatcagaatacggcacag

SEQ ID NO: 5528 - DNA, 33 bp, Artificial Sequence
  Synthetic Construct
gcccaactcagaggcagcatgcaaagcgcacag

SEQ ID NO: 5529 - DNA, 33 bp, Artificial Sequence
  Synthetic Construct
gcccaagtcacccaccaaatccacaacgcacag

SEQ ID NO: 5530 - DNA, 33 bp, Artificial Sequence
  Synthetic Construct
gcccaaaacgtcagaaacgcccccggcgcacag

SEQ ID NO: 5531 - DNA, 33 bp, Artificial Sequence
  Synthetic Construct
gcccaacagtcgaggagtgctgctgcggcacag

SEQ ID NO: 5532 - DNA, 33 bp, Artificial Sequence
  Synthetic Construct
gcccaacataatcaggcgccttcgggtgcacag

SEQ ID NO: 5533 - DNA, 33 bp, Artificial Sequence
  Synthetic Construct
gcccaaattggttcgatgcatcatactgcacag

SEQ ID NO: 5534 - DNA, 33 bp, Artificial Sequence
  Synthetic Construct
gcccaaaccaaccccggccccctcgccgcacag

SEQ ID NO: 5535 - DNA, 33 bp, Artificial Sequence
  Synthetic Construct
gcccaaaacaccccccacaacgccagcgcacag

SEQ ID NO: 5536 - DNA, 33 bp, Artificial Sequence
  Synthetic Construct
gcccaaagagtcatcggcaacagcagcgcacag

SEQ ID NO: 5537 - DNA, 33 bp, Artificial Sequence
  Synthetic Construct
gcccaatcgactgggaatcggtcggttgcacag

SEQ ID NO: 5538 - DNA, 33 bp, Artificial Sequence
  Synthetic Construct
gcccaaatgaattctgaggtgactcgggcacag

SEQ ID NO: 5539 - DNA, 33 bp, Artificial Sequence
  Synthetic Construct
gcccaacagcaggctaagggttcgactgcacag

SEQ ID NO: 5540 - DNA, 33 bp, Artificial Sequence
  Synthetic Construct
gcccaacttggtattcagcgtgggggtgcacag

SEQ ID NO: 5541 - DNA, 33 bp, Artificial Sequence
  Synthetic Construct
gcccaacatgtgggtgcggctacttcggcacag

SEQ ID NO: 5542 - DNA, 33 bp, Artificial Sequence
  Synthetic Construct
gcccaaaagtggaattctacgatggaggcacag

SEQ ID NO: 5543 - DNA, 33 bp, Artificial Sequence
  Synthetic Construct
gcccaaagcagagtccccgaaagcaacgcacag

SEQ ID NO: 5544 - DNA, 33 bp, Artificial Sequence
  Synthetic Construct
gcccaactcatggccaaaagcatgagcgcacag

SEQ ID NO: 5545 - DNA, 33 bp, Artificial Sequence
  Synthetic Construct
gcccaacggcctatggagccttcgattgcacag

SEQ ID NO: 5546 - DNA, 33 bp, Artificial Sequence
  Synthetic Construct
gcccaacaagtcaccagcagcagacccgcacag

SEQ ID NO: 5547 - DNA, 33 bp, Artificial Sequence
  Synthetic Construct
gcccaaagagacgccaacatgagcagcgcacag

SEQ ID NO: 5548 - DNA, 33 bp, Artificial Sequence
  Synthetic Construct
gcccaaggtttgctgagtcaggatggggcacag

SEQ ID NO: 5549 - DNA, 33 bp, Artificial Sequence
  Synthetic Construct
gcccaaaccatcaacgcccacagcatcgcacag

SEQ ID NO: 5550 - DNA, 33 bp, Artificial Sequence
  Synthetic Construct
gcccaacttacgggtaataagccgcaggcacag

SEQ ID NO: 5551 - DNA, 33 bp, Artificial Sequence
  Synthetic Construct
gcccaaaccttcgacaccaacaaaaccgcacag

SEQ ID NO: 5552 - DNA, 33 bp, Artificial Sequence
  Synthetic Construct
gcccaaactctgcagacgacgcgtcttgcacag

SEQ ID NO: 5553 - DNA, 33 bp, Artificial Sequence
  Synthetic Construct
gcccaaaccagccaaatgagaagccccgcacag

SEQ ID NO: 5554 - DNA, 33 bp, Artificial Sequence
  Synthetic Construct
gcccaagttagtccttctaataaggctgcacag

SEQ ID NO: 5555 - DNA, 33 bp, Artificial Sequence
  Synthetic Construct
gcccaacttaatcggacgtatcctcctgcacag

SEQ ID NO: 5556 - DNA, 33 bp, Artificial Sequence
  Synthetic Construct
gcccaaaatgcggagctggctgtgagggcacag

SEQ ID NO: 5557 - DNA, 33 bp, Artificial Sequence
  Synthetic Construct
gcccaaaggccgaatacgacgactgatgcacag

SEQ ID NO: 5558 - DNA, 33 bp, Artificial Sequence
  Synthetic Construct
gcccaaaccaacagaacccaactctacgcacag

SEQ ID NO: 5559 - DNA, 33 bp, Artificial Sequence
  Synthetic Construct
gcccaacccaaaagcagcggcatcaacgcacag

SEQ ID NO: 5560 - DNA, 33 bp, Artificial Sequence
  Synthetic Construct
gcccaaaacaacagcaacaccagacaagcacag

SEQ ID NO: 5561 - DNA, 33 bp, Artificial Sequence
  Synthetic Construct
gcccaacgtgtgacggatgctgggtcggcacag

SEQ ID NO: 5562 - DNA, 33 bp, Artificial Sequence
  Synthetic Construct
gcccaagacacccccaccaccagaaccgcacag

SEQ ID NO: 5563 - DNA, 33 bp, Artificial Sequence
  Synthetic Construct
gcccaaaacctcaacctcagcatgagcgcacag

SEQ ID NO: 5564 - DNA, 33 bp, Artificial Sequence
  Synthetic Construct
gcccaacctaatcggactgctaataatgcacag

SEQ ID NO: 5565 - DNA, 33 bp, Artificial Sequence
  Synthetic Construct
gcccaatggaatcggacgagtacggctgcacag

SEQ ID NO: 5566 - DNA, 33 bp, Artificial Sequence
  Synthetic Construct
gcccaacaaagcaaccccgtcatccccgcacag

SEQ ID NO: 5567 - DNA, 33 bp, Artificial Sequence
  Synthetic Construct
gcccaaatcagaaacgtcaccagcgacgcacag

SEQ ID NO: 5568 - DNA, 33 bp, Artificial Sequence
  Synthetic Construct
gcccaagaagtcaccgacaccaccagagcacag

SEQ ID NO: 5569 - DNA, 33 bp, Artificial Sequence
  Synthetic Construct
gcccaagcccaaaacaaaagcggccccgcacag

SEQ ID NO: 5570 - DNA, 33 bp, Artificial Sequence
  Synthetic Construct
gcccaatatattaatcagactgagtctgcacag

SEQ ID NO: 5571 - DNA, 33 bp, Artificial Sequence
  Synthetic Construct
gcccaaagagtccccgtcagcgaaaacgcacag

SEQ ID NO: 5572 - DNA, 33 bp, Artificial Sequence
  Synthetic Construct
gcccaacaaaacggcaccaaactccaagcacag

SEQ ID NO: 5573 - DNA, 33 bp, Artificial Sequence
  Synthetic Construct
gcccaagggtattctaataatacggctgcacag

SEQ ID NO: 5574 - DNA, 33 bp, Artificial Sequence
  Synthetic Construct
gcccaaaacagaggcatgggcaacgtcgcacag

SEQ ID NO: 5575 - DNA, 33 bp, Artificial Sequence
  Synthetic Construct
gcccaatatatgagggatccgtcgactgcacag

SEQ ID NO: 5576 - DNA, 33 bp, Artificial Sequence
  Synthetic Construct
gcccaaagcatccccagcagagacgtcgcacag

SEQ ID NO: 5577 - DNA, 33 bp, Artificial Sequence
  Synthetic Construct
gcccaaggtcctgtttctatgaattctgcacag

SEQ ID NO: 5578 - DNA, 33 bp, Artificial Sequence
  Synthetic Construct
gcccaatctgagggggtgactcgtcttgcacag

SEQ ID NO: 5579 - DNA, 33 bp, Artificial Sequence
  Synthetic Construct
gcccaaagcgtcaacgccggcgccatggcacag

SEQ ID NO: 5580 - DNA, 33 bp, Artificial Sequence
  Synthetic Construct
gcccaagagatgacgaagacgattcctgcacag

SEQ ID NO: 5581 - DNA, 33 bp, Artificial Sequence
  Synthetic Construct
gcccaacacgccagcgtcaaaatgcccgcacag

SEQ ID NO: 5582 - DNA, 33 bp, Artificial Sequence
  Synthetic Construct
gcccaaaacaacggcctcaaactcagcgcacag

SEQ ID NO: 5583 - DNA, 33 bp, Artificial Sequence
  Synthetic Construct
gcccaacctgtttctcataatgctggtgcacag

SEQ ID NO: 5584 - DNA, 33 bp, Artificial Sequence
  Synthetic Construct
gcccaaaaagtcgccgccgccgccgccgcacag

SEQ ID NO: 5585 - DNA, 33 bp, Artificial Sequence
  Synthetic Construct
gcccaaatggcgaatgcgattaggagtgcacag

SEQ ID NO: 5586 - DNA, 33 bp, Artificial Sequence
  Synthetic Construct
gcccaattcggccaaagcaccagcggcgcacag

SEQ ID NO: 5587 - DNA, 33 bp, Artificial Sequence
  Synthetic Construct
gcccaaacgtcgagtacgattcttagggcacag

SEQ ID NO: 5588 - DNA, 33 bp, Artificial Sequence
  Synthetic Construct
gcccaaaacgtcagcagagccgaacacgcacag

SEQ ID NO: 5589 - DNA, 33 bp, Artificial Sequence
  Synthetic Construct
gcccaaagaaccgcccccagcaccgaagcacag

SEQ ID NO: 5590 - DNA, 33 bp, Artificial Sequence
  Synthetic Construct
gcccaactcgccagaagcgaacacctcgcacag

SEQ ID NO: 5591 - DNA, 33 bp, Artificial Sequence
  Synthetic Construct
gcccaaagcaccggccaccccagccaagcacag

SEQ ID NO: 5592 - DNA, 33 bp, Artificial Sequence
  Synthetic Construct
gcccaatcgcgtccggataagaatctggcacag

SEQ ID NO: 5593 - DNA, 33 bp, Artificial Sequence
  Synthetic Construct
gcccaaaaaaaaagcgacagccccaacgcacag

SEQ ID NO: 5594 - DNA, 33 bp, Artificial Sequence
  Synthetic Construct
gcccaagtcaacagcagaatctacgccgcacag

SEQ ID NO: 5595 - DNA, 33 bp, Artificial Sequence
  Synthetic Construct
gcccaactgcggcagatggctaatggggcacag

SEQ ID NO: 5596 - DNA, 33 bp, Artificial Sequence
  Synthetic Construct
gcccaagaaagactcaaaggcagcagcgcacag

SEQ ID NO: 5597 - DNA, 33 bp, Artificial Sequence
  Synthetic Construct
gcccaaatgtcgtatatgcgggtggatgcacag

SEQ ID NO: 5598 - DNA, 33 bp, Artificial Sequence
  Synthetic Construct
gcccaatttaattctaagcttcagcttgcacag

SEQ ID NO: 5599 - DNA, 33 bp, Artificial Sequence
  Synthetic Construct
gcccaaagagaacacgtcaacgacagcgcacag

SEQ ID NO: 5600 - DNA, 33 bp, Artificial Sequence
  Synthetic Construct
gcccaaggcagccccagccaaaacaccgcacag

SEQ ID NO: 5601 - DNA, 33 bp, Artificial Sequence
  Synthetic Construct
gcccaacatactgctgagaaggctccggcacag

SEQ ID NO: 5602 - DNA, 33 bp, Artificial Sequence
  Synthetic Construct
gcccaaagcatgagcggcaaactcgacgcacag

SEQ ID NO: 5603 - DNA, 33 bp, Artificial Sequence
  Synthetic Construct
gcccaaaccagccaaagcagaaccagcgcacag

SEQ ID NO: 5604 - DNA, 33 bp, Artificial Sequence
  Synthetic Construct
gcccaatggccgacgcagagtggtagtgcacag

SEQ ID NO: 5605 - DNA, 33 bp, Artificial Sequence
  Synthetic Construct
gcccaagacaacaccaccagactcaaagcacag

SEQ ID NO: 5606 - DNA, 33 bp, Artificial Sequence
  Synthetic Construct
gcccaatcgtctgctgctgggaagtgggcacag

SEQ ID NO: 5607 - DNA, 33 bp, Artificial Sequence
  Synthetic Construct
gcccaatcgaagtttgctcatgtggctgcacag

SEQ ID NO: 5608 - DNA, 33 bp, Artificial Sequence
  Synthetic Construct
gcccaacaaacctaccaaggcagcaccgcacag

SEQ ID NO: 5609 - DNA, 33 bp, Artificial Sequence
  Synthetic Construct
gcccaaaccgtcaacctcaacagagccgcacag

SEQ ID NO: 5610 - DNA, 33 bp, Artificial Sequence
  Synthetic Construct
gcccaaagatacggcagcagcctccccgcacag

SEQ ID NO: 5611 - DNA, 33 bp, Artificial Sequence
  Synthetic Construct
gcccaaagaagcaacagcagcaacctcgcacag

SEQ ID NO: 5612 - DNA, 33 bp, Artificial Sequence
  Synthetic Construct
gcccaacaaggccccagcatcagagacgcacag

SEQ ID NO: 5613 - DNA, 33 bp, Artificial Sequence
  Synthetic Construct
gcccaatggagagacctcgcccccgtcgcacag

SEQ ID NO: 5614 - DNA, 33 bp, Artificial Sequence
  Synthetic Construct
gcccaacacagcgacatccaaagacccgcacag

SEQ ID NO: 5615 - DNA, 33 bp, Artificial Sequence
  Synthetic Construct
gcccaattggcggcgatgacgaatgctgcacag

SEQ ID NO: 5616 - DNA, 33 bp, Artificial Sequence
  Synthetic Construct
gcccaaagcgccaaccacacccacaccgcacag

SEQ ID NO: 5617 - DNA, 33 bp, Artificial Sequence
  Synthetic Construct
gcccaagggaagctgtcggtggagaatgcacag

SEQ ID NO: 5618 - DNA, 33 bp, Artificial Sequence
  Synthetic Construct
gcccaaaaacccggcgccaacccccccgcacag

SEQ ID NO: 5619 - DNA, 33 bp, Artificial Sequence
  Synthetic Construct
gcccaacttactgagggtcgtcatgatgcacag

SEQ ID NO: 5620 - DNA, 33 bp, Artificial Sequence
  Synthetic Construct
gcccaacttgggtcgaatatttatccggcacag

SEQ ID NO: 5621 - DNA, 33 bp, Artificial Sequence
  Synthetic Construct
gcccaaaacggcgcccacagcagcgaagcacag

SEQ ID NO: 5622 - DNA, 33 bp, Artificial Sequence
  Synthetic Construct
gcccaaaatacgatgggtggtgcggcggcacag

SEQ ID NO: 5623 - DNA, 33 bp, Artificial Sequence
  Synthetic Construct
gcccaaagaacccccatcggccaacccgcacag

SEQ ID NO: 5624 - DNA, 33 bp, Artificial Sequence
  Synthetic Construct
gcccaatatagtgtggctcagcagccggcacag

SEQ ID NO: 5625 - DNA, 33 bp, Artificial Sequence
  Synthetic Construct
gcccaacctcattctaaggggatgcttgcacag

SEQ ID NO: 5626 - DNA, 33 bp, Artificial Sequence
  Synthetic Construct
gcccaagttccggcgcatgggatgggtgcacag

SEQ ID NO: 5627 - DNA, 33 bp, Artificial Sequence
  Synthetic Construct
gcccaaattggtggggttcctcagcgtgcacag

SEQ ID NO: 5628 - DNA, 33 bp, Artificial Sequence
  Synthetic Construct
gcccaagtgcaggggacggtttcgagggcacag

SEQ ID NO: 5629 - DNA, 33 bp, Artificial Sequence
  Synthetic Construct
gcccaaagtggtgggagtggtgctcctgcacag

SEQ ID NO: 5630 - DNA, 33 bp, Artificial Sequence
  Synthetic Construct
gcccaaaaagtccccacccaaaccgaagcacag

SEQ ID NO: 5631 - DNA, 33 bp, Artificial Sequence
  Synthetic Construct
gcccaaatttcgacgatgaagcctagtgcacag

SEQ ID NO: 5632 - DNA, 33 bp, Artificial Sequence
  Synthetic Construct
gcccaaagcagagtcgtcgaacaagccgcacag

SEQ ID NO: 5633 - DNA, 33 bp, Artificial Sequence
  Synthetic Construct
gcccaagtcctcagcagacaaagcaccgcacag

SEQ ID NO: 5634 - DNA, 33 bp, Artificial Sequence
  Synthetic Construct
gcccaagtcgtcaccaccagcagcatggcacag

SEQ ID NO: 5635 - DNA, 33 bp, Artificial Sequence
  Synthetic Construct
gcccaaagtacgggttcttcgggtttggcacag

SEQ ID NO: 5636 - DNA, 33 bp, Artificial Sequence
  Synthetic Construct
gcccaacccaacagagccgccaacaacgcacag

SEQ ID NO: 5637 - DNA, 33 bp, Artificial Sequence
  Synthetic Construct
gcccaatatcctgttaatagtcagcctgcacag

SEQ ID NO: 5638 - DNA, 33 bp, Artificial Sequence
  Synthetic Construct
gcccaaaaaagcgccagcccctacgacgcacag

SEQ ID NO: 5639 - DNA, 33 bp, Artificial Sequence
  Synthetic Construct
gcccaaagcaaaagctggggcgccgccgcacag

SEQ ID NO: 5640 - DNA, 33 bp, Artificial Sequence
  Synthetic Construct
gcccaatctgcgatgctgaaggttgatgcacag

SEQ ID NO: 5641 - DNA, 33 bp, Artificial Sequence
  Synthetic Construct
gcccaacggagtcagacgattcaggctgcacag

SEQ ID NO: 5642 - DNA, 33 bp, Artificial Sequence
  Synthetic Construct
gcccaacccagcagcagactcggcgacgcacag

SEQ ID NO: 5643 - DNA, 33 bp, Artificial Sequence
  Synthetic Construct
gcccaaatcggccccagaggcacccaagcacag

SEQ ID NO: 5644 - DNA, 33 bp, Artificial Sequence
  Synthetic Construct
gcccaagccagcaaaggccaatacctcgcacag

SEQ ID NO: 5645 - DNA, 33 bp, Artificial Sequence
  Synthetic Construct
gcccaagttaggactcttactgttgatgcacag

SEQ ID NO: 5646 - DNA, 33 bp, Artificial Sequence
  Synthetic Construct
gcccaacgtgggaatgctgcgaatgaggcacag

SEQ ID NO: 5647 - DNA, 33 bp, Artificial Sequence
  Synthetic Construct
gcccaattcggcagccaccccagcgtcgcacag

SEQ ID NO: 5648 - DNA, 33 bp, Artificial Sequence
  Synthetic Construct
gcccaaggtcatccgactcctgttaatgcacag

SEQ ID NO: 5649 - DNA, 33 bp, Artificial Sequence
  Synthetic Construct
gcccaaagcctcaaccccgtcagaatggcacag

SEQ ID NO: 5650 - DNA, 33 bp, Artificial Sequence
  Synthetic Construct
gcccaaagtattcggggtcagccttttgcacag

SEQ ID NO: 5651 - DNA, 33 bp, Artificial Sequence
  Synthetic Construct
gcccaaaccgccaaattcaaccaaggcgcacag

SEQ ID NO: 5652 - DNA, 33 bp, Artificial Sequence
  Synthetic Construct
gcccaattgatttcgacgcatgatatggcacag

SEQ ID NO: 5653 - DNA, 33 bp, Artificial Sequence
  Synthetic Construct
gcccaacaaagcagagacaacatcagagcacag

SEQ ID NO: 5654 - DNA, 33 bp, Artificial Sequence
  Synthetic Construct
gcccaaaacaacggcaacaaaggcttcgcacag

SEQ ID NO: 5655 - DNA, 33 bp, Artificial Sequence
  Synthetic Construct
gcccaaaatgtgaattatgatgggcgggcacag

SEQ ID NO: 5656 - DNA, 33 bp, Artificial Sequence
  Synthetic Construct
gcccaattcatgaaaggcgccagcgccgcacag

SEQ ID NO: 5657 - DNA, 33 bp, Artificial Sequence
  Synthetic Construct
gcccaactcgccaccagcacccaaatggcacag

SEQ ID NO: 5658 - DNA, 33 bp, Artificial Sequence
  Synthetic Construct
gcccaagttcatggtgggtattcggctgcacag

SEQ ID NO: 5659 - DNA, 33 bp, Artificial Sequence
  Synthetic Construct
gcccaaagaggcagcgaacccatgcaagcacag

SEQ ID NO: 5660 - DNA, 33 bp, Artificial Sequence
  Synthetic Construct
gcccaaggtctgcgtacgagtgggacggcacag

SEQ ID NO: 5661 - DNA, 33 bp, Artificial Sequence
  Synthetic Construct
gcccaactctacaaaggcggcgtcagcgcacag

SEQ ID NO: 5662 - DNA, 33 bp, Artificial Sequence
  Synthetic Construct
gcccaaatgaaaacccacagcccccccgcacag

SEQ ID NO: 5663 - protein, 11 aa, Artificial Sequence
  Synthetic Construct
AQTLQIPFKAQ

SEQ ID NO: 5664 - protein, 11 aa, Artificial Sequence
  Synthetic Construct
AQTALKPFLAQ

SEQ ID NO: 5665 - protein, 11 aa, Artificial Sequence
  Synthetic Construct
AQTTLKPFLAQ

SEQ ID NO: 5666 - protein, 11 aa, Artificial Sequence
  Synthetic Construct
AQSIERPFKAQ

SEQ ID NO: 5667 - protein, 11 aa, Artificial Sequence
  Synthetic Construct
AQTQNRPFLAQ

SEQ ID NO: 5668 - protein, 11 aa, Artificial Sequence
  Synthetic Construct
AQTMQKPFIAQ

SEQ ID NO: 5669 - protein, 11 aa, Artificial Sequence
  Synthetic Construct
AQTSTRPFLAQ

SEQ ID NO: 5670 - protein, 11 aa, Artificial Sequence
  Synthetic Construct
AQGTFVPPTAQ

SEQ ID NO: 5671 - protein, 11 aa, Artificial Sequence
  Synthetic Construct
AQWSTNAGYAQ

SEQ ID NO: 5672 - protein, 11 aa, Artificial Sequence
  Synthetic Construct
AQTLERPFTAQ

SEQ ID NO: 5673 - protein, 11 aa, Artificial Sequence
  Synthetic Construct
AQTAAKPFLAQ

SEQ ID NO: 5674 - protein, 11 aa, Artificial Sequence
  Synthetic Construct
AQIRIGYSQAQ

SEQ ID NO: 5675 - protein, 11 aa, Artificial Sequence
  Synthetic Construct
AQERVGFAQAQ

SEQ ID NO: 5676 - protein, 11 aa, Artificial Sequence
  Synthetic Construct
AQADLLNYRAQ

SEQ ID NO: 5677 - protein, 11 aa, Artificial Sequence
  Synthetic Construct
AQLVAGFSQAQ

SEQ ID NO: 5678 - protein, 11 aa, Artificial Sequence
  Synthetic Construct
AQSSLKPFLAQ

SEQ ID NO: 5679 - protein, 11 aa, Artificial Sequence
  Synthetic Construct
AQTHSRPFIAQ

SEQ ID NO: 5680 - protein, 11 aa, Artificial Sequence
  Synthetic Construct
AQPFPGYSAAQ

SEQ ID NO: 5681 - protein, 11 aa, Artificial Sequence
  Synthetic Construct
AQIIVGYSQAQ

SEQ ID NO: 5682 - protein, 11 aa, Artificial Sequence
  Synthetic Construct
AQRYQGDSVAQ

SEQ ID NO: 5683 - protein, 11 aa, Artificial Sequence
  Synthetic Construct
AQRYAGDSIAQ

SEQ ID NO: 5684 - protein, 11 aa, Artificial Sequence
  Synthetic Construct
AQKTIGEHWAQ

SEQ ID NO: 5685 - protein, 11 aa, Artificial Sequence
  Synthetic Construct
AQWMTHGSAAQ

SEQ ID NO: 5686 - protein, 11 aa, Artificial Sequence
  Synthetic Construct
AQAASRPFLAQ

SEQ ID NO: 5687 - protein, 11 aa, Artificial Sequence
  Synthetic Construct
AQTTSRPFLAQ

SEQ ID NO: 5688 - protein, 11 aa, Artificial Sequence
  Synthetic Construct
AQARVGLAQAQ

SEQ ID NO: 5689 - protein, 11 aa, Artificial Sequence
  Synthetic Construct
AQGTSPNLAAQ

SEQ ID NO: 5690 - protein, 11 aa, Artificial Sequence
  Synthetic Construct
AQVRTGYSSAQ

SEQ ID NO: 5691 - protein, 11 aa, Artificial Sequence
  Synthetic Construct
AQIRVGYSSAQ

SEQ ID NO: 5692 - protein, 11 aa, Artificial Sequence
  Synthetic Construct
AQTTLRPFIAQ

SEQ ID NO: 5693 - protein, 11 aa, Artificial Sequence
  Synthetic Construct
AQGITSLFKAQ

SEQ ID NO: 5694 - protein, 11 aa, Artificial Sequence
  Synthetic Construct
AQTTQTPFRAQ

SEQ ID NO: 5695 - protein, 11 aa, Artificial Sequence
  Synthetic Construct
AQTVSRPFLAQ

SEQ ID NO: 5696 - protein, 11 aa, Artificial Sequence
  Synthetic Construct
AQYGTNPFRAQ

SEQ ID NO: 5697 - protein, 11 aa, Artificial Sequence
  Synthetic Construct
AQPTMVDSSAQ

SEQ ID NO: 5698 - protein, 11 aa, Artificial Sequence
  Synthetic Construct
AQNKASSQNAQ

SEQ ID NO: 5699 - protein, 11 aa, Artificial Sequence
  Synthetic Construct
AQTFRSSNDAQ

SEQ ID NO: 5700 - protein, 11 aa, Artificial Sequence
  Synthetic Construct
AQLPDRYPNAQ

SEQ ID NO: 5701 - protein, 11 aa, Artificial Sequence
  Synthetic Construct
AQQNVTKGVAQ

SEQ ID NO: 5702 - protein, 11 aa, Artificial Sequence
  Synthetic Construct
AQAQSPILRAQ

SEQ ID NO: 5703 - protein, 11 aa, Artificial Sequence
  Synthetic Construct
AQVATGYSSAQ

SEQ ID NO: 5704 - protein, 11 aa, Artificial Sequence
  Synthetic Construct
AQLNSNRPNAQ

SEQ ID NO: 5705 - protein, 11 aa, Artificial Sequence
  Synthetic Construct
AQTIRNNTIAQ

SEQ ID NO: 5706 - protein, 11 aa, Artificial Sequence
  Synthetic Construct
AQDLSRIFKAQ

SEQ ID NO: 5707 - protein, 11 aa, Artificial Sequence
  Synthetic Construct
AQLSNSASQAQ

SEQ ID NO: 5708 - protein, 11 aa, Artificial Sequence
  Synthetic Construct
AQLENMVMSAQ

SEQ ID NO: 5709 - protein, 11 aa, Artificial Sequence
  Synthetic Construct
AQLTQQTDVAQ

SEQ ID NO: 5710 - protein, 11 aa, Artificial Sequence
  Synthetic Construct
AQAGLAHATAQ

SEQ ID NO: 5711 - protein, 11 aa, Artificial Sequence
  Synthetic Construct
AQNAHTALDAQ

SEQ ID NO: 5712 - protein, 11 aa, Artificial Sequence
  Synthetic Construct
AQWPILRADAQ

SEQ ID NO: 5713 - protein, 11 aa, Artificial Sequence
  Synthetic Construct
AQALAGLSLAQ

SEQ ID NO: 5714 - protein, 11 aa, Artificial Sequence
  Synthetic Construct
AQRIDMPFKAQ

SEQ ID NO: 5715 - protein, 11 aa, Artificial Sequence
  Synthetic Construct
AQTMSLSSSAQ

SEQ ID NO: 5716 - protein, 11 aa, Artificial Sequence
  Synthetic Construct
AQQNVAKNLAQ

SEQ ID NO: 5717 - protein, 11 aa, Artificial Sequence
  Synthetic Construct
AQFDNPNNVAQ

SEQ ID NO: 5718 - protein, 11 aa, Artificial Sequence
  Synthetic Construct
AQVLMRESLAQ

SEQ ID NO: 5719 - protein, 11 aa, Artificial Sequence
  Synthetic Construct
AQHHDTGSAAQ

SEQ ID NO: 5720 - protein, 11 aa, Artificial Sequence
  Synthetic Construct
AQDAPNSVDAQ

SEQ ID NO: 5721 - protein, 11 aa, Artificial Sequence
  Synthetic Construct
AQTASRDAKAQ

SEQ ID NO: 5722 - protein, 11 aa, Artificial Sequence
  Synthetic Construct
AQTNYTKQIAQ

SEQ ID NO: 5723 - protein, 11 aa, Artificial Sequence
  Synthetic Construct
AQPHNASVLAQ

SEQ ID NO: 5724 - protein, 11 aa, Artificial Sequence
  Synthetic Construct
AQTNNTRNIAQ

SEQ ID NO: 5725 - protein, 11 aa, Artificial Sequence
  Synthetic Construct
AQMVPNHSGAQ

SEQ ID NO: 5726 - protein, 11 aa, Artificial Sequence
  Synthetic Construct
AQPVPQSEHAQ

SEQ ID NO: 5727 - protein, 11 aa, Artificial Sequence
  Synthetic Construct
AQLYHGGSTAQ

SEQ ID NO: 5728 - protein, 11 aa, Artificial Sequence
  Synthetic Construct
AQMIHTRETAQ

SEQ ID NO: 5729 - protein, 11 aa, Artificial Sequence
  Synthetic Construct
AQTNNTKPLAQ

SEQ ID NO: 5730 - protein, 11 aa, Artificial Sequence
  Synthetic Construct
AQLNTTRNTAQ

SEQ ID NO: 5731 - protein, 11 aa, Artificial Sequence
  Synthetic Construct
AQALHNSQNAQ

SEQ ID NO: 5732 - protein, 11 aa, Artificial Sequence
  Synthetic Construct
AQVNSTRNVAQ

SEQ ID NO: 5733 - protein, 11 aa, Artificial Sequence
  Synthetic Construct
AQGVGVVTKAQ

SEQ ID NO: 5734 - protein, 11 aa, Artificial Sequence
  Synthetic Construct
AQVLSKQLAAQ

SEQ ID NO: 5735 - protein, 11 aa, Artificial Sequence
  Synthetic Construct
AQSKSLQPLAQ

SEQ ID NO: 5736 - protein, 11 aa, Artificial Sequence
  Synthetic Construct
AQSNSTRLVAQ

SEQ ID NO: 5737 - protein, 11 aa, Artificial Sequence
  Synthetic Construct
AQLNQTKQIAQ

SEQ ID NO: 5738 - protein, 11 aa, Artificial Sequence
  Synthetic Construct
AQNNSVRQLAQ

SEQ ID NO: 5739 - protein, 11 aa, Artificial Sequence
  Synthetic Construct
AQMSGYSHTAQ

SEQ ID NO: 5740 - protein, 11 aa, Artificial Sequence
  Synthetic Construct
AQVKVPIITAQ

SEQ ID NO: 5741 - protein, 11 aa, Artificial Sequence
  Synthetic Construct
AQGNNTRAVAQ

SEQ ID NO: 5742 - protein, 11 aa, Artificial Sequence
  Synthetic Construct
AQQNQIKNIAQ

SEQ ID NO: 5743 - protein, 11 aa, Artificial Sequence
  Synthetic Construct
AQTNMTKPLAQ

SEQ ID NO: 5744 - protein, 11 aa, Artificial Sequence
  Synthetic Construct
AQNNSTRLSAQ

SEQ ID NO: 5745 - protein, 11 aa, Artificial Sequence
  Synthetic Construct
AQSMLTSIVAQ

SEQ ID NO: 5746 - protein, 11 aa, Artificial Sequence
  Synthetic Construct
AQLNATASRAQ

SEQ ID NO: 5747 - protein, 11 aa, Artificial Sequence
  Synthetic Construct
AQNTGVQVRAQ

SEQ ID NO: 5748 - protein, 11 aa, Artificial Sequence
  Synthetic Construct
AQTNTVRPIAQ

SEQ ID NO: 5749 - protein, 11 aa, Artificial Sequence
  Synthetic Construct
AQQSTPGATAQ

SEQ ID NO: 5750 - protein, 11 aa, Artificial Sequence
  Synthetic Construct
AQGHSENSRAQ

SEQ ID NO: 5751 - protein, 11 aa, Artificial Sequence
  Synthetic Construct
AQLPTQTLRAQ

SEQ ID NO: 5752 - protein, 11 aa, Artificial Sequence
  Synthetic Construct
AQKNAPMPDAQ

SEQ ID NO: 5753 - protein, 11 aa, Artificial Sequence
  Synthetic Construct
AQSNSTKPTAQ

SEQ ID NO: 5754 - protein, 11 aa, Artificial Sequence
  Synthetic Construct
AQPIITMPAAQ

SEQ ID NO: 5755 - protein, 11 aa, Artificial Sequence
  Synthetic Construct
AQPLKGIGSAQ

SEQ ID NO: 5756 - protein, 11 aa, Artificial Sequence
  Synthetic Construct
AQVLSVNHLAQ

SEQ ID NO: 5757 - protein, 11 aa, Artificial Sequence
  Synthetic Construct
AQSVAAVHMAQ

SEQ ID NO: 5758 - protein, 11 aa, Artificial Sequence
  Synthetic Construct
AQSNSIRLVAQ

SEQ ID NO: 5759 - protein, 11 aa, Artificial Sequence
  Synthetic Construct
AQHNDTRPLAQ

SEQ ID NO: 5760 - protein, 11 aa, Artificial Sequence
  Synthetic Construct
AQPPVRSTAAQ

SEQ ID NO: 5761 - protein, 11 aa, Artificial Sequence
  Synthetic Construct
AQMNTVRNLAQ

SEQ ID NO: 5762 - protein, 11 aa, Artificial Sequence
  Synthetic Construct
AQLTDGHRIAQ

SEQ ID NO: 5763 - protein, 11 aa, Artificial Sequence
  Synthetic Construct
AQTNAVKLTAQ

SEQ ID NO: 5764 - protein, 11 aa, Artificial Sequence
  Synthetic Construct
AQRVDAVLSAQ

SEQ ID NO: 5765 - protein, 11 aa, Artificial Sequence
  Synthetic Construct
AQTNAVKSTAQ

SEQ ID NO: 5766 - protein, 11 aa, Artificial Sequence
  Synthetic Construct
AQMLNTTARAQ

SEQ ID NO: 5767 - protein, 11 aa, Artificial Sequence
  Synthetic Construct
AQGNNTRPTAQ

SEQ ID NO: 5768 - protein, 11 aa, Artificial Sequence
  Synthetic Construct
AQQSGGSALAQ

SEQ ID NO: 5769 - protein, 11 aa, Artificial Sequence
  Synthetic Construct
AQVIALSTMAQ

SEQ ID NO: 5770 - protein, 11 aa, Artificial Sequence
  Synthetic Construct
AQLNTIRNVAQ

SEQ ID NO: 5771 - protein, 11 aa, Artificial Sequence
  Synthetic Construct
AQSNATRSVAQ

SEQ ID NO: 5772 - protein, 11 aa, Artificial Sequence
  Synthetic Construct
AQGNGTKFIAQ

SEQ ID NO: 5773 - protein, 11 aa, Artificial Sequence
  Synthetic Construct
AQSNTIRPVAQ

SEQ ID NO: 5774 - protein, 11 aa, Artificial Sequence
  Synthetic Construct
AQSNSTRAIAQ

SEQ ID NO: 5775 - protein, 11 aa, Artificial Sequence
  Synthetic Construct
AQFHLTDRGAQ

SEQ ID NO: 5776 - protein, 11 aa, Artificial Sequence
  Synthetic Construct
AQPIRSDTVAQ

SEQ ID NO: 5777 - protein, 11 aa, Artificial Sequence
  Synthetic Construct
AQANQIHNTAQ

SEQ ID NO: 5778 - protein, 11 aa, Artificial Sequence
  Synthetic Construct
AQSNTVRNTAQ

SEQ ID NO: 5779 - protein, 11 aa, Artificial Sequence
  Synthetic Construct
AQTSLGYSSAQ

SEQ ID NO: 5780 - protein, 11 aa, Artificial Sequence
  Synthetic Construct
AQISGVQTRAQ

SEQ ID NO: 5781 - protein, 11 aa, Artificial Sequence
  Synthetic Construct
AQSNAVRQTAQ

SEQ ID NO: 5782 - protein, 11 aa, Artificial Sequence
  Synthetic Construct
AQSLSELRIAQ

SEQ ID NO: 5783 - protein, 11 aa, Artificial Sequence
  Synthetic Construct
AQSTEKRDEAQ

SEQ ID NO: 5784 - protein, 11 aa, Artificial Sequence
  Synthetic Construct
AQNLVGTLIAQ

SEQ ID NO: 5785 - protein, 11 aa, Artificial Sequence
  Synthetic Construct
AQGNNIRLTAQ

SEQ ID NO: 5786 - protein, 11 aa, Artificial Sequence
  Synthetic Construct
AQAVPTGLRAQ

SEQ ID NO: 5787 - protein, 11 aa, Artificial Sequence
  Synthetic Construct
AQGDNSLTRAQ

SEQ ID NO: 5788 - protein, 11 aa, Artificial Sequence
  Synthetic Construct
AQHADNRLKAQ

SEQ ID NO: 5789 - protein, 11 aa, Artificial Sequence
  Synthetic Construct
AQSNATRNFAQ

SEQ ID NO: 5790 - protein, 11 aa, Artificial Sequence
  Synthetic Construct
AQGNTTRGLAQ

SEQ ID NO: 5791 - protein, 11 aa, Artificial Sequence
  Synthetic Construct
AQLNLTATNAQ

SEQ ID NO: 5792 - protein, 11 aa, Artificial Sequence
  Synthetic Construct
AQSGVSTTDAQ

SEQ ID NO: 5793 - protein, 11 aa, Artificial Sequence
  Synthetic Construct
AQYAKTLAMAQ

SEQ ID NO: 5794 - protein, 11 aa, Artificial Sequence
  Synthetic Construct
AQMNHTKPTAQ

SEQ ID NO: 5795 - protein, 11 aa, Artificial Sequence
  Synthetic Construct
AQANATRNSAQ

SEQ ID NO: 5796 - protein, 11 aa, Artificial Sequence
  Synthetic Construct
AQQNQTKITAQ

SEQ ID NO: 5797 - protein, 11 aa, Artificial Sequence
  Synthetic Construct
AQSNAIKATAQ

SEQ ID NO: 5798 - protein, 11 aa, Artificial Sequence
  Synthetic Construct
AQYPDNYGKAQ

SEQ ID NO: 5799 - protein, 11 aa, Artificial Sequence
  Synthetic Construct
AQGNTTIRSAQ

SEQ ID NO: 5800 - protein, 11 aa, Artificial Sequence
  Synthetic Construct
AQLGLTGAVAQ

SEQ ID NO: 5801 - protein, 11 aa, Artificial Sequence
  Synthetic Construct
AQANSTRILAQ

SEQ ID NO: 5802 - protein, 11 aa, Artificial Sequence
  Synthetic Construct
AQDNAIRAQAQ

SEQ ID NO: 5803 - protein, 11 aa, Artificial Sequence
  Synthetic Construct
AQTNYTKLMAQ

SEQ ID NO: 5804 - protein, 11 aa, Artificial Sequence
  Synthetic Construct
AQHNSPSSYAQ

SEQ ID NO: 5805 - protein, 11 aa, Artificial Sequence
  Synthetic Construct
AQENMVRSVAQ

SEQ ID NO: 5806 - protein, 11 aa, Artificial Sequence
  Synthetic Construct
AQTNNIKSYAQ

SEQ ID NO: 5807 - protein, 11 aa, Artificial Sequence
  Synthetic Construct
AQTNSTRPVAQ

SEQ ID NO: 5808 - protein, 11 aa, Artificial Sequence
  Synthetic Construct
AQHTAPPHPAQ

SEQ ID NO: 5809 - protein, 11 aa, Artificial Sequence
  Synthetic Construct
AQALSQNTSAQ

SEQ ID NO: 5810 - protein, 11 aa, Artificial Sequence
  Synthetic Construct
AQPNVTKNAAQ

SEQ ID NO: 5811 - protein, 11 aa, Artificial Sequence
  Synthetic Construct
AQLDTLTGYAQ

SEQ ID NO: 5812 - protein, 11 aa, Artificial Sequence
  Synthetic Construct
AQPNSVRSVAQ

SEQ ID NO: 5813 - protein, 11 aa, Artificial Sequence
  Synthetic Construct
AQTSSHLPHAQ

SEQ ID NO: 5814 - protein, 11 aa, Artificial Sequence
  Synthetic Construct
AQVLHGGNDAQ

SEQ ID NO: 5815 - protein, 11 aa, Artificial Sequence
  Synthetic Construct
AQSNYVKSAAQ

SEQ ID NO: 5816 - protein, 11 aa, Artificial Sequence
  Synthetic Construct
AQDNNSTRWAQ

SEQ ID NO: 5817 - protein, 11 aa, Artificial Sequence
  Synthetic Construct
AQTVMKGFTAQ

SEQ ID NO: 5818 - protein, 11 aa, Artificial Sequence
  Synthetic Construct
AQSHTLSTLAQ

SEQ ID NO: 5819 - protein, 11 aa, Artificial Sequence
  Synthetic Construct
AQPGPQQAKAQ

SEQ ID NO: 5820 - protein, 11 aa, Artificial Sequence
  Synthetic Construct
AQTFGTSKLAQ

SEQ ID NO: 5821 - protein, 11 aa, Artificial Sequence
  Synthetic Construct
AQSNAVTNRAQ

SEQ ID NO: 5822 - protein, 11 aa, Artificial Sequence
  Synthetic Construct
AQLSMSTVPAQ

SEQ ID NO: 5823 - protein, 11 aa, Artificial Sequence
  Synthetic Construct
AQRRYDGREAQ

SEQ ID NO: 5824 - protein, 11 aa, Artificial Sequence
  Synthetic Construct
AQTNSTKNIAQ

SEQ ID NO: 5825 - protein, 11 aa, Artificial Sequence
  Synthetic Construct
AQINAQWSAAQ

SEQ ID NO: 5826 - protein, 11 aa, Artificial Sequence
  Synthetic Construct
AQAQTSNDPAQ

SEQ ID NO: 5827 - protein, 11 aa, Artificial Sequence
  Synthetic Construct
AQTNETRMVAQ

SEQ ID NO: 5828 - protein, 11 aa, Artificial Sequence
  Synthetic Construct
AQANATRGVAQ

SEQ ID NO: 5829 - protein, 11 aa, Artificial Sequence
  Synthetic Construct
AQADVNASGAQ

SEQ ID NO: 5830 - protein, 11 aa, Artificial Sequence
  Synthetic Construct
AQLSERNYVAQ

SEQ ID NO: 5831 - protein, 11 aa, Artificial Sequence
  Synthetic Construct
AQSGELARAAQ

SEQ ID NO: 5832 - protein, 11 aa, Artificial Sequence
  Synthetic Construct
AQGNTAKNIAQ

SEQ ID NO: 5833 - protein, 11 aa, Artificial Sequence
  Synthetic Construct
AQDNAVRPLAQ

SEQ ID NO: 5834 - protein, 11 aa, Artificial Sequence
  Synthetic Construct
AQMMLSGLNAQ

SEQ ID NO: 5835 - protein, 11 aa, Artificial Sequence
  Synthetic Construct
AQPNTIRNVAQ

SEQ ID NO: 5836 - protein, 11 aa, Artificial Sequence
  Synthetic Construct
AQENLTRGVAQ

SEQ ID NO: 5837 - protein, 11 aa, Artificial Sequence
  Synthetic Construct
AQFSARSTGAQ

SEQ ID NO: 5838 - protein, 11 aa, Artificial Sequence
  Synthetic Construct
AQENATRTYAQ

SEQ ID NO: 5839 - protein, 11 aa, Artificial Sequence
  Synthetic Construct
AQGNSTRMNAQ

SEQ ID NO: 5840 - protein, 11 aa, Artificial Sequence
  Synthetic Construct
AQGNSTKSPAQ

SEQ ID NO: 5841 - protein, 11 aa, Artificial Sequence
  Synthetic Construct
AQMQTTLHLAQ

SEQ ID NO: 5842 - protein, 11 aa, Artificial Sequence
  Synthetic Construct
AQNPTLITLAQ

SEQ ID NO: 5843 - protein, 11 aa, Artificial Sequence
  Synthetic Construct
AQLISGHAQAQ

SEQ ID NO: 5844 - protein, 11 aa, Artificial Sequence
  Synthetic Construct
AQFNQVRSLAQ

SEQ ID NO: 5845 - protein, 11 aa, Artificial Sequence
  Synthetic Construct
AQMNILREVAQ

SEQ ID NO: 5846 - protein, 11 aa, Artificial Sequence
  Synthetic Construct
AQSAMMRGVAQ

SEQ ID NO: 5847 - protein, 11 aa, Artificial Sequence
  Synthetic Construct
AQPMLSSPSAQ

SEQ ID NO: 5848 - protein, 11 aa, Artificial Sequence
  Synthetic Construct
AQQNNTLRSAQ

SEQ ID NO: 5849 - protein, 11 aa, Artificial Sequence
  Synthetic Construct
AQRHSDPVEAQ

SEQ ID NO: 5850 - protein, 11 aa, Artificial Sequence
  Synthetic Construct
AQVNTTFSTAQ

SEQ ID NO: 5851 - protein, 11 aa, Artificial Sequence
  Synthetic Construct
AQINSTRGIAQ

SEQ ID NO: 5852 - protein, 11 aa, Artificial Sequence
  Synthetic Construct
AQTNAVRDLAQ

SEQ ID NO: 5853 - protein, 11 aa, Artificial Sequence
  Synthetic Construct
AQSNSTRLSAQ

SEQ ID NO: 5854 - protein, 11 aa, Artificial Sequence
  Synthetic Construct
AQTSIAGSFAQ

SEQ ID NO: 5855 - protein, 11 aa, Artificial Sequence
  Synthetic Construct
AQLGSTYPRAQ

SEQ ID NO: 5856 - protein, 11 aa, Artificial Sequence
  Synthetic Construct
AQANVTTQRAQ

SEQ ID NO: 5857 - protein, 11 aa, Artificial Sequence
  Synthetic Construct
AQSNSVRLSAQ

SEQ ID NO: 5858 - protein, 11 aa, Artificial Sequence
  Synthetic Construct
AQATNEPDRAQ

SEQ ID NO: 5859 - protein, 11 aa, Artificial Sequence
  Synthetic Construct
AQRMNPEQSAQ

SEQ ID NO: 5860 - protein, 11 aa, Artificial Sequence
  Synthetic Construct
AQSVSGSANAQ

SEQ ID NO: 5861 - protein, 11 aa, Artificial Sequence
  Synthetic Construct
AQPSNSTTRAQ

SEQ ID NO: 5862 - protein, 11 aa, Artificial Sequence
  Synthetic Construct
AQLFHGTHEAQ

SEQ ID NO: 5863 - protein, 11 aa, Artificial Sequence
  Synthetic Construct
AQPQLGSTKAQ

SEQ ID NO: 5864 - protein, 11 aa, Artificial Sequence
  Synthetic Construct
AQPISANRLAQ

SEQ ID NO: 5865 - protein, 11 aa, Artificial Sequence
  Synthetic Construct
AQNSGNLSMAQ

SEQ ID NO: 5866 - protein, 11 aa, Artificial Sequence
  Synthetic Construct
AQKVEAIGMAQ

SEQ ID NO: 5867 - protein, 11 aa, Artificial Sequence
  Synthetic Construct
AQKTLLNSVAQ

SEQ ID NO: 5868 - protein, 11 aa, Artificial Sequence
  Synthetic Construct
AQNAMDLKVAQ

SEQ ID NO: 5869 - protein, 11 aa, Artificial Sequence
  Synthetic Construct
AQMMGNGSSAQ

SEQ ID NO: 5870 - protein, 11 aa, Artificial Sequence
  Synthetic Construct
AQSNSTKALAQ

SEQ ID NO: 5871 - protein, 11 aa, Artificial Sequence
  Synthetic Construct
AQSNSTRGTAQ

SEQ ID NO: 5872 - protein, 11 aa, Artificial Sequence
  Synthetic Construct
AQSLSSLHVAQ

SEQ ID NO: 5873 - protein, 11 aa, Artificial Sequence
  Synthetic Construct
AQTLSGALTAQ

SEQ ID NO: 5874 - protein, 11 aa, Artificial Sequence
  Synthetic Construct
AQPNTVRNNAQ

SEQ ID NO: 5875 - protein, 11 aa, Artificial Sequence
  Synthetic Construct
AQNNNVKMTAQ

SEQ ID NO: 5876 - protein, 11 aa, Artificial Sequence
  Synthetic Construct
AQSVAKPFMAQ

SEQ ID NO: 5877 - protein, 11 aa, Artificial Sequence
  Synthetic Construct
AQTQTTRLSAQ

SEQ ID NO: 5878 - protein, 11 aa, Artificial Sequence
  Synthetic Construct
AQNNATRGGAQ

SEQ ID NO: 5879 - protein, 11 aa, Artificial Sequence
  Synthetic Construct
AQTNTTARIAQ

SEQ ID NO: 5880 - protein, 11 aa, Artificial Sequence
  Synthetic Construct
AQENSIRTIAQ

SEQ ID NO: 5881 - protein, 11 aa, Artificial Sequence
  Synthetic Construct
AQIRETSGKAQ

SEQ ID NO: 5882 - protein, 11 aa, Artificial Sequence
  Synthetic Construct
AQSIYYHTEAQ

SEQ ID NO: 5883 - protein, 11 aa, Artificial Sequence
  Synthetic Construct
AQVLDNSGQAQ

SEQ ID NO: 5884 - protein, 11 aa, Artificial Sequence
  Synthetic Construct
AQSHNMTIRAQ

SEQ ID NO: 5885 - protein, 11 aa, Artificial Sequence
  Synthetic Construct
AQTIPSAGKAQ

SEQ ID NO: 5886 - protein, 11 aa, Artificial Sequence
  Synthetic Construct
APPRHTLSQAQ

SEQ ID NO: 5887 - protein, 11 aa, Artificial Sequence
  Synthetic Construct
AQSLNVQDVAQ

SEQ ID NO: 5888 - protein, 11 aa, Artificial Sequence
  Synthetic Construct
AQYQSLANPAQ

SEQ ID NO: 5889 - protein, 11 aa, Artificial Sequence
  Synthetic Construct
AQILNMSTDAQ

SEQ ID NO: 5890 - protein, 11 aa, Artificial Sequence
  Synthetic Construct
AQVLHLGHSAQ

SEQ ID NO: 5891 - protein, 11 aa, Artificial Sequence
  Synthetic Construct
AQGVTQTPRAQ

SEQ ID NO: 5892 - protein, 11 aa, Artificial Sequence
  Synthetic Construct
AQTNDTRRIAQ

SEQ ID NO: 5893 - protein, 11 aa, Artificial Sequence
  Synthetic Construct
AQQTDHTSRAQ

SEQ ID NO: 5894 - protein, 11 aa, Artificial Sequence
  Synthetic Construct
AQKNEIKNVAQ

SEQ ID NO: 5895 - protein, 11 aa, Artificial Sequence
  Synthetic Construct
AQWTGNERLAQ

SEQ ID NO: 5896 - protein, 11 aa, Artificial Sequence
  Synthetic Construct
AQGKSDAMRAQ

SEQ ID NO: 5897 - protein, 11 aa, Artificial Sequence
  Synthetic Construct
AQGNATRTYAQ

SEQ ID NO: 5898 - protein, 11 aa, Artificial Sequence
  Synthetic Construct
AQASNLGLPAQ

SEQ ID NO: 5899 - protein, 11 aa, Artificial Sequence
  Synthetic Construct
AQSSLSGSPAQ

SEQ ID NO: 5900 - protein, 11 aa, Artificial Sequence
  Synthetic Construct
AQAAVNQGVAQ

SEQ ID NO: 5901 - protein, 11 aa, Artificial Sequence
  Synthetic Construct
AQDQNQPREAQ

SEQ ID NO: 5902 - protein, 11 aa, Artificial Sequence
  Synthetic Construct
AQLTQDKQAAQ

SEQ ID NO: 5903 - protein, 11 aa, Artificial Sequence
  Synthetic Construct
AQFGSNEHNAQ

SEQ ID NO: 5904 - protein, 11 aa, Artificial Sequence
  Synthetic Construct
AQLNQPNVRAQ

SEQ ID NO: 5905 - protein, 11 aa, Artificial Sequence
  Synthetic Construct
AQMNTTRNLAQ

SEQ ID NO: 5906 - protein, 11 aa, Artificial Sequence
  Synthetic Construct
AQTNSTRTSAQ

SEQ ID NO: 5907 - protein, 11 aa, Artificial Sequence
  Synthetic Construct
AQFELSHVPAQ

SEQ ID NO: 5908 - protein, 11 aa, Artificial Sequence
  Synthetic Construct
AQEGLGNAAAQ

SEQ ID NO: 5909 - protein, 11 aa, Artificial Sequence
  Synthetic Construct
AQLTVTLNHAQ

SEQ ID NO: 5910 - protein, 11 aa, Artificial Sequence
  Synthetic Construct
AQFGNAIQSAQ

SEQ ID NO: 5911 - protein, 11 aa, Artificial Sequence
  Synthetic Construct
AQPGGGLTPAQ

SEQ ID NO: 5912 - protein, 11 aa, Artificial Sequence
  Synthetic Construct
AQPNMTRSLAQ

SEQ ID NO: 5913 - protein, 11 aa, Artificial Sequence
  Synthetic Construct
AQSQLHRLQAQ

SEQ ID NO: 5914 - protein, 11 aa, Artificial Sequence
  Synthetic Construct
AQNDPVLTVAQ

SEQ ID NO: 5915 - protein, 11 aa, Artificial Sequence
  Synthetic Construct
AQENSVRTTAQ

SEQ ID NO: 5916 - protein, 11 aa, Artificial Sequence
  Synthetic Construct
AQDRVTNPKAQ

SEQ ID NO: 5917 - protein, 11 aa, Artificial Sequence
  Synthetic Construct
AQLNTGQMRAQ

SEQ ID NO: 5918 - protein, 11 aa, Artificial Sequence
  Synthetic Construct
AQISPSQVKAQ

SEQ ID NO: 5919 - protein, 11 aa, Artificial Sequence
  Synthetic Construct
AQYSADKTTAQ

SEQ ID NO: 5920 - protein, 11 aa, Artificial Sequence
  Synthetic Construct
AQIDSAGMAAQ

SEQ ID NO: 5921 - protein, 11 aa, Artificial Sequence
  Synthetic Construct
AQSNNIKLNAQ

SEQ ID NO: 5922 - protein, 11 aa, Artificial Sequence
  Synthetic Construct
AQLETQPRTAQ

SEQ ID NO: 5923 - protein, 11 aa, Artificial Sequence
  Synthetic Construct
AQNLHSNVLAQ

SEQ ID NO: 5924 - protein, 11 aa, Artificial Sequence
  Synthetic Construct
AQMVKDTQLAQ

SEQ ID NO: 5925 - protein, 11 aa, Artificial Sequence
  Synthetic Construct
AQLMHLTNPAQ

SEQ ID NO: 5926 - protein, 11 aa, Artificial Sequence
  Synthetic Construct
AQVASPDKRAQ

SEQ ID NO: 5927 - protein, 11 aa, Artificial Sequence
  Synthetic Construct
AQVVAVLTSAQ

SEQ ID NO: 5928 - protein, 11 aa, Artificial Sequence
  Synthetic Construct
AQNIMVNVPAQ

SEQ ID NO: 5929 - protein, 11 aa, Artificial Sequence
  Synthetic Construct
AQPYSGQRTAQ

SEQ ID NO: 5930 - protein, 11 aa, Artificial Sequence
  Synthetic Construct
AQPLLKTNTAQ

SEQ ID NO: 5931 - protein, 11 aa, Artificial Sequence
  Synthetic Construct
AQGNTTVRGAQ

SEQ ID NO: 5932 - protein, 11 aa, Artificial Sequence
  Synthetic Construct
AQTNKVRDDAQ

SEQ ID NO: 5933 - protein, 11 aa, Artificial Sequence
  Synthetic Construct
AQPSTALLVAQ

SEQ ID NO: 5934 - protein, 11 aa, Artificial Sequence
  Synthetic Construct
AQIQSITLKAQ

SEQ ID NO: 5935 - protein, 11 aa, Artificial Sequence
  Synthetic Construct
AQPLHANMSAQ

SEQ ID NO: 5936 - protein, 11 aa, Artificial Sequence
  Synthetic Construct
AQTAHAEARAQ

SEQ ID NO: 5937 - protein, 11 aa, Artificial Sequence
  Synthetic Construct
AQTNTDSYRAQ

SEQ ID NO: 5938 - protein, 11 aa, Artificial Sequence
  Synthetic Construct
AQTHVSLDRAQ

SEQ ID NO: 5939 - protein, 11 aa, Artificial Sequence
  Synthetic Construct
AQFSTKDHVAQ

SEQ ID NO: 5940 - protein, 11 aa, Artificial Sequence
  Synthetic Construct
AQDNTQTAPAQ

SEQ ID NO: 5941 - protein, 11 aa, Artificial Sequence
  Synthetic Construct
AQSNRIISGAQ

SEQ ID NO: 5942 - protein, 11 aa, Artificial Sequence
  Synthetic Construct
AQTNSVRNNAQ

SEQ ID NO: 5943 - protein, 11 aa, Artificial Sequence
  Synthetic Construct
AQSNEVRNMAQ

SEQ ID NO: 5944 - protein, 11 aa, Artificial Sequence
  Synthetic Construct
AQELYKPSRAQ

SEQ ID NO: 5945 - protein, 11 aa, Artificial Sequence
  Synthetic Construct
AQWITGGASAQ

SEQ ID NO: 5946 - protein, 11 aa, Artificial Sequence
  Synthetic Construct
AQNNSVRPTAQ

SEQ ID NO: 5947 - protein, 11 aa, Artificial Sequence
  Synthetic Construct
AQHTAVLRTAQ

SEQ ID NO: 5948 - protein, 11 aa, Artificial Sequence
  Synthetic Construct
AQNTLSLAPAQ

SEQ ID NO: 5949 - protein, 11 aa, Artificial Sequence
  Synthetic Construct
AQPNASVNSAQ

SEQ ID NO: 5950 - protein, 11 aa, Artificial Sequence
  Synthetic Construct
AQVTGGNTYAQ

SEQ ID NO: 5951 - protein, 11 aa, Artificial Sequence
  Synthetic Construct
AQVNENLIEAQ

SEQ ID NO: 5952 - protein, 11 aa, Artificial Sequence
  Synthetic Construct
AQVLTTHSNAQ

SEQ ID NO: 5953 - protein, 11 aa, Artificial Sequence
  Synthetic Construct
AQHTQLPLTAQ

SEQ ID NO: 5954 - protein, 11 aa, Artificial Sequence
  Synthetic Construct
AQRQSLEALAQ

SEQ ID NO: 5955 - protein, 11 aa, Artificial Sequence
  Synthetic Construct
AQPDVTEGRAQ

SEQ ID NO: 5956 - protein, 11 aa, Artificial Sequence
  Synthetic Construct
AQPTNIMLDAQ

SEQ ID NO: 5957 - protein, 11 aa, Artificial Sequence
  Synthetic Construct
AQPNMSAMIAQ

SEQ ID NO: 5958 - protein, 11 aa, Artificial Sequence
  Synthetic Construct
AQIMNGQALAQ

SEQ ID NO: 5959 - protein, 11 aa, Artificial Sequence
  Synthetic Construct
AQNNNSTRFAQ

SEQ ID NO: 5960 - protein, 11 aa, Artificial Sequence
  Synthetic Construct
AQANVTRSTAQ

SEQ ID NO: 5961 - protein, 11 aa, Artificial Sequence
  Synthetic Construct
AQQNLGLNVAQ

SEQ ID NO: 5962 - protein, 11 aa, Artificial Sequence
  Synthetic Construct
AQQAQMSSAAQ

SEQ ID NO: 5963 - protein, 11 aa, Artificial Sequence
  Synthetic Construct
AQLTMATNVAQ

SEQ ID NO: 5964 - protein, 11 aa, Artificial Sequence
  Synthetic Construct
AQDRDSVQNAQ

SEQ ID NO: 5965 - protein, 11 aa, Artificial Sequence
  Synthetic Construct
AQVNPTNNLAQ

SEQ ID NO: 5966 - protein, 11 aa, Artificial Sequence
  Synthetic Construct
AQPSFTTMSAQ

SEQ ID NO: 5967 - protein, 11 aa, Artificial Sequence
  Synthetic Construct
AQRETPIPKAQ

SEQ ID NO: 5968 - protein, 11 aa, Artificial Sequence
  Synthetic Construct
AQSLNFTTAAQ

SEQ ID NO: 5969 - protein, 11 aa, Artificial Sequence
  Synthetic Construct
AQGMSGVAQAQ

SEQ ID NO: 5970 - protein, 11 aa, Artificial Sequence
  Synthetic Construct
AQKVDAAQSAQ

SEQ ID NO: 5971 - protein, 11 aa, Artificial Sequence
  Synthetic Construct
AQHITTNVSAQ

SEQ ID NO: 5972 - protein, 11 aa, Artificial Sequence
  Synthetic Construct
AQERESARLAQ

SEQ ID NO: 5973 - protein, 11 aa, Artificial Sequence
  Synthetic Construct
AQDNRTQRTAQ

SEQ ID NO: 5974 - protein, 11 aa, Artificial Sequence
  Synthetic Construct
AQSAPNVTIAQ

SEQ ID NO: 5975 - protein, 11 aa, Artificial Sequence
  Synthetic Construct
AQENGTRNTAQ

SEQ ID NO: 5976 - protein, 11 aa, Artificial Sequence
  Synthetic Construct
AQGTAVFTAAQ

SEQ ID NO: 5977 - protein, 11 aa, Artificial Sequence
  Synthetic Construct
AQANNMSQTAQ

SEQ ID NO: 5978 - protein, 11 aa, Artificial Sequence
  Synthetic Construct
AQGNHTYNLAQ

SEQ ID NO: 5979 - protein, 11 aa, Artificial Sequence
  Synthetic Construct
AQLSPSNSNAQ

SEQ ID NO: 5980 - protein, 11 aa, Artificial Sequence
  Synthetic Construct
AQMGADHRTAQ

SEQ ID NO: 5981 - protein, 11 aa, Artificial Sequence
  Synthetic Construct
AQSNSTRGSAQ

SEQ ID NO: 5982 - protein, 11 aa, Artificial Sequence
  Synthetic Construct
AQNTSGVPKAQ

SEQ ID NO: 5983 - protein, 11 aa, Artificial Sequence
  Synthetic Construct
AQINTAVVSAQ

SEQ ID NO: 5984 - protein, 11 aa, Artificial Sequence
  Synthetic Construct
AQMGVQAYVAQ

SEQ ID NO: 5985 - protein, 11 aa, Artificial Sequence
  Synthetic Construct
AQGNFVKPNAQ

SEQ ID NO: 5986 - protein, 11 aa, Artificial Sequence
  Synthetic Construct
AQVNSVRMIAQ

SEQ ID NO: 5987 - protein, 11 aa, Artificial Sequence
  Synthetic Construct
AQHDSANSRAQ

SEQ ID NO: 5988 - protein, 11 aa, Artificial Sequence
  Synthetic Construct
AQLGVRDDSAQ

SEQ ID NO: 5989 - protein, 11 aa, Artificial Sequence
  Synthetic Construct
AQSNAVRANAQ

SEQ ID NO: 5990 - protein, 11 aa, Artificial Sequence
  Synthetic Construct
AQPVLAATMAQ

SEQ ID NO: 5991 - protein, 11 aa, Artificial Sequence
  Synthetic Construct
AQNKPVSGNAQ

SEQ ID NO: 5992 - protein, 11 aa, Artificial Sequence
  Synthetic Construct
AQVGLASHTAQ

SEQ ID NO: 5993 - protein, 11 aa, Artificial Sequence
  Synthetic Construct
AQGSNTNMKAQ

SEQ ID NO: 5994 - protein, 11 aa, Artificial Sequence
  Synthetic Construct
AQVATTVHNAQ

SEQ ID NO: 5995 - protein, 11 aa, Artificial Sequence
  Synthetic Construct
AQNTLDSRVAQ

SEQ ID NO: 5996 - protein, 11 aa, Artificial Sequence
  Synthetic Construct
AQREANLQAAQ

SEQ ID NO: 5997 - protein, 11 aa, Artificial Sequence
  Synthetic Construct
AQVDALSHMAQ

SEQ ID NO: 5998 - protein, 11 aa, Artificial Sequence
  Synthetic Construct
AQLRLAGLAAQ

SEQ ID NO: 5999 - protein, 11 aa, Artificial Sequence
  Synthetic Construct
AQITVTNYSAQ

SEQ ID NO: 6000 - protein, 11 aa, Artificial Sequence
  Synthetic Construct
AQWDSGSGEAQ

SEQ ID NO: 6001 - protein, 11 aa, Artificial Sequence
  Synthetic Construct
AQFASETVAAQ

SEQ ID NO: 6002 - protein, 11 aa, Artificial Sequence
  Synthetic Construct
AQQNVTGTRAQ

SEQ ID NO: 6003 - protein, 11 aa, Artificial Sequence
  Synthetic Construct
AQLNGLNVSAQ

SEQ ID NO: 6004 - protein, 11 aa, Artificial Sequence
  Synthetic Construct
AQNMLKQSEAQ

SEQ ID NO: 6005 - protein, 11 aa, Artificial Sequence
  Synthetic Construct
AQFNEVPKAAQ

SEQ ID NO: 6006 - protein, 11 aa, Artificial Sequence
  Synthetic Construct
AQLGDITGFAQ

SEQ ID NO: 6007 - protein, 11 aa, Artificial Sequence
  Synthetic Construct
AQISASHSRAQ

SEQ ID NO: 6008 - protein, 11 aa, Artificial Sequence
  Synthetic Construct
AQSQTQIALAQ

SEQ ID NO: 6009 - protein, 11 aa, Artificial Sequence
  Synthetic Construct
AQNMATQMKAQ

SEQ ID NO: 6010 - protein, 11 aa, Artificial Sequence
  Synthetic Construct
AQVNHNIRLAQ

SEQ ID NO: 6011 - protein, 11 aa, Artificial Sequence
  Synthetic Construct
AQNALQVPVAQ

SEQ ID NO: 6012 - protein, 11 aa, Artificial Sequence
  Synthetic Construct
AQNSTGIDTAQ

SEQ ID NO: 6013 - protein, 11 aa, Artificial Sequence
  Synthetic Construct
AQVVAGHLNAQ

SEQ ID NO: 6014 - protein, 11 aa, Artificial Sequence
  Synthetic Construct
AQRNDAILNAQ

SEQ ID NO: 6015 - protein, 11 aa, Artificial Sequence
  Synthetic Construct
AQNRVDSRAAQ

SEQ ID NO: 6016 - protein, 11 aa, Artificial Sequence
  Synthetic Construct
AQSTHSTYVAQ

SEQ ID NO: 6017 - protein, 11 aa, Artificial Sequence
  Synthetic Construct
AQSGHGTLRAQ

SEQ ID NO: 6018 - protein, 11 aa, Artificial Sequence
  Synthetic Construct
AQPNSTTLSAQ

SEQ ID NO: 6019 - protein, 11 aa, Artificial Sequence
  Synthetic Construct
AQDTKPTNTAQ

SEQ ID NO: 6020 - protein, 11 aa, Artificial Sequence
  Synthetic Construct
AQNRDTINNAQ

SEQ ID NO: 6021 - protein, 11 aa, Artificial Sequence
  Synthetic Construct
AQPRTLSDGAQ

SEQ ID NO: 6022 - protein, 11 aa, Artificial Sequence
  Synthetic Construct
AQTKDVTTSAQ

SEQ ID NO: 6023 - protein, 11 aa, Artificial Sequence
  Synthetic Construct
AQLGNPTPSAQ

SEQ ID NO: 6024 - protein, 11 aa, Artificial Sequence
  Synthetic Construct
AQYQAMYRDAQ

SEQ ID NO: 6025 - protein, 11 aa, Artificial Sequence
  Synthetic Construct
AQSGVQEFDAQ

SEQ ID NO: 6026 - protein, 11 aa, Artificial Sequence
  Synthetic Construct
AQSNHLSTVAQ

SEQ ID NO: 6027 - protein, 11 aa, Artificial Sequence
  Synthetic Construct
AQHDERANMAQ

SEQ ID NO: 6028 - protein, 11 aa, Artificial Sequence
  Synthetic Construct
AQTNSTRSPAQ

SEQ ID NO: 6029 - protein, 11 aa, Artificial Sequence
  Synthetic Construct
AQPTDKSYPAQ

SEQ ID NO: 6030 - protein, 11 aa, Artificial Sequence
  Synthetic Construct
AQMTEQRTAAQ

SEQ ID NO: 6031 - protein, 11 aa, Artificial Sequence
  Synthetic Construct
AQTNATHSKAQ

SEQ ID NO: 6032 - protein, 11 aa, Artificial Sequence
  Synthetic Construct
AQNRGTFSAAQ

SEQ ID NO: 6033 - protein, 11 aa, Artificial Sequence
  Synthetic Construct
AQNTTKFNTAQ

SEQ ID NO: 6034 - protein, 11 aa, Artificial Sequence
  Synthetic Construct
AQGIPPLTKAQ

SEQ ID NO: 6035 - protein, 11 aa, Artificial Sequence
  Synthetic Construct
AQTANSTQRAQ

SEQ ID NO: 6036 - protein, 11 aa, Artificial Sequence
  Synthetic Construct
AQTQGPGPKAQ

SEQ ID NO: 6037 - protein, 11 aa, Artificial Sequence
  Synthetic Construct
AQMNTTRNYAQ

SEQ ID NO: 6038 - protein, 11 aa, Artificial Sequence
  Synthetic Construct
AQLREGTFMAQ

SEQ ID NO: 6039 - protein, 11 aa, Artificial Sequence
  Synthetic Construct
AQNISSTDRAQ

SEQ ID NO: 6040 - protein, 11 aa, Artificial Sequence
  Synthetic Construct
AQSVSRPFQAQ

SEQ ID NO: 6041 - protein, 11 aa, Artificial Sequence
  Synthetic Construct
AQPMSANGKAQ

SEQ ID NO: 6042 - protein, 11 aa, Artificial Sequence
  Synthetic Construct
AQEVRGNTFAQ

SEQ ID NO: 6043 - protein, 11 aa, Artificial Sequence
  Synthetic Construct
AQSQKGLSVAQ

SEQ ID NO: 6044 - protein, 11 aa, Artificial Sequence
  Synthetic Construct
AQIAENLSAAQ

SEQ ID NO: 6045 - protein, 11 aa, Artificial Sequence
  Synthetic Construct
AQFSNMNLKAQ

SEQ ID NO: 6046 - protein, 11 aa, Artificial Sequence
  Synthetic Construct
AQPRERTYTAQ

SEQ ID NO: 6047 - protein, 11 aa, Artificial Sequence
  Synthetic Construct
AQWSHNPDSAQ

SEQ ID NO: 6048 - protein, 11 aa, Artificial Sequence
  Synthetic Construct
AQGLQTLITAQ

SEQ ID NO: 6049 - protein, 11 aa, Artificial Sequence
  Synthetic Construct
AQSNRTKDIAQ

SEQ ID NO: 6050 - protein, 11 aa, Artificial Sequence
  Synthetic Construct
AQVTETILKAQ

SEQ ID NO: 6051 - protein, 11 aa, Artificial Sequence
  Synthetic Construct
AQYVTRSGLAQ

SEQ ID NO: 6052 - protein, 11 aa, Artificial Sequence
  Synthetic Construct
AQMNANILVAQ

SEQ ID NO: 6053 - protein, 11 aa, Artificial Sequence
  Synthetic Construct
AQTTNRVGTAQ

SEQ ID NO: 6054 - protein, 11 aa, Artificial Sequence
  Synthetic Construct
AQVLKSHLQAQ

SEQ ID NO: 6055 - protein, 11 aa, Artificial Sequence
  Synthetic Construct
AQSDGLRTQAQ

SEQ ID NO: 6056 - protein, 11 aa, Artificial Sequence
  Synthetic Construct
AQLNSVKPNAQ

SEQ ID NO: 6057 - protein, 11 aa, Artificial Sequence
  Synthetic Construct
AQSQAIAPKAQ

SEQ ID NO: 6058 - protein, 11 aa, Artificial Sequence
  Synthetic Construct
AQSNNVRAPAQ

SEQ ID NO: 6059 - protein, 11 aa, Artificial Sequence
  Synthetic Construct
AQISHLSESAQ

SEQ ID NO: 6060 - protein, 11 aa, Artificial Sequence
  Synthetic Construct
AQLLPGMRFAQ

SEQ ID NO: 6061 - protein, 11 aa, Artificial Sequence
  Synthetic Construct
AQLLASATKAQ

SEQ ID NO: 6062 - protein, 11 aa, Artificial Sequence
  Synthetic Construct
AQNHNGMVSAQ

SEQ ID NO: 6063 - protein, 11 aa, Artificial Sequence
  Synthetic Construct
AQHSGELNNAQ

SEQ ID NO: 6064 - protein, 11 aa, Artificial Sequence
  Synthetic Construct
AQLSAPKDTAQ

SEQ ID NO: 6065 - protein, 11 aa, Artificial Sequence
  Synthetic Construct
AQIGTHVGTAQ

SEQ ID NO: 6066 - protein, 11 aa, Artificial Sequence
  Synthetic Construct
AQAVALASAAQ

SEQ ID NO: 6067 - protein, 11 aa, Artificial Sequence
  Synthetic Construct
AQITLQSNAAQ

SEQ ID NO: 6068 - protein, 11 aa, Artificial Sequence
  Synthetic Construct
AQVDHSLTSAQ

SEQ ID NO: 6069 - protein, 11 aa, Artificial Sequence
  Synthetic Construct
AQGNEATSLAQ

SEQ ID NO: 6070 - protein, 11 aa, Artificial Sequence
  Synthetic Construct
AQPVSSTTLAQ

SEQ ID NO: 6071 - protein, 11 aa, Artificial Sequence
  Synthetic Construct
AQPYQTSSAAQ

SEQ ID NO: 6072 - protein, 11 aa, Artificial Sequence
  Synthetic Construct
AQTSVVSAFAQ

SEQ ID NO: 6073 - protein, 11 aa, Artificial Sequence
  Synthetic Construct
AQNGVPDNNAQ

SEQ ID NO: 6074 - protein, 11 aa, Artificial Sequence
  Synthetic Construct
AQSTQTIGFAQ

SEQ ID NO: 6075 - protein, 11 aa, Artificial Sequence
  Synthetic Construct
AQIRSSDLAAQ

SEQ ID NO: 6076 - protein, 11 aa, Artificial Sequence
  Synthetic Construct
AQNTQSAKYAQ

SEQ ID NO: 6077 - protein, 11 aa, Artificial Sequence
  Synthetic Construct
AQSLESSRQAQ

SEQ ID NO: 6078 - protein, 11 aa, Artificial Sequence
  Synthetic Construct
AQLNLASGRAQ

SEQ ID NO: 6079 - protein, 11 aa, Artificial Sequence
  Synthetic Construct
AQMQERREYAQ

SEQ ID NO: 6080 - protein, 11 aa, Artificial Sequence
  Synthetic Construct
AQWLLKDGYAQ

SEQ ID NO: 6081 - protein, 11 aa, Artificial Sequence
  Synthetic Construct
AQGRYQTTSAQ

SEQ ID NO: 6082 - protein, 11 aa, Artificial Sequence
  Synthetic Construct
AQNTTKFPFAQ

SEQ ID NO: 6083 - protein, 11 aa, Artificial Sequence
  Synthetic Construct
AQMSNGISRAQ

SEQ ID NO: 6084 - protein, 11 aa, Artificial Sequence
  Synthetic Construct
AQPIRDPEKAQ

SEQ ID NO: 6085 - protein, 11 aa, Artificial Sequence
  Synthetic Construct
AQSTLSPHVAQ

SEQ ID NO: 6086 - protein, 11 aa, Artificial Sequence
  Synthetic Construct
AQFMPISSAAQ

SEQ ID NO: 6087 - protein, 11 aa, Artificial Sequence
  Synthetic Construct
AQRSDTQSSAQ

SEQ ID NO: 6088 - protein, 11 aa, Artificial Sequence
  Synthetic Construct
AQDNHVMARAQ

SEQ ID NO: 6089 - protein, 11 aa, Artificial Sequence
  Synthetic Construct
AQNLSSKSWAQ

SEQ ID NO: 6090 - protein, 11 aa, Artificial Sequence
  Synthetic Construct
AQSTILKDTAQ

SEQ ID NO: 6091 - protein, 11 aa, Artificial Sequence
  Synthetic Construct
AQPTHQSKPAQ

SEQ ID NO: 6092 - protein, 11 aa, Artificial Sequence
  Synthetic Construct
AQTEVTQNKAQ

SEQ ID NO: 6093 - protein, 11 aa, Artificial Sequence
  Synthetic Construct
AQHLDSNGSAQ

SEQ ID NO: 6094 - protein, 11 aa, Artificial Sequence
  Synthetic Construct
AQNTDSRVGAQ

SEQ ID NO: 6095 - protein, 11 aa, Artificial Sequence
  Synthetic Construct
AQSMGLKEKAQ

SEQ ID NO: 6096 - protein, 11 aa, Artificial Sequence
  Synthetic Construct
AQLSTSYTRAQ

SEQ ID NO: 6097 - protein, 11 aa, Artificial Sequence
  Synthetic Construct
AQSGMSNNHAQ

SEQ ID NO: 6098 - protein, 11 aa, Artificial Sequence
  Synthetic Construct
AQTNYDLRAAQ

SEQ ID NO: 6099 - protein, 11 aa, Artificial Sequence
  Synthetic Construct
AQTPQSQEMAQ

SEQ ID NO: 6100 - protein, 11 aa, Artificial Sequence
  Synthetic Construct
AQNSNMVTPAQ

SEQ ID NO: 6101 - protein, 11 aa, Artificial Sequence
  Synthetic Construct
AQSAVPNVKAQ

SEQ ID NO: 6102 - protein, 11 aa, Artificial Sequence
  Synthetic Construct
AQVLVAGSRAQ

SEQ ID NO: 6103 - protein, 11 aa, Artificial Sequence
  Synthetic Construct
AQGNNSRNMAQ

SEQ ID NO: 6104 - protein, 11 aa, Artificial Sequence
  Synthetic Construct
AQMPRGHVSAQ

SEQ ID NO: 6105 - protein, 11 aa, Artificial Sequence
  Synthetic Construct
AQWSHSENSAQ

SEQ ID NO: 6106 - protein, 11 aa, Artificial Sequence
  Synthetic Construct
AQFEKDPVAAQ

SEQ ID NO: 6107 - protein, 11 aa, Artificial Sequence
  Synthetic Construct
AQITQATPSAQ

SEQ ID NO: 6108 - protein, 11 aa, Artificial Sequence
  Synthetic Construct
AQANLSHLHAQ

SEQ ID NO: 6109 - protein, 11 aa, Artificial Sequence
  Synthetic Construct
AQGITNSTIAQ

SEQ ID NO: 6110 - protein, 11 aa, Artificial Sequence
  Synthetic Construct
AQPSQQPTRAQ

SEQ ID NO: 6111 - protein, 11 aa, Artificial Sequence
  Synthetic Construct
AQQQTHEDIAQ

SEQ ID NO: 6112 - protein, 11 aa, Artificial Sequence
  Synthetic Construct
AQQVNVSPDAQ

SEQ ID NO: 6113 - protein, 11 aa, Artificial Sequence
  Synthetic Construct
AQKAVVTQTAQ

SEQ ID NO: 6114 - protein, 11 aa, Artificial Sequence
  Synthetic Construct
AQNTVRSSTAQ

SEQ ID NO: 6115 - protein, 11 aa, Artificial Sequence
  Synthetic Construct
AQNASSHLLAQ

SEQ ID NO: 6116 - protein, 11 aa, Artificial Sequence
  Synthetic Construct
AQYIKDSTPAQ

SEQ ID NO: 6117 - protein, 11 aa, Artificial Sequence
  Synthetic Construct
AQSSESTNLAQ

SEQ ID NO: 6118 - protein, 11 aa, Artificial Sequence
  Synthetic Construct
AQKENVEGNAQ

SEQ ID NO: 6119 - protein, 11 aa, Artificial Sequence
  Synthetic Construct
AQNNVLGTPAQ

SEQ ID NO: 6120 - protein, 11 aa, Artificial Sequence
  Synthetic Construct
AQQNVSILDAQ

SEQ ID NO: 6121 - protein, 11 aa, Artificial Sequence
  Synthetic Construct
AQPLNSENNAQ

SEQ ID NO: 6122 - protein, 11 aa, Artificial Sequence
  Synthetic Construct
AQTINLVGYAQ

SEQ ID NO: 6123 - protein, 11 aa, Artificial Sequence
  Synthetic Construct
AQPALAAQAAQ

SEQ ID NO: 6124 - protein, 11 aa, Artificial Sequence
  Synthetic Construct
AQTLQNSITAQ

SEQ ID NO: 6125 - protein, 11 aa, Artificial Sequence
  Synthetic Construct
AQLGGTDGHAQ

SEQ ID NO: 6126 - protein, 11 aa, Artificial Sequence
  Synthetic Construct
AQAGPINNTAQ

SEQ ID NO: 6127 - protein, 11 aa, Artificial Sequence
  Synthetic Construct
AQHVLTQSVAQ

SEQ ID NO: 6128 - protein, 11 aa, Artificial Sequence
  Synthetic Construct
AQTTIPSHQAQ

SEQ ID NO: 6129 - protein, 11 aa, Artificial Sequence
  Synthetic Construct
AQHDGLLSRAQ

SEQ ID NO: 6130 - protein, 11 aa, Artificial Sequence
  Synthetic Construct
AQSIHTGLTAQ

SEQ ID NO: 6131 - protein, 11 aa, Artificial Sequence
  Synthetic Construct
AQGNMTKFTAQ

SEQ ID NO: 6132 - protein, 11 aa, Artificial Sequence
  Synthetic Construct
AQYALSTDTAQ

SEQ ID NO: 6133 - protein, 11 aa, Artificial Sequence
  Synthetic Construct
AQTQADNLKAQ

SEQ ID NO: 6134 - protein, 11 aa, Artificial Sequence
  Synthetic Construct
AQWYKTLDAAQ

SEQ ID NO: 6135 - protein, 11 aa, Artificial Sequence
  Synthetic Construct
AQPQYAKISAQ

SEQ ID NO: 6136 - protein, 11 aa, Artificial Sequence
  Synthetic Construct
AQLATDNKSAQ

SEQ ID NO: 6137 - protein, 11 aa, Artificial Sequence
  Synthetic Construct
AQLSVVITSAQ

SEQ ID NO: 6138 - protein, 11 aa, Artificial Sequence
  Synthetic Construct
AQNVPTSPRAQ

SEQ ID NO: 6139 - protein, 11 aa, Artificial Sequence
  Synthetic Construct
AQARPDLKLAQ

SEQ ID NO: 6140 - protein, 11 aa, Artificial Sequence
  Synthetic Construct
AQSALANTLAQ

SEQ ID NO: 6141 - protein, 11 aa, Artificial Sequence
  Synthetic Construct
AQLMDFSNPAQ

SEQ ID NO: 6142 - protein, 11 aa, Artificial Sequence
  Synthetic Construct
AQPRTELISAQ

SEQ ID NO: 6143 - protein, 11 aa, Artificial Sequence
  Synthetic Construct
AQTSDIKSKAQ

SEQ ID NO: 6144 - protein, 11 aa, Artificial Sequence
  Synthetic Construct
AQSNATMRFAQ

SEQ ID NO: 6145 - protein, 11 aa, Artificial Sequence
  Synthetic Construct
AQVQSPALQAQ

SEQ ID NO: 6146 - protein, 11 aa, Artificial Sequence
  Synthetic Construct
AQTANTTSRAQ

SEQ ID NO: 6147 - protein, 11 aa, Artificial Sequence
  Synthetic Construct
AQQHMTSQIAQ

SEQ ID NO: 6148 - protein, 11 aa, Artificial Sequence
  Synthetic Construct
AQSNMSLSSAQ

SEQ ID NO: 6149 - protein, 11 aa, Artificial Sequence
  Synthetic Construct
AQITGIPTSAQ

SEQ ID NO: 6150 - protein, 11 aa, Artificial Sequence
  Synthetic Construct
AQFTNNVRDAQ

SEQ ID NO: 6151 - protein, 11 aa, Artificial Sequence
  Synthetic Construct
AQNSNAGGKAQ

SEQ ID NO: 6152 - protein, 11 aa, Artificial Sequence
  Synthetic Construct
AQYNTDITKAQ

SEQ ID NO: 6153 - protein, 11 aa, Artificial Sequence
  Synthetic Construct
AQFSNPDKMAQ

SEQ ID NO: 6154 - protein, 11 aa, Artificial Sequence
  Synthetic Construct
AQLMTTSTIAQ

SEQ ID NO: 6155 - protein, 11 aa, Artificial Sequence
  Synthetic Construct
AQTNSTLRQAQ

SEQ ID NO: 6156 - protein, 11 aa, Artificial Sequence
  Synthetic Construct
AQSNYTKIIAQ

SEQ ID NO: 6157 - protein, 11 aa, Artificial Sequence
  Synthetic Construct
AQSAGLISSAQ

SEQ ID NO: 6158 - protein, 11 aa, Artificial Sequence
  Synthetic Construct
AQKQGPMLSAQ

SEQ ID NO: 6159 - protein, 11 aa, Artificial Sequence
  Synthetic Construct
AQVRTPGVQAQ

SEQ ID NO: 6160 - protein, 11 aa, Artificial Sequence
  Synthetic Construct
AQTPDHRERAQ

SEQ ID NO: 6161 - protein, 11 aa, Artificial Sequence
  Synthetic Construct
AQMNATVPSAQ

SEQ ID NO: 6162 - protein, 11 aa, Artificial Sequence
  Synthetic Construct
AQLHSMLAPAQ

SEQ ID NO: 6163 - protein, 11 aa, Artificial Sequence
  Synthetic Construct
AQDMHHSQPAQ

SEQ ID NO: 6164 - protein, 11 aa, Artificial Sequence
  Synthetic Construct
AQKPLPTTYAQ

SEQ ID NO: 6165 - protein, 11 aa, Artificial Sequence
  Synthetic Construct
AQAMQVTLSAQ

SEQ ID NO: 6166 - protein, 11 aa, Artificial Sequence
  Synthetic Construct
AQSPTHDARAQ

SEQ ID NO: 6167 - protein, 11 aa, Artificial Sequence
  Synthetic Construct
AQALSVKELAQ

SEQ ID NO: 6168 - protein, 11 aa, Artificial Sequence
  Synthetic Construct
AQPSRVPTQAQ

SEQ ID NO: 6169 - protein, 11 aa, Artificial Sequence
  Synthetic Construct
AQGSLGLGKAQ

SEQ ID NO: 6170 - protein, 11 aa, Artificial Sequence
  Synthetic Construct
AQHSSYSSKAQ

SEQ ID NO: 6171 - protein, 11 aa, Artificial Sequence
  Synthetic Construct
AQPNPSNPSAQ

SEQ ID NO: 6172 - protein, 11 aa, Artificial Sequence
  Synthetic Construct
AQTKNGVAQAQ

SEQ ID NO: 6173 - protein, 11 aa, Artificial Sequence
  Synthetic Construct
AQGSTSSAYAQ

SEQ ID NO: 6174 - protein, 11 aa, Artificial Sequence
  Synthetic Construct
AQRSTHENTAQ

SEQ ID NO: 6175 - protein, 11 aa, Artificial Sequence
  Synthetic Construct
AQSGHDRDAAQ

SEQ ID NO: 6176 - protein, 11 aa, Artificial Sequence
  Synthetic Construct
AQNTQSYTSAQ

SEQ ID NO: 6177 - protein, 11 aa, Artificial Sequence
  Synthetic Construct
AQDRVPHLRAQ

SEQ ID NO: 6178 - protein, 11 aa, Artificial Sequence
  Synthetic Construct
AQNNPPHMRAQ

SEQ ID NO: 6179 - protein, 11 aa, Artificial Sequence
  Synthetic Construct
AQRSLQSQFAQ

SEQ ID NO: 6180 - protein, 11 aa, Artificial Sequence
  Synthetic Construct
AQIRDDRSLAQ

SEQ ID NO: 6181 - protein, 11 aa, Artificial Sequence
  Synthetic Construct
AQMLSAPLPAQ

SEQ ID NO: 6182 - protein, 11 aa, Artificial Sequence
  Synthetic Construct
AQTSSILTTAQ

SEQ ID NO: 6183 - protein, 11 aa, Artificial Sequence
  Synthetic Construct
AQREQMNLVAQ

SEQ ID NO: 6184 - protein, 11 aa, Artificial Sequence
  Synthetic Construct
AQKTQSLSNAQ

SEQ ID NO: 6185 - protein, 11 aa, Artificial Sequence
  Synthetic Construct
AQLKTAEYTAQ

SEQ ID NO: 6186 - protein, 11 aa, Artificial Sequence
  Synthetic Construct
AQSSEKPFRAQ

SEQ ID NO: 6187 - protein, 11 aa, Artificial Sequence
  Synthetic Construct
AQPTSGVFGAQ

SEQ ID NO: 6188 - protein, 11 aa, Artificial Sequence
  Synthetic Construct
AQGPSIVTMAQ

SEQ ID NO: 6189 - protein, 11 aa, Artificial Sequence
  Synthetic Construct
AQTSDKSSLAQ

SEQ ID NO: 6190 - protein, 11 aa, Artificial Sequence
  Synthetic Construct
AQNTITMAKAQ

SEQ ID NO: 6191 - protein, 11 aa, Artificial Sequence
  Synthetic Construct
AQRNQPVPSAQ

SEQ ID NO: 6192 - protein, 11 aa, Artificial Sequence
  Synthetic Construct
AQSVHLNLQAQ

SEQ ID NO: 6193 - protein, 11 aa, Artificial Sequence
  Synthetic Construct
AQYNLTMVSAQ

SEQ ID NO: 6194 - protein, 11 aa, Artificial Sequence
  Synthetic Construct
AQTADSHPRAQ

SEQ ID NO: 6195 - protein, 11 aa, Artificial Sequence
  Synthetic Construct
AQLLGEKVMAQ

SEQ ID NO: 6196 - protein, 11 aa, Artificial Sequence
  Synthetic Construct
AQWDLTAPQAQ

SEQ ID NO: 6197 - protein, 11 aa, Artificial Sequence
  Synthetic Construct
AQVLADRLPAQ

SEQ ID NO: 6198 - protein, 11 aa, Artificial Sequence
  Synthetic Construct
AQSRALPNSAQ

SEQ ID NO: 6199 - protein, 11 aa, Artificial Sequence
  Synthetic Construct
AQSSLNMPRAQ

SEQ ID NO: 6200 - protein, 11 aa, Artificial Sequence
  Synthetic Construct
AQQKVSILAAQ

SEQ ID NO: 6201 - protein, 11 aa, Artificial Sequence
  Synthetic Construct
AQRGDNSRLAQ

SEQ ID NO: 6202 - protein, 11 aa, Artificial Sequence
  Synthetic Construct
AQRIDLGSQAQ

SEQ ID NO: 6203 - protein, 11 aa, Artificial Sequence
  Synthetic Construct
AQASLGLRAAQ

SEQ ID NO: 6204 - protein, 11 aa, Artificial Sequence
  Synthetic Construct
AQSMQNGLRAQ

SEQ ID NO: 6205 - protein, 11 aa, Artificial Sequence
  Synthetic Construct
AQTLAVGIAAQ

SEQ ID NO: 6206 - protein, 11 aa, Artificial Sequence
  Synthetic Construct
AQGQTVTGAAQ

SEQ ID NO: 6207 - protein, 11 aa, Artificial Sequence
  Synthetic Construct
AQHALSPSPAQ

SEQ ID NO: 6208 - protein, 11 aa, Artificial Sequence
  Synthetic Construct
AQVSSVFTEAQ

SEQ ID NO: 6209 - protein, 11 aa, Artificial Sequence
  Synthetic Construct
AQYGAGAVKAQ

SEQ ID NO: 6210 - protein, 11 aa, Artificial Sequence
  Synthetic Construct
AQKETLPNAAQ

SEQ ID NO: 6211 - protein, 11 aa, Artificial Sequence
  Synthetic Construct
AQIPSQTPLAQ

SEQ ID NO: 6212 - protein, 11 aa, Artificial Sequence
  Synthetic Construct
AQSAISTFVAQ

SEQ ID NO: 6213 - protein, 11 aa, Artificial Sequence
  Synthetic Construct
AQVNSTSSTAQ

SEQ ID NO: 6214 - protein, 11 aa, Artificial Sequence
  Synthetic Construct
AQPTRDYKEAQ

SEQ ID NO: 6215 - protein, 11 aa, Artificial Sequence
  Synthetic Construct
AQNNPASTQAQ

SEQ ID NO: 6216 - protein, 11 aa, Artificial Sequence
  Synthetic Construct
AQVTQTSVNAQ

SEQ ID NO: 6217 - protein, 11 aa, Artificial Sequence
  Synthetic Construct
AQWAGTTSHAQ

SEQ ID NO: 6218 - protein, 11 aa, Artificial Sequence
  Synthetic Construct
AQVTAGFSAAQ

SEQ ID NO: 6219 - protein, 11 aa, Artificial Sequence
  Synthetic Construct
AQLHSPSMQAQ

SEQ ID NO: 6220 - protein, 11 aa, Artificial Sequence
  Synthetic Construct
AQFPTQPSMAQ

SEQ ID NO: 6221 - protein, 11 aa, Artificial Sequence
  Synthetic Construct
AQAQSVNDGAQ

SEQ ID NO: 6222 - protein, 11 aa, Artificial Sequence
  Synthetic Construct
AQVASTTYTAQ

SEQ ID NO: 6223 - protein, 11 aa, Artificial Sequence
  Synthetic Construct
AQLGGLNSVAQ

SEQ ID NO: 6224 - protein, 11 aa, Artificial Sequence
  Synthetic Construct
AQAGAPSLSAQ

SEQ ID NO: 6225 - protein, 11 aa, Artificial Sequence
  Synthetic Construct
AQSNRKIDDAQ

SEQ ID NO: 6226 - protein, 11 aa, Artificial Sequence
  Synthetic Construct
AQSPNNRAVAQ

SEQ ID NO: 6227 - protein, 11 aa, Artificial Sequence
  Synthetic Construct
AQVLREDQSAQ

SEQ ID NO: 6228 - protein, 11 aa, Artificial Sequence
  Synthetic Construct
AQLLATGLKAQ

SEQ ID NO: 6229 - protein, 11 aa, Artificial Sequence
  Synthetic Construct
AQVHLRSQIAQ

SEQ ID NO: 6230 - protein, 11 aa, Artificial Sequence
  Synthetic Construct
AQSANSNLKAQ

SEQ ID NO: 6231 - protein, 11 aa, Artificial Sequence
  Synthetic Construct
AQSKAGEGNAQ

SEQ ID NO: 6232 - protein, 11 aa, Artificial Sequence
  Synthetic Construct
AQVSNPAMKAQ

SEQ ID NO: 6233 - protein, 11 aa, Artificial Sequence
  Synthetic Construct
AQINGNNQRAQ

SEQ ID NO: 6234 - protein, 11 aa, Artificial Sequence
  Synthetic Construct
AQYKSTTLSAQ

SEQ ID NO: 6235 - protein, 11 aa, Artificial Sequence
  Synthetic Construct
AQKEGLVSRAQ

SEQ ID NO: 6236 - protein, 11 aa, Artificial Sequence
  Synthetic Construct
AQHLKVMTIAQ

SEQ ID NO: 6237 - protein, 11 aa, Artificial Sequence
  Synthetic Construct
AQRTNDHSSAQ

SEQ ID NO: 6238 - protein, 11 aa, Artificial Sequence
  Synthetic Construct
AQLPSQSAKAQ

SEQ ID NO: 6239 - protein, 11 aa, Artificial Sequence
  Synthetic Construct
AQITLRHLQAQ

SEQ ID NO: 6240 - protein, 11 aa, Artificial Sequence
  Synthetic Construct
AQQMIANIPAQ

SEQ ID NO: 6241 - protein, 11 aa, Artificial Sequence
  Synthetic Construct
AQSSSTDQHAQ

SEQ ID NO: 6242 - protein, 11 aa, Artificial Sequence
  Synthetic Construct
AQRSTDFTPAQ

SEQ ID NO: 6243 - protein, 11 aa, Artificial Sequence
  Synthetic Construct
AQQHASISAAQ

SEQ ID NO: 6244 - protein, 11 aa, Artificial Sequence
  Synthetic Construct
AQNISSMQMAQ

SEQ ID NO: 6245 - protein, 11 aa, Artificial Sequence
  Synthetic Construct
AQSGNVVGRAQ

SEQ ID NO: 6246 - protein, 11 aa, Artificial Sequence
  Synthetic Construct
AQSKGDTSAAQ

SEQ ID NO: 6247 - protein, 11 aa, Artificial Sequence
  Synthetic Construct
AQLLNTGTKAQ

SEQ ID NO: 6248 - protein, 11 aa, Artificial Sequence
  Synthetic Construct
AQGTGASMNAQ

SEQ ID NO: 6249 - protein, 11 aa, Artificial Sequence
  Synthetic Construct
AQRLDANSTAQ

SEQ ID NO: 6250 - protein, 11 aa, Artificial Sequence
  Synthetic Construct
AQLPERPNSAQ

SEQ ID NO: 6251 - protein, 11 aa, Artificial Sequence
  Synthetic Construct
AQAREILNHAQ

SEQ ID NO: 6252 - protein, 11 aa, Artificial Sequence
  Synthetic Construct
AQNFKTTNSAQ

SEQ ID NO: 6253 - protein, 11 aa, Artificial Sequence
  Synthetic Construct
AQGRTVQDRAQ

SEQ ID NO: 6254 - protein, 11 aa, Artificial Sequence
  Synthetic Construct
AQGMNQTTTAQ

SEQ ID NO: 6255 - protein, 11 aa, Artificial Sequence
  Synthetic Construct
AQVGKDGVLAQ

SEQ ID NO: 6256 - protein, 11 aa, Artificial Sequence
  Synthetic Construct
AQVTRDGAKAQ

SEQ ID NO: 6257 - protein, 11 aa, Artificial Sequence
  Synthetic Construct
AQGTATYGKAQ

SEQ ID NO: 6258 - protein, 11 aa, Artificial Sequence
  Synthetic Construct
AQMLGAEGYAQ

SEQ ID NO: 6259 - protein, 11 aa, Artificial Sequence
  Synthetic Construct
AQVTQQNHHAQ

SEQ ID NO: 6260 - protein, 11 aa, Artificial Sequence
  Synthetic Construct
AQTVNADQLAQ

SEQ ID NO: 6261 - protein, 11 aa, Artificial Sequence
  Synthetic Construct
AQQMQNSPIAQ

SEQ ID NO: 6262 - protein, 11 aa, Artificial Sequence
  Synthetic Construct
AQGTLASSKAQ

SEQ ID NO: 6263 - protein, 11 aa, Artificial Sequence
  Synthetic Construct
AQSNVTIAHAQ

SEQ ID NO: 6264 - protein, 11 aa, Artificial Sequence
  Synthetic Construct
AQANNSRPFAQ

SEQ ID NO: 6265 - protein, 11 aa, Artificial Sequence
  Synthetic Construct
AQIATAGGPAQ

SEQ ID NO: 6266 - protein, 11 aa, Artificial Sequence
  Synthetic Construct
AQAFSGPSRAQ

SEQ ID NO: 6267 - protein, 11 aa, Artificial Sequence
  Synthetic Construct
AQLTNLVSRAQ

SEQ ID NO: 6268 - protein, 11 aa, Artificial Sequence
  Synthetic Construct
AQAGQHLALAQ

SEQ ID NO: 6269 - protein, 11 aa, Artificial Sequence
  Synthetic Construct
AQSVVASANAQ

SEQ ID NO: 6270 - protein, 11 aa, Artificial Sequence
  Synthetic Construct
AQETVSTSLAQ

SEQ ID NO: 6271 - protein, 11 aa, Artificial Sequence
  Synthetic Construct
AQILAALTGAQ

SEQ ID NO: 6272 - protein, 11 aa, Artificial Sequence
  Synthetic Construct
AQTTDKAALAQ

SEQ ID NO: 6273 - protein, 11 aa, Artificial Sequence
  Synthetic Construct
AQYLDKPGAAQ

SEQ ID NO: 6274 - protein, 11 aa, Artificial Sequence
  Synthetic Construct
AQPNLSNLMAQ

SEQ ID NO: 6275 - protein, 11 aa, Artificial Sequence
  Synthetic Construct
AQINAPTASAQ

SEQ ID NO: 6276 - protein, 11 aa, Artificial Sequence
  Synthetic Construct
AQHGGTSLAAQ

SEQ ID NO: 6277 - protein, 11 aa, Artificial Sequence
  Synthetic Construct
AQNIQLSLAAQ

SEQ ID NO: 6278 - protein, 11 aa, Artificial Sequence
  Synthetic Construct
AQTLHMSSKAQ

SEQ ID NO: 6279 - protein, 11 aa, Artificial Sequence
  Synthetic Construct
AQAIINPHSAQ

SEQ ID NO: 6280 - protein, 11 aa, Artificial Sequence
  Synthetic Construct
AQNTLINVSAQ

SEQ ID NO: 6281 - protein, 11 aa, Artificial Sequence
  Synthetic Construct
AQNSVVLAMAQ

SEQ ID NO: 6282 - protein, 11 aa, Artificial Sequence
  Synthetic Construct
AQNMASLSAAQ

SEQ ID NO: 6283 - protein, 11 aa, Artificial Sequence
  Synthetic Construct
AQSSTHLLAAQ

SEQ ID NO: 6284 - protein, 11 aa, Artificial Sequence
  Synthetic Construct
AQDNSQSDKAQ

SEQ ID NO: 6285 - protein, 11 aa, Artificial Sequence
  Synthetic Construct
AQGITTNAHAQ

SEQ ID NO: 6286 - protein, 11 aa, Artificial Sequence
  Synthetic Construct
AQSSTINGYAQ

SEQ ID NO: 6287 - protein, 11 aa, Artificial Sequence
  Synthetic Construct
AQNHTRMNEAQ

SEQ ID NO: 6288 - protein, 11 aa, Artificial Sequence
  Synthetic Construct
AQGNQQKNLAQ

SEQ ID NO: 6289 - protein, 11 aa, Artificial Sequence
  Synthetic Construct
AQGTSDRQQAQ

SEQ ID NO: 6290 - protein, 11 aa, Artificial Sequence
  Synthetic Construct
AQSDSEYKPAQ

SEQ ID NO: 6291 - protein, 11 aa, Artificial Sequence
  Synthetic Construct
AQTAAHVSYAQ

SEQ ID NO: 6292 - protein, 11 aa, Artificial Sequence
  Synthetic Construct
AQMATTHAAAQ

SEQ ID NO: 6293 - protein, 11 aa, Artificial Sequence
  Synthetic Construct
AQNSVRQSLAQ

SEQ ID NO: 6294 - protein, 11 aa, Artificial Sequence
  Synthetic Construct
AQSGSGVSSAQ

SEQ ID NO: 6295 - protein, 11 aa, Artificial Sequence
  Synthetic Construct
AQPTTRITDAQ

SEQ ID NO: 6296 - protein, 11 aa, Artificial Sequence
  Synthetic Construct
AQSHEAKNPAQ

SEQ ID NO: 6297 - protein, 11 aa, Artificial Sequence
  Synthetic Construct
AQPYSTADRAQ

SEQ ID NO: 6298 - protein, 11 aa, Artificial Sequence
  Synthetic Construct
AQMLSNTNHAQ

SEQ ID NO: 6299 - protein, 11 aa, Artificial Sequence
  Synthetic Construct
AQSLGLGGSAQ

SEQ ID NO: 6300 - protein, 11 aa, Artificial Sequence
  Synthetic Construct
AQNAMNMPVAQ

SEQ ID NO: 6301 - protein, 11 aa, Artificial Sequence
  Synthetic Construct
AQMLGHIANAQ

SEQ ID NO: 6302 - protein, 11 aa, Artificial Sequence
  Synthetic Construct
AQKGQTVSEAQ

SEQ ID NO: 6303 - protein, 11 aa, Artificial Sequence
  Synthetic Construct
AQMDNRNNWAQ

SEQ ID NO: 6304 - protein, 11 aa, Artificial Sequence
  Synthetic Construct
AQLLHRNDVAQ

SEQ ID NO: 6305 - protein, 11 aa, Artificial Sequence
  Synthetic Construct
AQANLVSAKAQ

SEQ ID NO: 6306 - protein, 11 aa, Artificial Sequence
  Synthetic Construct
AQSLTRDLKAQ

SEQ ID NO: 6307 - protein, 11 aa, Artificial Sequence
  Synthetic Construct
AQGGQIVSRAQ

SEQ ID NO: 6308 - protein, 11 aa, Artificial Sequence
  Synthetic Construct
AQNYTPDKRAQ

SEQ ID NO: 6309 - protein, 11 aa, Artificial Sequence
  Synthetic Construct
AQLYANHHSAQ

SEQ ID NO: 6310 - protein, 11 aa, Artificial Sequence
  Synthetic Construct
AQESVAGHMAQ

SEQ ID NO: 6311 - protein, 11 aa, Artificial Sequence
  Synthetic Construct
AQEPRQDAHAQ

SEQ ID NO: 6312 - protein, 11 aa, Artificial Sequence
  Synthetic Construct
AQSVGGTTQAQ

SEQ ID NO: 6313 - protein, 11 aa, Artificial Sequence
  Synthetic Construct
AQQPAMFNGAQ

SEQ ID NO: 6314 - protein, 11 aa, Artificial Sequence
  Synthetic Construct
AQVKQTVMSAQ

SEQ ID NO: 6315 - protein, 11 aa, Artificial Sequence
  Synthetic Construct
AQLYEQASKAQ

SEQ ID NO: 6316 - protein, 11 aa, Artificial Sequence
  Synthetic Construct
AQINAAIALAQ

SEQ ID NO: 6317 - protein, 11 aa, Artificial Sequence
  Synthetic Construct
AQLELSHSRAQ

SEQ ID NO: 6318 - protein, 11 aa, Artificial Sequence
  Synthetic Construct
AQSVKSIMNAQ

SEQ ID NO: 6319 - protein, 11 aa, Artificial Sequence
  Synthetic Construct
AQVPNREPKAQ

SEQ ID NO: 6320 - protein, 11 aa, Artificial Sequence
  Synthetic Construct
AQIASLLSRAQ

SEQ ID NO: 6321 - protein, 11 aa, Artificial Sequence
  Synthetic Construct
AQANNVADRAQ

SEQ ID NO: 6322 - protein, 11 aa, Artificial Sequence
  Synthetic Construct
AQSVDRAERAQ

SEQ ID NO: 6323 - protein, 11 aa, Artificial Sequence
  Synthetic Construct
AQVLADRVPAQ

SEQ ID NO: 6324 - protein, 11 aa, Artificial Sequence
  Synthetic Construct
AQRTDSSHPAQ

SEQ ID NO: 6325 - protein, 11 aa, Artificial Sequence
  Synthetic Construct
AQILGTGGQAQ

SEQ ID NO: 6326 - protein, 11 aa, Artificial Sequence
  Synthetic Construct
AQSTAQASYAQ

SEQ ID NO: 6327 - protein, 11 aa, Artificial Sequence
  Synthetic Construct
AQVGPINTVAQ

SEQ ID NO: 6328 - protein, 11 aa, Artificial Sequence
  Synthetic Construct
AQQTNNTVRAQ

SEQ ID NO: 6329 - protein, 11 aa, Artificial Sequence
  Synthetic Construct
AQGNAVRSTAQ

SEQ ID NO: 6330 - protein, 11 aa, Artificial Sequence
  Synthetic Construct
AQQNLTKGQAQ

SEQ ID NO: 6331 - protein, 11 aa, Artificial Sequence
  Synthetic Construct
AQKQLSKDYAQ

SEQ ID NO: 6332 - protein, 11 aa, Artificial Sequence
  Synthetic Construct
AQMVQNGLIAQ

SEQ ID NO: 6333 - protein, 11 aa, Artificial Sequence
  Synthetic Construct
AQIVEHMPLAQ

SEQ ID NO: 6334 - protein, 11 aa, Artificial Sequence
  Synthetic Construct
AQYDTTSIFAQ

SEQ ID NO: 6335 - protein, 11 aa, Artificial Sequence
  Synthetic Construct
AQNSISSSAAQ

SEQ ID NO: 6336 - protein, 11 aa, Artificial Sequence
  Synthetic Construct
AQGGNNSLHAQ

SEQ ID NO: 6337 - protein, 11 aa, Artificial Sequence
  Synthetic Construct
AQISGASLMAQ

SEQ ID NO: 6338 - protein, 11 aa, Artificial Sequence
  Synthetic Construct
AQATLSRNVAQ

SEQ ID NO: 6339 - protein, 11 aa, Artificial Sequence
  Synthetic Construct
AQLANNVPLAQ

SEQ ID NO: 6340 - protein, 11 aa, Artificial Sequence
  Synthetic Construct
AQWSDPSDLAQ

SEQ ID NO: 6341 - protein, 11 aa, Artificial Sequence
  Synthetic Construct
AQSSLTDQPAQ

SEQ ID NO: 6342 - protein, 11 aa, Artificial Sequence
  Synthetic Construct
AQYVPDHTRAQ

SEQ ID NO: 6343 - protein, 11 aa, Artificial Sequence
  Synthetic Construct
AQNNTEGKAAQ

SEQ ID NO: 6344 - protein, 11 aa, Artificial Sequence
  Synthetic Construct
AQGNSVRLIAQ

SEQ ID NO: 6345 - protein, 11 aa, Artificial Sequence
  Synthetic Construct
AQIAQSNTLAQ

SEQ ID NO: 6346 - protein, 11 aa, Artificial Sequence
  Synthetic Construct
AQHDNATKYAQ

SEQ ID NO: 6347 - protein, 11 aa, Artificial Sequence
  Synthetic Construct
AQTKANEMQAQ

SEQ ID NO: 6348 - protein, 11 aa, Artificial Sequence
  Synthetic Construct
AQYLGTVVAAQ

SEQ ID NO: 6349 - protein, 11 aa, Artificial Sequence
  Synthetic Construct
AQPSIELKPAQ

SEQ ID NO: 6350 - protein, 11 aa, Artificial Sequence
  Synthetic Construct
AQAAGNVLMAQ

SEQ ID NO: 6351 - protein, 11 aa, Artificial Sequence
  Synthetic Construct
AQTSVANLRAQ

SEQ ID NO: 6352 - protein, 11 aa, Artificial Sequence
  Synthetic Construct
AQFSREPKPAQ

SEQ ID NO: 6353 - protein, 11 aa, Artificial Sequence
  Synthetic Construct
AQTPRENWGAQ

SEQ ID NO: 6354 - protein, 11 aa, Artificial Sequence
  Synthetic Construct
AQSQNVGTKAQ

SEQ ID NO: 6355 - protein, 11 aa, Artificial Sequence
  Synthetic Construct
AQYLDKGRTAQ

SEQ ID NO: 6356 - protein, 11 aa, Artificial Sequence
  Synthetic Construct
AQTSTTPFLAQ

SEQ ID NO: 6357 - protein, 11 aa, Artificial Sequence
  Synthetic Construct
AQRQDNLELAQ

SEQ ID NO: 6358 - protein, 11 aa, Artificial Sequence
  Synthetic Construct
AQISDSRVHAQ

SEQ ID NO: 6359 - protein, 11 aa, Artificial Sequence
  Synthetic Construct
AQSQSSHYKAQ

SEQ ID NO: 6360 - protein, 11 aa, Artificial Sequence
  Synthetic Construct
AQLNRVVSQAQ

SEQ ID NO: 6361 - protein, 11 aa, Artificial Sequence
  Synthetic Construct
AQMALDNSRAQ

SEQ ID NO: 6362 - protein, 11 aa, Artificial Sequence
  Synthetic Construct
AQLIQSMAKAQ

SEQ ID NO: 6363 - protein, 11 aa, Artificial Sequence
  Synthetic Construct
AQAGEPNSRAQ

SEQ ID NO: 6364 - protein, 11 aa, Artificial Sequence
  Synthetic Construct
AQSNQSTVRAQ

SEQ ID NO: 6365 - protein, 11 aa, Artificial Sequence
  Synthetic Construct
AQTSNLSERAQ

SEQ ID NO: 6366 - protein, 11 aa, Artificial Sequence
  Synthetic Construct
AQSNSTSRAAQ

SEQ ID NO: 6367 - protein, 11 aa, Artificial Sequence
  Synthetic Construct
AQMQQQFPSAQ

SEQ ID NO: 6368 - protein, 11 aa, Artificial Sequence
  Synthetic Construct
AQFNTLAEVAQ

SEQ ID NO: 6369 - protein, 11 aa, Artificial Sequence
  Synthetic Construct
AQPGVTVISAQ

SEQ ID NO: 6370 - protein, 11 aa, Artificial Sequence
  Synthetic Construct
AQLQNVHDSAQ

SEQ ID NO: 6371 - protein, 11 aa, Artificial Sequence
  Synthetic Construct
AQNSVIGGSAQ

SEQ ID NO: 6372 - protein, 11 aa, Artificial Sequence
  Synthetic Construct
AQNEGVRPLAQ

SEQ ID NO: 6373 - protein, 11 aa, Artificial Sequence
  Synthetic Construct
AQSVNPSVVAQ

SEQ ID NO: 6374 - protein, 11 aa, Artificial Sequence
  Synthetic Construct
AQMSTTSEDAQ

SEQ ID NO: 6375 - protein, 11 aa, Artificial Sequence
  Synthetic Construct
AQIHSGLPKAQ

SEQ ID NO: 6376 - protein, 11 aa, Artificial Sequence
  Synthetic Construct
AQGMNGYPKAQ

SEQ ID NO: 6377 - protein, 11 aa, Artificial Sequence
  Synthetic Construct
AQSIRDSVKAQ

SEQ ID NO: 6378 - protein, 11 aa, Artificial Sequence
  Synthetic Construct
AQMLKPDNVAQ

SEQ ID NO: 6379 - protein, 11 aa, Artificial Sequence
  Synthetic Construct
AQAFTSSLGAQ

SEQ ID NO: 6380 - protein, 11 aa, Artificial Sequence
  Synthetic Construct
AQMLDKSSSAQ

SEQ ID NO: 6381 - protein, 11 aa, Artificial Sequence
  Synthetic Construct
AQKTQNTQMAQ

SEQ ID NO: 6382 - protein, 11 aa, Artificial Sequence
  Synthetic Construct
AQGTTSSMAAQ

SEQ ID NO: 6383 - protein, 11 aa, Artificial Sequence
  Synthetic Construct
AQGSAASQAAQ

SEQ ID NO: 6384 - protein, 11 aa, Artificial Sequence
  Synthetic Construct
AQAHSNIDSAQ

SEQ ID NO: 6385 - protein, 11 aa, Artificial Sequence
  Synthetic Construct
AQGSASSLLAQ

SEQ ID NO: 6386 - protein, 11 aa, Artificial Sequence
  Synthetic Construct
AQLSPNSSFAQ

SEQ ID NO: 6387 - protein, 11 aa, Artificial Sequence
  Synthetic Construct
AQGHSVTPSAQ

SEQ ID NO: 6388 - protein, 11 aa, Artificial Sequence
  Synthetic Construct
AQKGGNSIDAQ

SEQ ID NO: 6389 - protein, 11 aa, Artificial Sequence
  Synthetic Construct
AQLGPSPSAAQ

SEQ ID NO: 6390 - protein, 11 aa, Artificial Sequence
  Synthetic Construct
AQQLPMLNAAQ

SEQ ID NO: 6391 - protein, 11 aa, Artificial Sequence
  Synthetic Construct
AQATNILTAAQ

SEQ ID NO: 6392 - protein, 11 aa, Artificial Sequence
  Synthetic Construct
AQLMQNGQKAQ

SEQ ID NO: 6393 - protein, 11 aa, Artificial Sequence
  Synthetic Construct
AQHNNGQALAQ

SEQ ID NO: 6394 - protein, 11 aa, Artificial Sequence
  Synthetic Construct
AQSITQTLSAQ

SEQ ID NO: 6395 - protein, 11 aa, Artificial Sequence
  Synthetic Construct
AQGNRISNTAQ

SEQ ID NO: 6396 - protein, 11 aa, Artificial Sequence
  Synthetic Construct
AQGPQNDPPAQ

SEQ ID NO: 6397 - protein, 11 aa, Artificial Sequence
  Synthetic Construct
AQINGMGPNAQ

SEQ ID NO: 6398 - protein, 11 aa, Artificial Sequence
  Synthetic Construct
AQTGNAHPNAQ

SEQ ID NO: 6399 - protein, 11 aa, Artificial Sequence
  Synthetic Construct
AQYAVNLNNAQ

SEQ ID NO: 6400 - protein, 11 aa, Artificial Sequence
  Synthetic Construct
AQALISNSTAQ

SEQ ID NO: 6401 - protein, 11 aa, Artificial Sequence
  Synthetic Construct
AQSHVSTTMAQ

SEQ ID NO: 6402 - protein, 11 aa, Artificial Sequence
  Synthetic Construct
AQLDDFVRPAQ

SEQ ID NO: 6403 - protein, 11 aa, Artificial Sequence
  Synthetic Construct
AQNNTARSVAQ

SEQ ID NO: 6404 - protein, 11 aa, Artificial Sequence
  Synthetic Construct
AQNKYPQPSAQ

SEQ ID NO: 6405 - protein, 11 aa, Artificial Sequence
  Synthetic Construct
AQYASELFVAQ

SEQ ID NO: 6406 - protein, 11 aa, Artificial Sequence
  Synthetic Construct
AQFYTANASAQ

SEQ ID NO: 6407 - protein, 11 aa, Artificial Sequence
  Synthetic Construct
AQFTKSNATAQ

SEQ ID NO: 6408 - protein, 11 aa, Artificial Sequence
  Synthetic Construct
AQLAVSQMRAQ

SEQ ID NO: 6409 - protein, 11 aa, Artificial Sequence
  Synthetic Construct
AQRNGQLIVAQ

SEQ ID NO: 6410 - protein, 11 aa, Artificial Sequence
  Synthetic Construct
AQDTANTARAQ

SEQ ID NO: 6411 - protein, 11 aa, Artificial Sequence
  Synthetic Construct
AQKPTEVQHAQ

SEQ ID NO: 6412 - protein, 11 aa, Artificial Sequence
  Synthetic Construct
AQLTNAATYAQ

SEQ ID NO: 6413 - protein, 11 aa, Artificial Sequence
  Synthetic Construct
AQISNVQANAQ

SEQ ID NO: 6414 - protein, 11 aa, Artificial Sequence
  Synthetic Construct
AQESRNNGFAQ

SEQ ID NO: 6415 - protein, 11 aa, Artificial Sequence
  Synthetic Construct
AQSTGPTMHAQ

SEQ ID NO: 6416 - protein, 11 aa, Artificial Sequence
  Synthetic Construct
AQTPGESHKAQ

SEQ ID NO: 6417 - protein, 11 aa, Artificial Sequence
  Synthetic Construct
AQSVSIASSAQ

SEQ ID NO: 6418 - protein, 11 aa, Artificial Sequence
  Synthetic Construct
AQNGVTQSKAQ

SEQ ID NO: 6419 - protein, 11 aa, Artificial Sequence
  Synthetic Construct
AQAKNTYASAQ

SEQ ID NO: 6420 - protein, 11 aa, Artificial Sequence
  Synthetic Construct
AQGTSDGHRAQ

SEQ ID NO: 6421 - protein, 11 aa, Artificial Sequence
  Synthetic Construct
AQWSQNKGYAQ

SEQ ID NO: 6422 - protein, 11 aa, Artificial Sequence
  Synthetic Construct
AQGQLARSVAQ

SEQ ID NO: 6423 - protein, 11 aa, Artificial Sequence
  Synthetic Construct
AQIGGGAQKAQ

SEQ ID NO: 6424 - protein, 11 aa, Artificial Sequence
  Synthetic Construct
AQAGNASHTAQ

SEQ ID NO: 6425 - protein, 11 aa, Artificial Sequence
  Synthetic Construct
AQFNQVGKMAQ

SEQ ID NO: 6426 - protein, 11 aa, Artificial Sequence
  Synthetic Construct
AQTRDTLYKAQ

SEQ ID NO: 6427 - protein, 11 aa, Artificial Sequence
  Synthetic Construct
AQNGSPSYNAQ

SEQ ID NO: 6428 - protein, 11 aa, Artificial Sequence
  Synthetic Construct
AQLAEAHARAQ

SEQ ID NO: 6429 - protein, 11 aa, Artificial Sequence
  Synthetic Construct
AQPMSNSERAQ

SEQ ID NO: 6430 - protein, 11 aa, Artificial Sequence
  Synthetic Construct
AQHVTSLNDAQ

SEQ ID NO: 6431 - protein, 11 aa, Artificial Sequence
  Synthetic Construct
AQGAPHVSRAQ

SEQ ID NO: 6432 - protein, 11 aa, Artificial Sequence
  Synthetic Construct
AQNTNGNSAAQ

SEQ ID NO: 6433 - protein, 11 aa, Artificial Sequence
  Synthetic Construct
AQNELTGMLAQ

SEQ ID NO: 6434 - protein, 11 aa, Artificial Sequence
  Synthetic Construct
AQSSLLPAAAQ

SEQ ID NO: 6435 - protein, 11 aa, Artificial Sequence
  Synthetic Construct
AQPVGQSLTAQ

SEQ ID NO: 6436 - protein, 11 aa, Artificial Sequence
  Synthetic Construct
AQLTAAKGLAQ

SEQ ID NO: 6437 - protein, 11 aa, Artificial Sequence
  Synthetic Construct
AQLIGRLTSAQ

SEQ ID NO: 6438 - protein, 11 aa, Artificial Sequence
  Synthetic Construct
AQAKHNDNIAQ

SEQ ID NO: 6439 - protein, 11 aa, Artificial Sequence
  Synthetic Construct
AQLRSGDEMAQ

SEQ ID NO: 6440 - protein, 11 aa, Artificial Sequence
  Synthetic Construct
AQPQNSTTAAQ

SEQ ID NO: 6441 - protein, 11 aa, Artificial Sequence
  Synthetic Construct
AQLATGPLFAQ

SEQ ID NO: 6442 - protein, 11 aa, Artificial Sequence
  Synthetic Construct
AQASAVSQKAQ

SEQ ID NO: 6443 - protein, 11 aa, Artificial Sequence
  Synthetic Construct
AQAPVSSALAQ

SEQ ID NO: 6444 - protein, 11 aa, Artificial Sequence
  Synthetic Construct
AQTMPSLDSAQ

SEQ ID NO: 6445 - protein, 11 aa, Artificial Sequence
  Synthetic Construct
AQHMNFPNPAQ

SEQ ID NO: 6446 - protein, 11 aa, Artificial Sequence
  Synthetic Construct
AQASARMDAAQ

SEQ ID NO: 6447 - protein, 11 aa, Artificial Sequence
  Synthetic Construct
AQTVIVGGRAQ

SEQ ID NO: 6448 - protein, 11 aa, Artificial Sequence
  Synthetic Construct
AQSSQSQTVAQ

SEQ ID NO: 6449 - protein, 11 aa, Artificial Sequence
  Synthetic Construct
AQINTTSQKAQ

SEQ ID NO: 6450 - protein, 11 aa, Artificial Sequence
  Synthetic Construct
AQAGARVTEAQ

SEQ ID NO: 6451 - protein, 11 aa, Artificial Sequence
  Synthetic Construct
AQPAPHSGSAQ

SEQ ID NO: 6452 - protein, 11 aa, Artificial Sequence
  Synthetic Construct
AQLNVMYNPAQ

SEQ ID NO: 6453 - protein, 11 aa, Artificial Sequence
  Synthetic Construct
AQGHAQTLYAQ

SEQ ID NO: 6454 - protein, 11 aa, Artificial Sequence
  Synthetic Construct
AQTPNLSTHAQ

SEQ ID NO: 6455 - protein, 11 aa, Artificial Sequence
  Synthetic Construct
AQSAERTNVAQ

SEQ ID NO: 6456 - protein, 11 aa, Artificial Sequence
  Synthetic Construct
AQNNLRPVYAQ

SEQ ID NO: 6457 - protein, 11 aa, Artificial Sequence
  Synthetic Construct
AQNQQSAYTAQ

SEQ ID NO: 6458 - protein, 11 aa, Artificial Sequence
  Synthetic Construct
AQVVDGKTQAQ

SEQ ID NO: 6459 - protein, 11 aa, Artificial Sequence
  Synthetic Construct
AQPLPQQLDAQ

SEQ ID NO: 6460 - protein, 11 aa, Artificial Sequence
  Synthetic Construct
AQVAEIVQLAQ

SEQ ID NO: 6461 - protein, 11 aa, Artificial Sequence
  Synthetic Construct
AQDRNTTVRAQ

SEQ ID NO: 6462 - protein, 11 aa, Artificial Sequence
  Synthetic Construct
AQNMMKTGMAQ

SEQ ID NO: 6463 - protein, 11 aa, Artificial Sequence
  Synthetic Construct
AQVQFNTSKAQ

SEQ ID NO: 6464 - protein, 11 aa, Artificial Sequence
  Synthetic Construct
AQPGNASIRAQ

SEQ ID NO: 6465 - protein, 11 aa, Artificial Sequence
  Synthetic Construct
AQLGGILSAAQ

SEQ ID NO: 6466 - protein, 11 aa, Artificial Sequence
  Synthetic Construct
AQQTDHSHLAQ

SEQ ID NO: 6467 - protein, 11 aa, Artificial Sequence
  Synthetic Construct
AQTLHAEFSAQ

SEQ ID NO: 6468 - protein, 11 aa, Artificial Sequence
  Synthetic Construct
AQLSDRLNAAQ

SEQ ID NO: 6469 - protein, 11 aa, Artificial Sequence
  Synthetic Construct
AQLNERIGGAQ

SEQ ID NO: 6470 - protein, 11 aa, Artificial Sequence
  Synthetic Construct
AQTLNSTASAQ

SEQ ID NO: 6471 - protein, 11 aa, Artificial Sequence
  Synthetic Construct
AQSGRVVAQAQ

SEQ ID NO: 6472 - protein, 11 aa, Artificial Sequence
  Synthetic Construct
AQNNRTTNNAQ

SEQ ID NO: 6473 - protein, 11 aa, Artificial Sequence
  Synthetic Construct
AQNVPSSTYAQ

SEQ ID NO: 6474 - protein, 11 aa, Artificial Sequence
  Synthetic Construct
AQVPSTALKAQ

SEQ ID NO: 6475 - protein, 11 aa, Artificial Sequence
  Synthetic Construct
AQPPNTQSLAQ

SEQ ID NO: 6476 - protein, 11 aa, Artificial Sequence
  Synthetic Construct
AQTNTTRAMAQ

SEQ ID NO: 6477 - protein, 11 aa, Artificial Sequence
  Synthetic Construct
AQSNRTVREAQ

SEQ ID NO: 6478 - protein, 11 aa, Artificial Sequence
  Synthetic Construct
AQASTQIMRAQ

SEQ ID NO: 6479 - protein, 11 aa, Artificial Sequence
  Synthetic Construct
AQTVISSSRAQ

SEQ ID NO: 6480 - protein, 11 aa, Artificial Sequence
  Synthetic Construct
AQVYSPQGTAQ

SEQ ID NO: 6481 - protein, 11 aa, Artificial Sequence
  Synthetic Construct
AQGSPTQSMAQ

SEQ ID NO: 6482 - protein, 11 aa, Artificial Sequence
  Synthetic Construct
AQAVSSEARAQ

SEQ ID NO: 6483 - protein, 11 aa, Artificial Sequence
  Synthetic Construct
AQGSVATLTAQ

SEQ ID NO: 6484 - protein, 11 aa, Artificial Sequence
  Synthetic Construct
AQSANTGTGAQ

SEQ ID NO: 6485 - protein, 11 aa, Artificial Sequence
  Synthetic Construct
AQIVQGTSMAQ

SEQ ID NO: 6486 - protein, 11 aa, Artificial Sequence
  Synthetic Construct
AQTPSLGVLAQ

SEQ ID NO: 6487 - protein, 11 aa, Artificial Sequence
  Synthetic Construct
AQPNMMGSSAQ

SEQ ID NO: 6488 - protein, 11 aa, Artificial Sequence
  Synthetic Construct
AQLTQSPAPAQ

SEQ ID NO: 6489 - protein, 11 aa, Artificial Sequence
  Synthetic Construct
AQKGSNSTLAQ

SEQ ID NO: 6490 - protein, 11 aa, Artificial Sequence
  Synthetic Construct
AQPMAAAPRAQ

SEQ ID NO: 6491 - protein, 11 aa, Artificial Sequence
  Synthetic Construct
AQVTTGPSRAQ

SEQ ID NO: 6492 - protein, 11 aa, Artificial Sequence
  Synthetic Construct
AQVVSPLSYAQ

SEQ ID NO: 6493 - protein, 11 aa, Artificial Sequence
  Synthetic Construct
AQVTGSVQKAQ

SEQ ID NO: 6494 - protein, 11 aa, Artificial Sequence
  Synthetic Construct
AQGGTTVQTAQ

SEQ ID NO: 6495 - protein, 11 aa, Artificial Sequence
  Synthetic Construct
AQNSAQINMAQ

SEQ ID NO: 6496 - protein, 11 aa, Artificial Sequence
  Synthetic Construct
AQPGTQKPTAQ

SEQ ID NO: 6497 - protein, 11 aa, Artificial Sequence
  Synthetic Construct
AQGKASHYPAQ

SEQ ID NO: 6498 - protein, 11 aa, Artificial Sequence
  Synthetic Construct
AQYNSVPSAAQ

SEQ ID NO: 6499 - protein, 11 aa, Artificial Sequence
  Synthetic Construct
AQVYERVSHAQ

SEQ ID NO: 6500 - protein, 11 aa, Artificial Sequence
  Synthetic Construct
AQDVNNRSMAQ

SEQ ID NO: 6501 - protein, 11 aa, Artificial Sequence
  Synthetic Construct
AQPHAVSMLAQ

SEQ ID NO: 6502 - protein, 11 aa, Artificial Sequence
  Synthetic Construct
AQGMPAPLGAQ

SEQ ID NO: 6503 - protein, 11 aa, Artificial Sequence
  Synthetic Construct
AQQLQINPAAQ

SEQ ID NO: 6504 - protein, 11 aa, Artificial Sequence
  Synthetic Construct
AQTMDLSPPAQ

SEQ ID NO: 6505 - protein, 11 aa, Artificial Sequence
  Synthetic Construct
AQTTDLHAKAQ

SEQ ID NO: 6506 - protein, 11 aa, Artificial Sequence
  Synthetic Construct
AQHHTTQTTAQ

SEQ ID NO: 6507 - protein, 11 aa, Artificial Sequence
  Synthetic Construct
AQPSSNSTNAQ

SEQ ID NO: 6508 - protein, 11 aa, Artificial Sequence
  Synthetic Construct
AQTRYNVDPAQ

SEQ ID NO: 6509 - protein, 11 aa, Artificial Sequence
  Synthetic Construct
AQSVVSLSPAQ

SEQ ID NO: 6510 - protein, 11 aa, Artificial Sequence
  Synthetic Construct
AQEKVDQLRAQ

SEQ ID NO: 6511 - protein, 11 aa, Artificial Sequence
  Synthetic Construct
AQSDSRQTLAQ

SEQ ID NO: 6512 - protein, 11 aa, Artificial Sequence
  Synthetic Construct
AQTYPATSDAQ

SEQ ID NO: 6513 - protein, 11 aa, Artificial Sequence
  Synthetic Construct
AQSMNVGSAAQ

SEQ ID NO: 6514 - protein, 11 aa, Artificial Sequence
  Synthetic Construct
AQLESSNAIAQ

SEQ ID NO: 6515 - protein, 11 aa, Artificial Sequence
  Synthetic Construct
AQSPTNHAPAQ

SEQ ID NO: 6516 - protein, 11 aa, Artificial Sequence
  Synthetic Construct
AQAHEGMVKAQ

SEQ ID NO: 6517 - protein, 11 aa, Artificial Sequence
  Synthetic Construct
AQVDTLLSKAQ

SEQ ID NO: 6518 - protein, 11 aa, Artificial Sequence
  Synthetic Construct
AQTAGQLTWAQ

SEQ ID NO: 6519 - protein, 11 aa, Artificial Sequence
  Synthetic Construct
AQMGMDGQIAQ

SEQ ID NO: 6520 - protein, 11 aa, Artificial Sequence
  Synthetic Construct
AQELENGRRAQ

SEQ ID NO: 6521 - protein, 11 aa, Artificial Sequence
  Synthetic Construct
AQLDLSVSRAQ

SEQ ID NO: 6522 - protein, 11 aa, Artificial Sequence
  Synthetic Construct
AQSQHPNMTAQ

SEQ ID NO: 6523 - protein, 11 aa, Artificial Sequence
  Synthetic Construct
AQYHEVSEHAQ

SEQ ID NO: 6524 - protein, 11 aa, Artificial Sequence
  Synthetic Construct
AQMRSPPPTAQ

SEQ ID NO: 6525 - protein, 11 aa, Artificial Sequence
  Synthetic Construct
AQGSGSSTIAQ

SEQ ID NO: 6526 - protein, 11 aa, Artificial Sequence
  Synthetic Construct
AQGGDAGRWAQ

SEQ ID NO: 6527 - protein, 11 aa, Artificial Sequence
  Synthetic Construct
AQKAEAMVIAQ

SEQ ID NO: 6528 - protein, 11 aa, Artificial Sequence
  Synthetic Construct
AQANKDLGVAQ

SEQ ID NO: 6529 - protein, 11 aa, Artificial Sequence
  Synthetic Construct
AQTSSENRTAQ

SEQ ID NO: 6530 - protein, 11 aa, Artificial Sequence
  Synthetic Construct
AQGPDRTAAAQ

SEQ ID NO: 6531 - protein, 11 aa, Artificial Sequence
  Synthetic Construct
AQGSTVVHLAQ

SEQ ID NO: 6532 - protein, 11 aa, Artificial Sequence
  Synthetic Construct
AQTAVVVPQAQ

SEQ ID NO: 6533 - protein, 11 aa, Artificial Sequence
  Synthetic Construct
AQAVNIANAAQ

SEQ ID NO: 6534 - protein, 11 aa, Artificial Sequence
  Synthetic Construct
AQLLSQSGVAQ

SEQ ID NO: 6535 - protein, 11 aa, Artificial Sequence
  Synthetic Construct
AQHTGEGKLAQ

SEQ ID NO: 6536 - protein, 11 aa, Artificial Sequence
  Synthetic Construct
AQSNGNNIRAQ

SEQ ID NO: 6537 - protein, 11 aa, Artificial Sequence
  Synthetic Construct
AQEVTLMHKAQ

SEQ ID NO: 6538 - protein, 11 aa, Artificial Sequence
  Synthetic Construct
AQLTTTGSNAQ

SEQ ID NO: 6539 - protein, 11 aa, Artificial Sequence
  Synthetic Construct
AQDISGKIAAQ

SEQ ID NO: 6540 - protein, 11 aa, Artificial Sequence
  Synthetic Construct
AQISPNVYSAQ

SEQ ID NO: 6541 - protein, 11 aa, Artificial Sequence
  Synthetic Construct
AQYNKLVDGAQ

SEQ ID NO: 6542 - protein, 11 aa, Artificial Sequence
  Synthetic Construct
AQFHTHPTSAQ

SEQ ID NO: 6543 - protein, 11 aa, Artificial Sequence
  Synthetic Construct
AQPTLEATSAQ

SEQ ID NO: 6544 - protein, 11 aa, Artificial Sequence
  Synthetic Construct
AQELGRNGPAQ

SEQ ID NO: 6545 - protein, 11 aa, Artificial Sequence
  Synthetic Construct
AQVDKVERLAQ

SEQ ID NO: 6546 - protein, 11 aa, Artificial Sequence
  Synthetic Construct
AQTTTMTPRAQ

SEQ ID NO: 6547 - protein, 11 aa, Artificial Sequence
  Synthetic Construct
AQLQQIPTPAQ

SEQ ID NO: 6548 - protein, 11 aa, Artificial Sequence
  Synthetic Construct
AQTDSNSLQAQ

SEQ ID NO: 6549 - protein, 11 aa, Artificial Sequence
  Synthetic Construct
AQDDRSVRFAQ

SEQ ID NO: 6550 - protein, 11 aa, Artificial Sequence
  Synthetic Construct
AQLATQNASAQ

SEQ ID NO: 6551 - protein, 11 aa, Artificial Sequence
  Synthetic Construct
AQVGTHIHSAQ

SEQ ID NO: 6552 - protein, 11 aa, Artificial Sequence
  Synthetic Construct
AQSERSSVKAQ

SEQ ID NO: 6553 - protein, 11 aa, Artificial Sequence
  Synthetic Construct
AQGYAHSMIAQ

SEQ ID NO: 6554 - protein, 11 aa, Artificial Sequence
  Synthetic Construct
AQPLSGGVRAQ

SEQ ID NO: 6555 - protein, 11 aa, Artificial Sequence
  Synthetic Construct
AQLTYVASSAQ

SEQ ID NO: 6556 - protein, 11 aa, Artificial Sequence
  Synthetic Construct
AQVDKTLSRAQ

SEQ ID NO: 6557 - protein, 11 aa, Artificial Sequence
  Synthetic Construct
AQPNLVGVPAQ

SEQ ID NO: 6558 - protein, 11 aa, Artificial Sequence
  Synthetic Construct
AQTKIDTVRAQ

SEQ ID NO: 6559 - protein, 11 aa, Artificial Sequence
  Synthetic Construct
AQSGGTQARAQ

SEQ ID NO: 6560 - protein, 11 aa, Artificial Sequence
  Synthetic Construct
AQHSTPLVSAQ

SEQ ID NO: 6561 - protein, 11 aa, Artificial Sequence
  Synthetic Construct
AQHSGTNLRAQ

SEQ ID NO: 6562 - protein, 11 aa, Artificial Sequence
  Synthetic Construct
AQAQPRLVTAQ

SEQ ID NO: 6563 - protein, 11 aa, Artificial Sequence
  Synthetic Construct
AQPLGAHGSAQ

SEQ ID NO: 6564 - protein, 11 aa, Artificial Sequence
  Synthetic Construct
AQISDASVLAQ

SEQ ID NO: 6565 - protein, 11 aa, Artificial Sequence
  Synthetic Construct
AQMSVGVKTAQ

SEQ ID NO: 6566 - protein, 11 aa, Artificial Sequence
  Synthetic Construct
AQNIAEGLSAQ

SEQ ID NO: 6567 - protein, 11 aa, Artificial Sequence
  Synthetic Construct
AQSSNSDGIAQ

SEQ ID NO: 6568 - protein, 11 aa, Artificial Sequence
  Synthetic Construct
AQVGQTTNSAQ

SEQ ID NO: 6569 - protein, 11 aa, Artificial Sequence
  Synthetic Construct
AQESKRPFLAQ

SEQ ID NO: 6570 - protein, 11 aa, Artificial Sequence
  Synthetic Construct
AQSQENSRTAQ

SEQ ID NO: 6571 - protein, 11 aa, Artificial Sequence
  Synthetic Construct
AQNTGTDHPAQ

SEQ ID NO: 6572 - protein, 11 aa, Artificial Sequence
  Synthetic Construct
AQGNWVKDIAQ

SEQ ID NO: 6573 - protein, 11 aa, Artificial Sequence
  Synthetic Construct
AQRLTETVTAQ

SEQ ID NO: 6574 - protein, 11 aa, Artificial Sequence
  Synthetic Construct
AQGEIGVLYAQ

SEQ ID NO: 6575 - protein, 11 aa, Artificial Sequence
  Synthetic Construct
AQLAPEPLKAQ

SEQ ID NO: 6576 - protein, 11 aa, Artificial Sequence
  Synthetic Construct
AQNKLPPALAQ

SEQ ID NO: 6577 - protein, 11 aa, Artificial Sequence
  Synthetic Construct
AQNIGTRDAAQ

SEQ ID NO: 6578 - protein, 11 aa, Artificial Sequence
  Synthetic Construct
AQTVRELQPAQ

SEQ ID NO: 6579 - protein, 11 aa, Artificial Sequence
  Synthetic Construct
AQENHGTTSAQ

SEQ ID NO: 6580 - protein, 11 aa, Artificial Sequence
  Synthetic Construct
AQHTDRNYVAQ

SEQ ID NO: 6581 - protein, 11 aa, Artificial Sequence
  Synthetic Construct
AQTVGPTSHAQ

SEQ ID NO: 6582 - protein, 11 aa, Artificial Sequence
  Synthetic Construct
AQGLVKDHPAQ

SEQ ID NO: 6583 - protein, 11 aa, Artificial Sequence
  Synthetic Construct
AQINALTNGAQ

SEQ ID NO: 6584 - protein, 11 aa, Artificial Sequence
  Synthetic Construct
AQPLDSNRDAQ

SEQ ID NO: 6585 - protein, 11 aa, Artificial Sequence
  Synthetic Construct
AQLKVTKIDAQ

SEQ ID NO: 6586 - protein, 11 aa, Artificial Sequence
  Synthetic Construct
AQHNSNPGLAQ

SEQ ID NO: 6587 - protein, 11 aa, Artificial Sequence
  Synthetic Construct
AQTTVILKTAQ

SEQ ID NO: 6588 - protein, 11 aa, Artificial Sequence
  Synthetic Construct
AQLGKGMTAAQ

SEQ ID NO: 6589 - protein, 11 aa, Artificial Sequence
  Synthetic Construct
AQFSISDLKAQ

SEQ ID NO: 6590 - protein, 11 aa, Artificial Sequence
  Synthetic Construct
AQSTDTHLPAQ

SEQ ID NO: 6591 - protein, 11 aa, Artificial Sequence
  Synthetic Construct
AQLNAVKNVAQ

SEQ ID NO: 6592 - protein, 11 aa, Artificial Sequence
  Synthetic Construct
AQRSTPNTIAQ

SEQ ID NO: 6593 - protein, 11 aa, Artificial Sequence
  Synthetic Construct
AQLSIKLQNAQ

SEQ ID NO: 6594 - protein, 11 aa, Artificial Sequence
  Synthetic Construct
AQSLAITSSAQ

SEQ ID NO: 6595 - protein, 11 aa, Artificial Sequence
  Synthetic Construct
AQRQDITIAAQ

SEQ ID NO: 6596 - protein, 11 aa, Artificial Sequence
  Synthetic Construct
AQGNATPRSAQ

SEQ ID NO: 6597 - protein, 11 aa, Artificial Sequence
  Synthetic Construct
AQSLVGTTSAQ

SEQ ID NO: 6598 - protein, 11 aa, Artificial Sequence
  Synthetic Construct
AQWQTQDKEAQ

SEQ ID NO: 6599 - protein, 11 aa, Artificial Sequence
  Synthetic Construct
AQTPNVPSPAQ

SEQ ID NO: 6600 - protein, 11 aa, Artificial Sequence
  Synthetic Construct
AQINTISPKAQ

SEQ ID NO: 6601 - protein, 11 aa, Artificial Sequence
  Synthetic Construct
AQPLGTSNTAQ

SEQ ID NO: 6602 - protein, 11 aa, Artificial Sequence
  Synthetic Construct
AQSQVNGGKAQ

SEQ ID NO: 6603 - protein, 11 aa, Artificial Sequence
  Synthetic Construct
AQPINDKVMAQ

SEQ ID NO: 6604 - protein, 11 aa, Artificial Sequence
  Synthetic Construct
AQNVSSSILAQ

SEQ ID NO: 6605 - protein, 11 aa, Artificial Sequence
  Synthetic Construct
AQQANWTASAQ

SEQ ID NO: 6606 - protein, 11 aa, Artificial Sequence
  Synthetic Construct
AQRPENHSSAQ

SEQ ID NO: 6607 - protein, 11 aa, Artificial Sequence
  Synthetic Construct
AQTRNLDVHAQ

SEQ ID NO: 6608 - protein, 11 aa, Artificial Sequence
  Synthetic Construct
AQINSSFSKAQ

SEQ ID NO: 6609 - protein, 11 aa, Artificial Sequence
  Synthetic Construct
AQSIQGSQRAQ

SEQ ID NO: 6610 - protein, 11 aa, Artificial Sequence
  Synthetic Construct
AQVVAVGQFAQ

SEQ ID NO: 6611 - protein, 11 aa, Artificial Sequence
  Synthetic Construct
AQVNKVRDVAQ

SEQ ID NO: 6612 - protein, 11 aa, Artificial Sequence
  Synthetic Construct
AQKPNAQIQAQ

SEQ ID NO: 6613 - protein, 11 aa, Artificial Sequence
  Synthetic Construct
AQMSIGTGSAQ

SEQ ID NO: 6614 - protein, 11 aa, Artificial Sequence
  Synthetic Construct
AQGLQATYSAQ

SEQ ID NO: 6615 - protein, 11 aa, Artificial Sequence
  Synthetic Construct
AQQTLSASSAQ

SEQ ID NO: 6616 - protein, 11 aa, Artificial Sequence
  Synthetic Construct
AQDPPNKFPAQ

SEQ ID NO: 6617 - protein, 11 aa, Artificial Sequence
  Synthetic Construct
AQRISTLGLAQ

SEQ ID NO: 6618 - protein, 11 aa, Artificial Sequence
  Synthetic Construct
AQNSDRSVSAQ

SEQ ID NO: 6619 - protein, 11 aa, Artificial Sequence
  Synthetic Construct
AQYNLRLGGAQ

SEQ ID NO: 6620 - protein, 11 aa, Artificial Sequence
  Synthetic Construct
AQVQDRAMTAQ

SEQ ID NO: 6621 - protein, 11 aa, Artificial Sequence
  Synthetic Construct
AQSSSTLPRAQ

SEQ ID NO: 6622 - protein, 11 aa, Artificial Sequence
  Synthetic Construct
AQGGVQTDSAQ

SEQ ID NO: 6623 - protein, 11 aa, Artificial Sequence
  Synthetic Construct
AQLLSNNTRAQ

SEQ ID NO: 6624 - protein, 11 aa, Artificial Sequence
  Synthetic Construct
AQYHAAQAVAQ

SEQ ID NO: 6625 - protein, 11 aa, Artificial Sequence
  Synthetic Construct
AQMSGVGSSAQ

SEQ ID NO: 6626 - protein, 11 aa, Artificial Sequence
  Synthetic Construct
AQLTGQVLVAQ

SEQ ID NO: 6627 - protein, 11 aa, Artificial Sequence
  Synthetic Construct
AQAVNRLPIAQ

SEQ ID NO: 6628 - protein, 11 aa, Artificial Sequence
  Synthetic Construct
AQSSQMPLRAQ

SEQ ID NO: 6629 - protein, 11 aa, Artificial Sequence
  Synthetic Construct
AQSSNIADSAQ

SEQ ID NO: 6630 - protein, 11 aa, Artificial Sequence
  Synthetic Construct
AQVVTPQISAQ

SEQ ID NO: 6631 - protein, 11 aa, Artificial Sequence
  Synthetic Construct
AQDSKKMSWAQ

SEQ ID NO: 6632 - protein, 11 aa, Artificial Sequence
  Synthetic Construct
AQETYKTTLAQ

SEQ ID NO: 6633 - protein, 11 aa, Artificial Sequence
  Synthetic Construct
AQLTMGNSLAQ

SEQ ID NO: 6634 - protein, 11 aa, Artificial Sequence
  Synthetic Construct
AQFKVSIQQAQ

SEQ ID NO: 6635 - protein, 11 aa, Artificial Sequence
  Synthetic Construct
AQDGHAHLPAQ

SEQ ID NO: 6636 - protein, 11 aa, Artificial Sequence
  Synthetic Construct
AQTAVSLSNAQ

SEQ ID NO: 6637 - protein, 11 aa, Artificial Sequence
  Synthetic Construct
AQSQNQMQTAQ

SEQ ID NO: 6638 - protein, 11 aa, Artificial Sequence
  Synthetic Construct
AQQSVTTQHAQ

SEQ ID NO: 6639 - protein, 11 aa, Artificial Sequence
  Synthetic Construct
AQLSTALTVAQ

SEQ ID NO: 6640 - protein, 11 aa, Artificial Sequence
  Synthetic Construct
AQLANAVTKAQ

SEQ ID NO: 6641 - protein, 11 aa, Artificial Sequence
  Synthetic Construct
AQTGHVHENAQ

SEQ ID NO: 6642 - protein, 11 aa, Artificial Sequence
  Synthetic Construct
AQSISDTASAQ

SEQ ID NO: 6643 - protein, 11 aa, Artificial Sequence
  Synthetic Construct
AQPVVQSVGAQ

SEQ ID NO: 6644 - protein, 11 aa, Artificial Sequence
  Synthetic Construct
AQQHLSTVNAQ

SEQ ID NO: 6645 - protein, 11 aa, Artificial Sequence
  Synthetic Construct
AQLSHNTTHAQ

SEQ ID NO: 6646 - protein, 11 aa, Artificial Sequence
  Synthetic Construct
AQPSNFSNSAQ

SEQ ID NO: 6647 - protein, 11 aa, Artificial Sequence
  Synthetic Construct
AQFDKSVPSAQ

SEQ ID NO: 6648 - protein, 11 aa, Artificial Sequence
  Synthetic Construct
AQTQATEKDAQ

SEQ ID NO: 6649 - protein, 11 aa, Artificial Sequence
  Synthetic Construct
AQLSAKASQAQ

SEQ ID NO: 6650 - protein, 11 aa, Artificial Sequence
  Synthetic Construct
AQSVQPAVSAQ

SEQ ID NO: 6651 - protein, 11 aa, Artificial Sequence
  Synthetic Construct
AQSLMHGTPAQ

SEQ ID NO: 6652 - protein, 11 aa, Artificial Sequence
  Synthetic Construct
AQPTIRTNTAQ

SEQ ID NO: 6653 - protein, 11 aa, Artificial Sequence
  Synthetic Construct
AQNDSLKVNAQ

SEQ ID NO: 6654 - protein, 11 aa, Artificial Sequence
  Synthetic Construct
AQSTQPVNRAQ

SEQ ID NO: 6655 - protein, 11 aa, Artificial Sequence
  Synthetic Construct
AQSSDKHNPAQ

SEQ ID NO: 6656 - protein, 11 aa, Artificial Sequence
  Synthetic Construct
AQFLENAKIAQ

SEQ ID NO: 6657 - protein, 11 aa, Artificial Sequence
  Synthetic Construct
AQVSTGTLKAQ

SEQ ID NO: 6658 - protein, 11 aa, Artificial Sequence
  Synthetic Construct
AQRDASLSTAQ

SEQ ID NO: 6659 - protein, 11 aa, Artificial Sequence
  Synthetic Construct
AQKGTEIKLAQ

SEQ ID NO: 6660 - protein, 11 aa, Artificial Sequence
  Synthetic Construct
AQIMNQLGDAQ

SEQ ID NO: 6661 - protein, 11 aa, Artificial Sequence
  Synthetic Construct
AQPSNNTQIAQ

SEQ ID NO: 6662 - protein, 11 aa, Artificial Sequence
  Synthetic Construct
AQTSSSITTAQ

SEQ ID NO: 6663 - protein, 11 aa, Artificial Sequence
  Synthetic Construct
AQRDLNAHNAQ

SEQ ID NO: 6664 - protein, 11 aa, Artificial Sequence
  Synthetic Construct
AQTGFARSEAQ

SEQ ID NO: 6665 - protein, 11 aa, Artificial Sequence
  Synthetic Construct
AQLEQLAPKAQ

SEQ ID NO: 6666 - protein, 11 aa, Artificial Sequence
  Synthetic Construct
AQAAMQSERAQ

SEQ ID NO: 6667 - protein, 11 aa, Artificial Sequence
  Synthetic Construct
AQQLNYEAHAQ

SEQ ID NO: 6668 - protein, 11 aa, Artificial Sequence
  Synthetic Construct
AQANPGSLLAQ

SEQ ID NO: 6669 - protein, 11 aa, Artificial Sequence
  Synthetic Construct
AQLRHIETPAQ

SEQ ID NO: 6670 - protein, 11 aa, Artificial Sequence
  Synthetic Construct
AQLPQNSAKAQ

SEQ ID NO: 6671 - protein, 11 aa, Artificial Sequence
  Synthetic Construct
AQAGSPISRAQ

SEQ ID NO: 6672 - protein, 11 aa, Artificial Sequence
  Synthetic Construct
AQRATNVEVAQ

SEQ ID NO: 6673 - protein, 11 aa, Artificial Sequence
  Synthetic Construct
AQPQPNNRGAQ

SEQ ID NO: 6674 - protein, 11 aa, Artificial Sequence
  Synthetic Construct
AQSPSTPHLAQ

SEQ ID NO: 6675 - protein, 11 aa, Artificial Sequence
  Synthetic Construct
AQLSNTLTNAQ

SEQ ID NO: 6676 - protein, 11 aa, Artificial Sequence
  Synthetic Construct
AQSNREGLMAQ

SEQ ID NO: 6677 - protein, 11 aa, Artificial Sequence
  Synthetic Construct
AQVAHSPPSAQ

SEQ ID NO: 6678 - protein, 11 aa, Artificial Sequence
  Synthetic Construct
AQSVKNMLTAQ

SEQ ID NO: 6679 - protein, 11 aa, Artificial Sequence
  Synthetic Construct
AQGLSTGLAAQ

SEQ ID NO: 6680 - protein, 11 aa, Artificial Sequence
  Synthetic Construct
AQAMSRPELAQ

SEQ ID NO: 6681 - protein, 11 aa, Artificial Sequence
  Synthetic Construct
AQAMDLKLQAQ

SEQ ID NO: 6682 - protein, 11 aa, Artificial Sequence
  Synthetic Construct
AQAVAGPTKAQ

SEQ ID NO: 6683 - protein, 11 aa, Artificial Sequence
  Synthetic Construct
AQPTLGSRTAQ

SEQ ID NO: 6684 - protein, 11 aa, Artificial Sequence
  Synthetic Construct
AQSENPIDPAQ

SEQ ID NO: 6685 - protein, 11 aa, Artificial Sequence
  Synthetic Construct
AQTNNSPGTAQ

SEQ ID NO: 6686 - protein, 11 aa, Artificial Sequence
  Synthetic Construct
AQHTSPTSLAQ

SEQ ID NO: 6687 - protein, 11 aa, Artificial Sequence
  Synthetic Construct
AQNNAGISMAQ

SEQ ID NO: 6688 - protein, 11 aa, Artificial Sequence
  Synthetic Construct
AQLVYSNNTAQ

SEQ ID NO: 6689 - protein, 11 aa, Artificial Sequence
  Synthetic Construct
AQPASQSTTAQ

SEQ ID NO: 6690 - protein, 11 aa, Artificial Sequence
  Synthetic Construct
AQVQVGHPLAQ

SEQ ID NO: 6691 - protein, 11 aa, Artificial Sequence
  Synthetic Construct
AQDASYTGTAQ

SEQ ID NO: 6692 - protein, 11 aa, Artificial Sequence
  Synthetic Construct
AQGITTEARAQ

SEQ ID NO: 6693 - protein, 11 aa, Artificial Sequence
  Synthetic Construct
AQSMPQHAIAQ

SEQ ID NO: 6694 - protein, 11 aa, Artificial Sequence
  Synthetic Construct
AQLQSALQNAQ

SEQ ID NO: 6695 - protein, 11 aa, Artificial Sequence
  Synthetic Construct
AQKSSDSTSAQ

SEQ ID NO: 6696 - protein, 11 aa, Artificial Sequence
  Synthetic Construct
AQKSPAGALAQ

SEQ ID NO: 6697 - protein, 11 aa, Artificial Sequence
  Synthetic Construct
AQTEMSLTSAQ

SEQ ID NO: 6698 - protein, 11 aa, Artificial Sequence
  Synthetic Construct
AQLNSETFPAQ

SEQ ID NO: 6699 - protein, 11 aa, Artificial Sequence
  Synthetic Construct
AQSALSQQYAQ

SEQ ID NO: 6700 - protein, 11 aa, Artificial Sequence
  Synthetic Construct
AQRSVANVPAQ

SEQ ID NO: 6701 - protein, 11 aa, Artificial Sequence
  Synthetic Construct
AQSSGATLQAQ

SEQ ID NO: 6702 - protein, 11 aa, Artificial Sequence
  Synthetic Construct
AQLNGGAASAQ

SEQ ID NO: 6703 - protein, 11 aa, Artificial Sequence
  Synthetic Construct
AQSHQTTPTAQ

SEQ ID NO: 6704 - protein, 11 aa, Artificial Sequence
  Synthetic Construct
AQYENSSSLAQ

SEQ ID NO: 6705 - protein, 11 aa, Artificial Sequence
  Synthetic Construct
AQIQTSAHTAQ

SEQ ID NO: 6706 - protein, 11 aa, Artificial Sequence
  Synthetic Construct
AQREIQKMSAQ

SEQ ID NO: 6707 - protein, 11 aa, Artificial Sequence
  Synthetic Construct
AQSAGMISHAQ

SEQ ID NO: 6708 - protein, 11 aa, Artificial Sequence
  Synthetic Construct
AQMRSTDSEAQ

SEQ ID NO: 6709 - protein, 11 aa, Artificial Sequence
  Synthetic Construct
AQSHPQGDSAQ

SEQ ID NO: 6710 - protein, 11 aa, Artificial Sequence
  Synthetic Construct
AQLIDTKISAQ

SEQ ID NO: 6711 - protein, 11 aa, Artificial Sequence
  Synthetic Construct
AQTHLKDLLAQ

SEQ ID NO: 6712 - protein, 11 aa, Artificial Sequence
  Synthetic Construct
AQGTSSVLIAQ

SEQ ID NO: 6713 - protein, 11 aa, Artificial Sequence
  Synthetic Construct
AQPLVTNEPAQ

SEQ ID NO: 6714 - protein, 11 aa, Artificial Sequence
  Synthetic Construct
AQRDLSHNSAQ

SEQ ID NO: 6715 - protein, 11 aa, Artificial Sequence
  Synthetic Construct
AQYDNEHRPAQ

SEQ ID NO: 6716 - protein, 11 aa, Artificial Sequence
  Synthetic Construct
AQVGSHTMTAQ

SEQ ID NO: 6717 - protein, 11 aa, Artificial Sequence
  Synthetic Construct
AQGHTSVSLAQ

SEQ ID NO: 6718 - protein, 11 aa, Artificial Sequence
  Synthetic Construct
AQLDLKNQRAQ

SEQ ID NO: 6719 - protein, 11 aa, Artificial Sequence
  Synthetic Construct
AQPVAKITSAQ

SEQ ID NO: 6720 - protein, 11 aa, Artificial Sequence
  Synthetic Construct
AQLENGKPKAQ

SEQ ID NO: 6721 - protein, 11 aa, Artificial Sequence
  Synthetic Construct
AQDLARATLAQ

SEQ ID NO: 6722 - protein, 11 aa, Artificial Sequence
  Synthetic Construct
AQKVRDDKPAQ

SEQ ID NO: 6723 - protein, 11 aa, Artificial Sequence
  Synthetic Construct
AQHNVAITPAQ

SEQ ID NO: 6724 - protein, 11 aa, Artificial Sequence
  Synthetic Construct
AQTFNATYAAQ

SEQ ID NO: 6725 - protein, 11 aa, Artificial Sequence
  Synthetic Construct
AQGSQGTIRAQ

SEQ ID NO: 6726 - protein, 11 aa, Artificial Sequence
  Synthetic Construct
AQSLGHDARAQ

SEQ ID NO: 6727 - protein, 11 aa, Artificial Sequence
  Synthetic Construct
AQRSGPDSSAQ

SEQ ID NO: 6728 - protein, 11 aa, Artificial Sequence
  Synthetic Construct
AQAMNLQNLAQ

SEQ ID NO: 6729 - protein, 11 aa, Artificial Sequence
  Synthetic Construct
AQLRAGPGVAQ

SEQ ID NO: 6730 - protein, 11 aa, Artificial Sequence
  Synthetic Construct
AQTVMSSSSAQ

SEQ ID NO: 6731 - protein, 11 aa, Artificial Sequence
  Synthetic Construct
AQHTSPVGYAQ

SEQ ID NO: 6732 - protein, 11 aa, Artificial Sequence
  Synthetic Construct
AQWTSQATAAQ

SEQ ID NO: 6733 - protein, 11 aa, Artificial Sequence
  Synthetic Construct
AQTMNSVPRAQ

SEQ ID NO: 6734 - protein, 11 aa, Artificial Sequence
  Synthetic Construct
AQVNGGMVNAQ

SEQ ID NO: 6735 - protein, 11 aa, Artificial Sequence
  Synthetic Construct
AQTNARMNTAQ

SEQ ID NO: 6736 - protein, 11 aa, Artificial Sequence
  Synthetic Construct
AQISGNMHSAQ

SEQ ID NO: 6737 - protein, 11 aa, Artificial Sequence
  Synthetic Construct
AQSVGGASFAQ

SEQ ID NO: 6738 - protein, 11 aa, Artificial Sequence
  Synthetic Construct
AQTSESPYKAQ

SEQ ID NO: 6739 - protein, 11 aa, Artificial Sequence
  Synthetic Construct
AQGHFGTMSAQ

SEQ ID NO: 6740 - protein, 11 aa, Artificial Sequence
  Synthetic Construct
AQLTTSGLKAQ

SEQ ID NO: 6741 - protein, 11 aa, Artificial Sequence
  Synthetic Construct
AQRINSSTYAQ

SEQ ID NO: 6742 - protein, 11 aa, Artificial Sequence
  Synthetic Construct
AQLTGSSLTAQ

SEQ ID NO: 6743 - protein, 11 aa, Artificial Sequence
  Synthetic Construct
AQPIRGTIYAQ

SEQ ID NO: 6744 - protein, 11 aa, Artificial Sequence
  Synthetic Construct
AQTTSNNTHAQ

SEQ ID NO: 6745 - protein, 11 aa, Artificial Sequence
  Synthetic Construct
AQQVTTNLDAQ

SEQ ID NO: 6746 - protein, 11 aa, Artificial Sequence
  Synthetic Construct
AQALDSSEPAQ

SEQ ID NO: 6747 - protein, 11 aa, Artificial Sequence
  Synthetic Construct
AQYPKNVAWAQ

SEQ ID NO: 6748 - protein, 11 aa, Artificial Sequence
  Synthetic Construct
AQSTTGRNLAQ

SEQ ID NO: 6749 - protein, 11 aa, Artificial Sequence
  Synthetic Construct
AQTKLMQSNAQ

SEQ ID NO: 6750 - protein, 11 aa, Artificial Sequence
  Synthetic Construct
AQNSYGDAAAQ

SEQ ID NO: 6751 - protein, 11 aa, Artificial Sequence
  Synthetic Construct
AQEHTGAPAAQ

SEQ ID NO: 6752 - protein, 11 aa, Artificial Sequence
  Synthetic Construct
AQLRTETANAQ

SEQ ID NO: 6753 - protein, 11 aa, Artificial Sequence
  Synthetic Construct
AQVLDVNTLAQ

SEQ ID NO: 6754 - protein, 11 aa, Artificial Sequence
  Synthetic Construct
AQDRGNDKLAQ

SEQ ID NO: 6755 - protein, 11 aa, Artificial Sequence
  Synthetic Construct
AQSFTNSTHAQ

SEQ ID NO: 6756 - protein, 11 aa, Artificial Sequence
  Synthetic Construct
AQLAHSSLSAQ

SEQ ID NO: 6757 - protein, 11 aa, Artificial Sequence
  Synthetic Construct
AQRLVDPIPAQ

SEQ ID NO: 6758 - protein, 11 aa, Artificial Sequence
  Synthetic Construct
AQWGDKETFAQ

SEQ ID NO: 6759 - protein, 11 aa, Artificial Sequence
  Synthetic Construct
AQRDDNLSTAQ

SEQ ID NO: 6760 - protein, 11 aa, Artificial Sequence
  Synthetic Construct
AQSKQLIDTAQ

SEQ ID NO: 6761 - protein, 11 aa, Artificial Sequence
  Synthetic Construct
AQFQNQTVGAQ

SEQ ID NO: 6762 - protein, 11 aa, Artificial Sequence
  Synthetic Construct
AQVFSSDSLAQ

SEQ ID NO: 6763 - protein, 11 aa, Artificial Sequence
  Synthetic Construct
AQYAQQLPVAQ

SEQ ID NO: 6764 - protein, 11 aa, Artificial Sequence
  Synthetic Construct
AQIVTGTTQAQ

SEQ ID NO: 6765 - protein, 11 aa, Artificial Sequence
  Synthetic Construct
AQSKITESNAQ

SEQ ID NO: 6766 - protein, 11 aa, Artificial Sequence
  Synthetic Construct
AQIAGQVGAAQ

SEQ ID NO: 6767 - protein, 11 aa, Artificial Sequence
  Synthetic Construct
AQGYSQTPHAQ

SEQ ID NO: 6768 - protein, 11 aa, Artificial Sequence
  Synthetic Construct
AQGLALRPDAQ

SEQ ID NO: 6769 - protein, 11 aa, Artificial Sequence
  Synthetic Construct
AQNAVSNNTAQ

SEQ ID NO: 6770 - protein, 11 aa, Artificial Sequence
  Synthetic Construct
AQNQSTLPTAQ

SEQ ID NO: 6771 - protein, 11 aa, Artificial Sequence
  Synthetic Construct
AQTSIPDKPAQ

SEQ ID NO: 6772 - protein, 11 aa, Artificial Sequence
  Synthetic Construct
AQGSSTASLAQ

SEQ ID NO: 6773 - protein, 11 aa, Artificial Sequence
  Synthetic Construct
AQRIIGTATAQ

SEQ ID NO: 6774 - protein, 11 aa, Artificial Sequence
  Synthetic Construct
AQSLNGGRTAQ

SEQ ID NO: 6775 - protein, 11 aa, Artificial Sequence
  Synthetic Construct
AQPVKTVGIAQ

SEQ ID NO: 6776 - protein, 11 aa, Artificial Sequence
  Synthetic Construct
AQQPSAIPNAQ

SEQ ID NO: 6777 - protein, 11 aa, Artificial Sequence
  Synthetic Construct
AQFASSVSAAQ

SEQ ID NO: 6778 - protein, 11 aa, Artificial Sequence
  Synthetic Construct
AQEGNLTKLAQ

SEQ ID NO: 6779 - protein, 11 aa, Artificial Sequence
  Synthetic Construct
AQLGTRTTSAQ

SEQ ID NO: 6780 - protein, 11 aa, Artificial Sequence
  Synthetic Construct
AQTHRDFSPAQ

SEQ ID NO: 6781 - protein, 11 aa, Artificial Sequence
  Synthetic Construct
AQTGVSTGVAQ

SEQ ID NO: 6782 - protein, 11 aa, Artificial Sequence
  Synthetic Construct
AQVPNNSQRAQ

SEQ ID NO: 6783 - protein, 11 aa, Artificial Sequence
  Synthetic Construct
AQMPSGVPVAQ

SEQ ID NO: 6784 - protein, 11 aa, Artificial Sequence
  Synthetic Construct
AQNALPRPNAQ

SEQ ID NO: 6785 - protein, 11 aa, Artificial Sequence
  Synthetic Construct
AQRTDHSQIAQ

SEQ ID NO: 6786 - protein, 11 aa, Artificial Sequence
  Synthetic Construct
AQQTLKSAYAQ

SEQ ID NO: 6787 - protein, 11 aa, Artificial Sequence
  Synthetic Construct
AQKEEHTRGAQ

SEQ ID NO: 6788 - protein, 11 aa, Artificial Sequence
  Synthetic Construct
AQLPAAPRYAQ

SEQ ID NO: 6789 - protein, 11 aa, Artificial Sequence
  Synthetic Construct
AQLDKAHFAAQ

SEQ ID NO: 6790 - protein, 11 aa, Artificial Sequence
  Synthetic Construct
AQHAIDAVKAQ

SEQ ID NO: 6791 - protein, 11 aa, Artificial Sequence
  Synthetic Construct
AQPILTAVPAQ

SEQ ID NO: 6792 - protein, 11 aa, Artificial Sequence
  Synthetic Construct
AQTVQQSAMAQ

SEQ ID NO: 6793 - protein, 11 aa, Artificial Sequence
  Synthetic Construct
AQSEGIGGRAQ

SEQ ID NO: 6794 - protein, 11 aa, Artificial Sequence
  Synthetic Construct
AQMGSTVTRAQ

SEQ ID NO: 6795 - protein, 11 aa, Artificial Sequence
  Synthetic Construct
AQSVRSPTKAQ

SEQ ID NO: 6796 - protein, 11 aa, Artificial Sequence
  Synthetic Construct
AQTTRDVTTAQ

SEQ ID NO: 6797 - protein, 11 aa, Artificial Sequence
  Synthetic Construct
AQSAAGKTYAQ

SEQ ID NO: 6798 - protein, 11 aa, Artificial Sequence
  Synthetic Construct
AQTTPSTVRAQ

SEQ ID NO: 6799 - protein, 11 aa, Artificial Sequence
  Synthetic Construct
AQVALTTTVAQ

SEQ ID NO: 6800 - protein, 11 aa, Artificial Sequence
  Synthetic Construct
AQDTQLPLSAQ

SEQ ID NO: 6801 - protein, 11 aa, Artificial Sequence
  Synthetic Construct
AQNAVSNPLAQ

SEQ ID NO: 6802 - protein, 11 aa, Artificial Sequence
  Synthetic Construct
AQMELKYQRAQ

SEQ ID NO: 6803 - protein, 11 aa, Artificial Sequence
  Synthetic Construct
AQNSLHGHAAQ

SEQ ID NO: 6804 - protein, 11 aa, Artificial Sequence
  Synthetic Construct
AQHSPSLSDAQ

SEQ ID NO: 6805 - protein, 11 aa, Artificial Sequence
  Synthetic Construct
AQGSVTSLGAQ

SEQ ID NO: 6806 - protein, 11 aa, Artificial Sequence
  Synthetic Construct
AQREVSSTTAQ

SEQ ID NO: 6807 - protein, 11 aa, Artificial Sequence
  Synthetic Construct
AQGKATLDTAQ

SEQ ID NO: 6808 - protein, 11 aa, Artificial Sequence
  Synthetic Construct
AQLNPPLNNAQ

SEQ ID NO: 6809 - protein, 11 aa, Artificial Sequence
  Synthetic Construct
AQTSGHSPSAQ

SEQ ID NO: 6810 - protein, 11 aa, Artificial Sequence
  Synthetic Construct
AQDVTATAPAQ

SEQ ID NO: 6811 - protein, 11 aa, Artificial Sequence
  Synthetic Construct
AQHQNTGSVAQ

SEQ ID NO: 6812 - protein, 11 aa, Artificial Sequence
  Synthetic Construct
AQDLTHTFDAQ

SEQ ID NO: 6813 - protein, 11 aa, Artificial Sequence
  Synthetic Construct
AQYLPNKERAQ

SEQ ID NO: 6814 - protein, 11 aa, Artificial Sequence
  Synthetic Construct
AQVDGTYTVAQ

SEQ ID NO: 6815 - protein, 11 aa, Artificial Sequence
  Synthetic Construct
AQYLTSGGYAQ

SEQ ID NO: 6816 - protein, 11 aa, Artificial Sequence
  Synthetic Construct
AQASLVVVAAQ

SEQ ID NO: 6817 - protein, 11 aa, Artificial Sequence
  Synthetic Construct
AQFDANSKIAQ

SEQ ID NO: 6818 - protein, 11 aa, Artificial Sequence
  Synthetic Construct
AQYLTESPGAQ

SEQ ID NO: 6819 - protein, 11 aa, Artificial Sequence
  Synthetic Construct
AQRNASLDPAQ

SEQ ID NO: 6820 - protein, 11 aa, Artificial Sequence
  Synthetic Construct
AQAGSPRAGAQ

SEQ ID NO: 6821 - protein, 11 aa, Artificial Sequence
  Synthetic Construct
AQRVEKLTPAQ

SEQ ID NO: 6822 - protein, 11 aa, Artificial Sequence
  Synthetic Construct
AQRTTGDNTAQ

SEQ ID NO: 6823 - protein, 11 aa, Artificial Sequence
  Synthetic Construct
AQPAATSGFAQ

SEQ ID NO: 6824 - protein, 11 aa, Artificial Sequence
  Synthetic Construct
AQILTIHTHAQ

SEQ ID NO: 6825 - protein, 11 aa, Artificial Sequence
  Synthetic Construct
AQINISSHVAQ

SEQ ID NO: 6826 - protein, 11 aa, Artificial Sequence
  Synthetic Construct
AQPSGSARSAQ

SEQ ID NO: 6827 - protein, 11 aa, Artificial Sequence
  Synthetic Construct
AQSTMPTRLAQ

SEQ ID NO: 6828 - protein, 11 aa, Artificial Sequence
  Synthetic Construct
AQLYASAGVAQ

SEQ ID NO: 6829 - protein, 11 aa, Artificial Sequence
  Synthetic Construct
AQLVQTGLLAQ

SEQ ID NO: 6830 - protein, 11 aa, Artificial Sequence
  Synthetic Construct
AQVSLNRTEAQ

SEQ ID NO: 6831 - protein, 11 aa, Artificial Sequence
  Synthetic Construct
AQGGRESSLAQ

SEQ ID NO: 6832 - protein, 11 aa, Artificial Sequence
  Synthetic Construct
AQVERMPRMAQ

SEQ ID NO: 6833 - protein, 11 aa, Artificial Sequence
  Synthetic Construct
AQPQIGIPDAQ

SEQ ID NO: 6834 - protein, 11 aa, Artificial Sequence
  Synthetic Construct
AQATVKSSTAQ

SEQ ID NO: 6835 - protein, 11 aa, Artificial Sequence
  Synthetic Construct
AQGGNVQAIAQ

SEQ ID NO: 6836 - protein, 11 aa, Artificial Sequence
  Synthetic Construct
AQTIVNVTSAQ

SEQ ID NO: 6837 - protein, 11 aa, Artificial Sequence
  Synthetic Construct
AQGDPAQSSAQ

SEQ ID NO: 6838 - protein, 11 aa, Artificial Sequence
  Synthetic Construct
AQTKNTDFQAQ

SEQ ID NO: 6839 - protein, 11 aa, Artificial Sequence
  Synthetic Construct
AQRHTDAVIAQ

SEQ ID NO: 6840 - protein, 11 aa, Artificial Sequence
  Synthetic Construct
AQSVHTAVRAQ

SEQ ID NO: 6841 - protein, 11 aa, Artificial Sequence
  Synthetic Construct
AQITSLMSGAQ

SEQ ID NO: 6842 - protein, 11 aa, Artificial Sequence
  Synthetic Construct
AQDHNQISLAQ

SEQ ID NO: 6843 - protein, 11 aa, Artificial Sequence
  Synthetic Construct
AQQGQSALKAQ

SEQ ID NO: 6844 - protein, 11 aa, Artificial Sequence
  Synthetic Construct
AQNNATRYTAQ

SEQ ID NO: 6845 - protein, 11 aa, Artificial Sequence
  Synthetic Construct
AQSRNTTSWAQ

SEQ ID NO: 6846 - protein, 11 aa, Artificial Sequence
  Synthetic Construct
AQPSNSKLIAQ

SEQ ID NO: 6847 - protein, 11 aa, Artificial Sequence
  Synthetic Construct
AQKTVSLNDAQ

SEQ ID NO: 6848 - protein, 11 aa, Artificial Sequence
  Synthetic Construct
AQTPLPRVSAQ

SEQ ID NO: 6849 - protein, 11 aa, Artificial Sequence
  Synthetic Construct
AQQTIASALAQ

SEQ ID NO: 6850 - protein, 11 aa, Artificial Sequence
  Synthetic Construct
AQPIMKTTVAQ

SEQ ID NO: 6851 - protein, 11 aa, Artificial Sequence
  Synthetic Construct
AQSAVIQGHAQ

SEQ ID NO: 6852 - protein, 11 aa, Artificial Sequence
  Synthetic Construct
AQPLYGTMSAQ

SEQ ID NO: 6853 - protein, 11 aa, Artificial Sequence
  Synthetic Construct
AQANRTKDYAQ

SEQ ID NO: 6854 - protein, 11 aa, Artificial Sequence
  Synthetic Construct
AQVIPQTERAQ

SEQ ID NO: 6855 - protein, 11 aa, Artificial Sequence
  Synthetic Construct
AQIVNGHIRAQ

SEQ ID NO: 6856 - protein, 11 aa, Artificial Sequence
  Synthetic Construct
AQSRPNETTAQ

SEQ ID NO: 6857 - protein, 11 aa, Artificial Sequence
  Synthetic Construct
AQGYTPVSRAQ

SEQ ID NO: 6858 - protein, 11 aa, Artificial Sequence
  Synthetic Construct
AQPLQRTIGAQ

SEQ ID NO: 6859 - protein, 11 aa, Artificial Sequence
  Synthetic Construct
AQSTGSPTIAQ

SEQ ID NO: 6860 - protein, 11 aa, Artificial Sequence
  Synthetic Construct
AQSTMTGLIAQ

SEQ ID NO: 6861 - protein, 11 aa, Artificial Sequence
  Synthetic Construct
AQIHAVGAEAQ

SEQ ID NO: 6862 - protein, 11 aa, Artificial Sequence
  Synthetic Construct
AQTANVSELAQ

SEQ ID NO: 6863 - protein, 11 aa, Artificial Sequence
  Synthetic Construct
AQNKSDMPHAQ

SEQ ID NO: 6864 - protein, 11 aa, Artificial Sequence
  Synthetic Construct
AQSNYNTHDAQ

SEQ ID NO: 6865 - protein, 11 aa, Artificial Sequence
  Synthetic Construct
AQPSVTHHPAQ

SEQ ID NO: 6866 - protein, 11 aa, Artificial Sequence
  Synthetic Construct
AQNLSLKPLAQ

SEQ ID NO: 6867 - protein, 11 aa, Artificial Sequence
  Synthetic Construct
AQLYSNKSNAQ

SEQ ID NO: 6868 - protein, 11 aa, Artificial Sequence
  Synthetic Construct
AQDNGLVHRAQ

SEQ ID NO: 6869 - protein, 11 aa, Artificial Sequence
  Synthetic Construct
AQMGTLTISAQ

SEQ ID NO: 6870 - protein, 11 aa, Artificial Sequence
  Synthetic Construct
AQTFQSDERAQ

SEQ ID NO: 6871 - protein, 11 aa, Artificial Sequence
  Synthetic Construct
AQIVTGAYRAQ

SEQ ID NO: 6872 - protein, 11 aa, Artificial Sequence
  Synthetic Construct
AQTVVNPSSAQ

SEQ ID NO: 6873 - protein, 11 aa, Artificial Sequence
  Synthetic Construct
AQDNNVRHTAQ

SEQ ID NO: 6874 - protein, 11 aa, Artificial Sequence
  Synthetic Construct
AQDRSQNSLAQ

SEQ ID NO: 6875 - protein, 11 aa, Artificial Sequence
  Synthetic Construct
AQHPPVPASAQ

SEQ ID NO: 6876 - protein, 11 aa, Artificial Sequence
  Synthetic Construct
AQKYITPSSAQ

SEQ ID NO: 6877 - protein, 11 aa, Artificial Sequence
  Synthetic Construct
AQVPDKQAMAQ

SEQ ID NO: 6878 - protein, 11 aa, Artificial Sequence
  Synthetic Construct
AQVIAKTEYAQ

SEQ ID NO: 6879 - protein, 11 aa, Artificial Sequence
  Synthetic Construct
AQGGQAEARAQ

SEQ ID NO: 6880 - protein, 11 aa, Artificial Sequence
  Synthetic Construct
AQQPVLNQPAQ

SEQ ID NO: 6881 - protein, 11 aa, Artificial Sequence
  Synthetic Construct
AQNNTNENLAQ

SEQ ID NO: 6882 - protein, 11 aa, Artificial Sequence
  Synthetic Construct
AQTNLSLSSAQ

SEQ ID NO: 6883 - protein, 11 aa, Artificial Sequence
  Synthetic Construct
AQGQSSDERAQ

SEQ ID NO: 6884 - protein, 11 aa, Artificial Sequence
  Synthetic Construct
AQTHATTFAAQ

SEQ ID NO: 6885 - protein, 11 aa, Artificial Sequence
  Synthetic Construct
AQTSQQDRSAQ

SEQ ID NO: 6886 - protein, 11 aa, Artificial Sequence
  Synthetic Construct
AQALLHREAAQ

SEQ ID NO: 6887 - protein, 11 aa, Artificial Sequence
  Synthetic Construct
AQNPSVTALAQ

SEQ ID NO: 6888 - protein, 11 aa, Artificial Sequence
  Synthetic Construct
AQVANLNSRAQ

SEQ ID NO: 6889 - protein, 11 aa, Artificial Sequence
  Synthetic Construct
AQTMLLEPKAQ

SEQ ID NO: 6890 - protein, 11 aa, Artificial Sequence
  Synthetic Construct
AQNVRPSTYAQ

SEQ ID NO: 6891 - protein, 11 aa, Artificial Sequence
  Synthetic Construct
AQVIHITNTAQ

SEQ ID NO: 6892 - protein, 11 aa, Artificial Sequence
  Synthetic Construct
AQSNPSLLTAQ

SEQ ID NO: 6893 - protein, 11 aa, Artificial Sequence
  Synthetic Construct
AQYQDNARLAQ

SEQ ID NO: 6894 - protein, 11 aa, Artificial Sequence
  Synthetic Construct
AQIQGLTSHAQ

SEQ ID NO: 6895 - protein, 11 aa, Artificial Sequence
  Synthetic Construct
AQTYNQGKQAQ

SEQ ID NO: 6896 - protein, 11 aa, Artificial Sequence
  Synthetic Construct
AQAPTGMKHAQ

SEQ ID NO: 6897 - protein, 11 aa, Artificial Sequence
  Synthetic Construct
AQMSGELIRAQ

SEQ ID NO: 6898 - protein, 11 aa, Artificial Sequence
  Synthetic Construct
AQRLNTSHLAQ

SEQ ID NO: 6899 - protein, 11 aa, Artificial Sequence
  Synthetic Construct
AQATALAAGAQ

SEQ ID NO: 6900 - protein, 11 aa, Artificial Sequence
  Synthetic Construct
AQPISGLKSAQ

SEQ ID NO: 6901 - protein, 11 aa, Artificial Sequence
  Synthetic Construct
AQERTFNPAAQ

SEQ ID NO: 6902 - protein, 11 aa, Artificial Sequence
  Synthetic Construct
AQMSNISSVAQ

SEQ ID NO: 6903 - protein, 11 aa, Artificial Sequence
  Synthetic Construct
AQRDARLSPAQ

SEQ ID NO: 6904 - protein, 11 aa, Artificial Sequence
  Synthetic Construct
AQDHYVNTRAQ

SEQ ID NO: 6905 - protein, 11 aa, Artificial Sequence
  Synthetic Construct
AQPGTAVRLAQ

SEQ ID NO: 6906 - protein, 11 aa, Artificial Sequence
  Synthetic Construct
AQDKGTLSEAQ

SEQ ID NO: 6907 - protein, 11 aa, Artificial Sequence
  Synthetic Construct
AQSIPRTDNAQ

SEQ ID NO: 6908 - protein, 11 aa, Artificial Sequence
  Synthetic Construct
AQEPVLHTVAQ

SEQ ID NO: 6909 - protein, 11 aa, Artificial Sequence
  Synthetic Construct
AQDRAILNSAQ

SEQ ID NO: 6910 - protein, 11 aa, Artificial Sequence
  Synthetic Construct
AQEIGSLRQAQ

SEQ ID NO: 6911 - protein, 11 aa, Artificial Sequence
  Synthetic Construct
AQAFVGATPAQ

SEQ ID NO: 6912 - protein, 11 aa, Artificial Sequence
  Synthetic Construct
AQFVQNKDAAQ

SEQ ID NO: 6913 - protein, 11 aa, Artificial Sequence
  Synthetic Construct
AQRDKAGPTAQ

SEQ ID NO: 6914 - protein, 11 aa, Artificial Sequence
  Synthetic Construct
AQLLPTAHNAQ

SEQ ID NO: 6915 - protein, 11 aa, Artificial Sequence
  Synthetic Construct
AQPNGITSTAQ

SEQ ID NO: 6916 - protein, 11 aa, Artificial Sequence
  Synthetic Construct
AQSGVTKGSAQ

SEQ ID NO: 6917 - protein, 11 aa, Artificial Sequence
  Synthetic Construct
AQMNSTISHAQ

SEQ ID NO: 6918 - protein, 11 aa, Artificial Sequence
  Synthetic Construct
AQYKSDVGSAQ

SEQ ID NO: 6919 - protein, 11 aa, Artificial Sequence
  Synthetic Construct
AQPVTRVNLAQ

SEQ ID NO: 6920 - protein, 11 aa, Artificial Sequence
  Synthetic Construct
AQRNVADGLAQ

SEQ ID NO: 6921 - protein, 11 aa, Artificial Sequence
  Synthetic Construct
AQASATSITAQ

SEQ ID NO: 6922 - protein, 11 aa, Artificial Sequence
  Synthetic Construct
AQSGTASNVAQ

SEQ ID NO: 6923 - protein, 11 aa, Artificial Sequence
  Synthetic Construct
AQRQDLGSTAQ

SEQ ID NO: 6924 - protein, 11 aa, Artificial Sequence
  Synthetic Construct
AQDSALISKAQ

SEQ ID NO: 6925 - protein, 11 aa, Artificial Sequence
  Synthetic Construct
AQNNGLNSAAQ

SEQ ID NO: 6926 - protein, 11 aa, Artificial Sequence
  Synthetic Construct
AQAASERRMAQ

SEQ ID NO: 6927 - protein, 11 aa, Artificial Sequence
  Synthetic Construct
AQRHSAVPEAQ

SEQ ID NO: 6928 - protein, 11 aa, Artificial Sequence
  Synthetic Construct
AQYQDTKGQAQ

SEQ ID NO: 6929 - protein, 11 aa, Artificial Sequence
  Synthetic Construct
AQKTGSLPVAQ

SEQ ID NO: 6930 - protein, 11 aa, Artificial Sequence
  Synthetic Construct
AQIARSVSMAQ

SEQ ID NO: 6931 - protein, 11 aa, Artificial Sequence
  Synthetic Construct
AQPSSKLPLAQ

SEQ ID NO: 6932 - protein, 11 aa, Artificial Sequence
  Synthetic Construct
AQINDQRISAQ

SEQ ID NO: 6933 - protein, 11 aa, Artificial Sequence
  Synthetic Construct
AQGISEKTSAQ

SEQ ID NO: 6934 - protein, 11 aa, Artificial Sequence
  Synthetic Construct
AQTSAYTSVAQ

SEQ ID NO: 6935 - protein, 11 aa, Artificial Sequence
  Synthetic Construct
AQGTLHSSAAQ

SEQ ID NO: 6936 - protein, 11 aa, Artificial Sequence
  Synthetic Construct
AQAPRDAASAQ

SEQ ID NO: 6937 - protein, 11 aa, Artificial Sequence
  Synthetic Construct
AQNNTAMSLAQ

SEQ ID NO: 6938 - protein, 11 aa, Artificial Sequence
  Synthetic Construct
AQILRVADAAQ

SEQ ID NO: 6939 - protein, 11 aa, Artificial Sequence
  Synthetic Construct
AQASVAGASAQ

SEQ ID NO: 6940 - protein, 11 aa, Artificial Sequence
  Synthetic Construct
AQSVLNGSKAQ

SEQ ID NO: 6941 - protein, 11 aa, Artificial Sequence
  Synthetic Construct
AQIYQTASAAQ

SEQ ID NO: 6942 - protein, 11 aa, Artificial Sequence
  Synthetic Construct
AQTSERTQFAQ

SEQ ID NO: 6943 - protein, 11 aa, Artificial Sequence
  Synthetic Construct
AQSTVALTSAQ

SEQ ID NO: 6944 - protein, 11 aa, Artificial Sequence
  Synthetic Construct
AQGNTVINAAQ

SEQ ID NO: 6945 - protein, 11 aa, Artificial Sequence
  Synthetic Construct
AQPLGSIVTAQ

SEQ ID NO: 6946 - protein, 11 aa, Artificial Sequence
  Synthetic Construct
AQLRMSDSFAQ

SEQ ID NO: 6947 - protein, 11 aa, Artificial Sequence
  Synthetic Construct
AQTSESGTLAQ

SEQ ID NO: 6948 - protein, 11 aa, Artificial Sequence
  Synthetic Construct
AQEATRPVRAQ

SEQ ID NO: 6949 - protein, 11 aa, Artificial Sequence
  Synthetic Construct
AQNKQFLADAQ

SEQ ID NO: 6950 - protein, 11 aa, Artificial Sequence
  Synthetic Construct
AQLTIRDNVAQ

SEQ ID NO: 6951 - protein, 11 aa, Artificial Sequence
  Synthetic Construct
AQVGSGLAKAQ

SEQ ID NO: 6952 - protein, 11 aa, Artificial Sequence
  Synthetic Construct
AQQNATNLMAQ

SEQ ID NO: 6953 - protein, 11 aa, Artificial Sequence
  Synthetic Construct
AQSMYAGHEAQ

SEQ ID NO: 6954 - protein, 11 aa, Artificial Sequence
  Synthetic Construct
AQMVNSEKAAQ

SEQ ID NO: 6955 - protein, 11 aa, Artificial Sequence
  Synthetic Construct
AQRMSMRSDAQ

SEQ ID NO: 6956 - protein, 11 aa, Artificial Sequence
  Synthetic Construct
AQSSSGLNKAQ

SEQ ID NO: 6957 - protein, 11 aa, Artificial Sequence
  Synthetic Construct
AQQSSVLTPAQ

SEQ ID NO: 6958 - protein, 11 aa, Artificial Sequence
  Synthetic Construct
AQTPNLETSAQ

SEQ ID NO: 6959 - protein, 11 aa, Artificial Sequence
  Synthetic Construct
AQMRGTLSMAQ

SEQ ID NO: 6960 - protein, 11 aa, Artificial Sequence
  Synthetic Construct
AQDHGASLPAQ

SEQ ID NO: 6961 - protein, 11 aa, Artificial Sequence
  Synthetic Construct
AQSHLATPKAQ

SEQ ID NO: 6962 - protein, 11 aa, Artificial Sequence
  Synthetic Construct
AQSDASHRQAQ

SEQ ID NO: 6963 - protein, 11 aa, Artificial Sequence
  Synthetic Construct
AQTGTERLSAQ

SEQ ID NO: 6964 - protein, 11 aa, Artificial Sequence
  Synthetic Construct
AQAVGHVGPAQ

SEQ ID NO: 6965 - protein, 11 aa, Artificial Sequence
  Synthetic Construct
AQQSQQGVKAQ

SEQ ID NO: 6966 - protein, 11 aa, Artificial Sequence
  Synthetic Construct
AQNLTISNRAQ

SEQ ID NO: 6967 - protein, 11 aa, Artificial Sequence
  Synthetic Construct
AQVSSGYETAQ

SEQ ID NO: 6968 - protein, 11 aa, Artificial Sequence
  Synthetic Construct
AQSISPPRTAQ

SEQ ID NO: 6969 - protein, 11 aa, Artificial Sequence
  Synthetic Construct
AQPYNQSPSAQ

SEQ ID NO: 6970 - protein, 11 aa, Artificial Sequence
  Synthetic Construct
AQTMSYNTNAQ

SEQ ID NO: 6971 - protein, 11 aa, Artificial Sequence
  Synthetic Construct
AQGAYNTVSAQ

SEQ ID NO: 6972 - protein, 11 aa, Artificial Sequence
  Synthetic Construct
AQSKVTPPLAQ

SEQ ID NO: 6973 - protein, 11 aa, Artificial Sequence
  Synthetic Construct
AQRFRENDHAQ

SEQ ID NO: 6974 - protein, 11 aa, Artificial Sequence
  Synthetic Construct
AQLDTGQPTAQ

SEQ ID NO: 6975 - protein, 11 aa, Artificial Sequence
  Synthetic Construct
AQLPSTPQNAQ

SEQ ID NO: 6976 - protein, 11 aa, Artificial Sequence
  Synthetic Construct
AQTLSYVTSAQ

SEQ ID NO: 6977 - protein, 11 aa, Artificial Sequence
  Synthetic Construct
AQSTTVLPVAQ

SEQ ID NO: 6978 - protein, 11 aa, Artificial Sequence
  Synthetic Construct
AQMTHTLLSAQ

SEQ ID NO: 6979 - protein, 11 aa, Artificial Sequence
  Synthetic Construct
AQSTYNKTFAQ

SEQ ID NO: 6980 - protein, 11 aa, Artificial Sequence
  Synthetic Construct
AQATSSHTLAQ

SEQ ID NO: 6981 - protein, 11 aa, Artificial Sequence
  Synthetic Construct
AQRLNGTEPAQ

SEQ ID NO: 6982 - protein, 11 aa, Artificial Sequence
  Synthetic Construct
AQQANTPTKAQ

SEQ ID NO: 6983 - protein, 11 aa, Artificial Sequence
  Synthetic Construct
AQSAVINSSAQ

SEQ ID NO: 6984 - protein, 11 aa, Artificial Sequence
  Synthetic Construct
AQNHGNEVKAQ

SEQ ID NO: 6985 - protein, 11 aa, Artificial Sequence
  Synthetic Construct
AQKHLSHDPAQ

SEQ ID NO: 6986 - protein, 11 aa, Artificial Sequence
  Synthetic Construct
AQLGSGRMAAQ

SEQ ID NO: 6987 - protein, 11 aa, Artificial Sequence
  Synthetic Construct
AQSNQITIVAQ

SEQ ID NO: 6988 - protein, 11 aa, Artificial Sequence
  Synthetic Construct
AQGGRGVGMAQ

SEQ ID NO: 6989 - protein, 11 aa, Artificial Sequence
  Synthetic Construct
AQFVTESKSAQ

SEQ ID NO: 6990 - protein, 11 aa, Artificial Sequence
  Synthetic Construct
AQNSVHNDLAQ

SEQ ID NO: 6991 - protein, 11 aa, Artificial Sequence
  Synthetic Construct
AQSPQQSRYAQ

SEQ ID NO: 6992 - protein, 11 aa, Artificial Sequence
  Synthetic Construct
AQTQPNHDSAQ

SEQ ID NO: 6993 - protein, 11 aa, Artificial Sequence
  Synthetic Construct
AQTRLNEVTAQ

SEQ ID NO: 6994 - protein, 11 aa, Artificial Sequence
  Synthetic Construct
AQTAQRTNVAQ

SEQ ID NO: 6995 - protein, 11 aa, Artificial Sequence
  Synthetic Construct
AQPGRSPTTAQ

SEQ ID NO: 6996 - protein, 11 aa, Artificial Sequence
  Synthetic Construct
AQAYSVVRGAQ

SEQ ID NO: 6997 - protein, 11 aa, Artificial Sequence
  Synthetic Construct
AQVGPVLSRAQ

SEQ ID NO: 6998 - protein, 11 aa, Artificial Sequence
  Synthetic Construct
AQTKMGTPNAQ

SEQ ID NO: 6999 - protein, 11 aa, Artificial Sequence
  Synthetic Construct
AQTTPNLNPAQ

SEQ ID NO: 7000 - protein, 11 aa, Artificial Sequence
  Synthetic Construct
AQTSGTDGIAQ

SEQ ID NO: 7001 - protein, 11 aa, Artificial Sequence
  Synthetic Construct
AQPMPNMPSAQ

SEQ ID NO: 7002 - protein, 11 aa, Artificial Sequence
  Synthetic Construct
AQADALSNRAQ

SEQ ID NO: 7003 - protein, 11 aa, Artificial Sequence
  Synthetic Construct
AQLQTSSHTAQ

SEQ ID NO: 7004 - protein, 11 aa, Artificial Sequence
  Synthetic Construct
AQTSMQGVYAQ

SEQ ID NO: 7005 - protein, 11 aa, Artificial Sequence
  Synthetic Construct
AQQTTVLNKAQ

SEQ ID NO: 7006 - protein, 11 aa, Artificial Sequence
  Synthetic Construct
AQIIPVNSTAQ

SEQ ID NO: 7007 - protein, 11 aa, Artificial Sequence
  Synthetic Construct
AQIATVTSSAQ

SEQ ID NO: 7008 - protein, 11 aa, Artificial Sequence
  Synthetic Construct
AQLETPGRMAQ

SEQ ID NO: 7009 - protein, 11 aa, Artificial Sequence
  Synthetic Construct
AQIATSVGSAQ

SEQ ID NO: 7010 - protein, 11 aa, Artificial Sequence
  Synthetic Construct
AQVREHEALAQ

SEQ ID NO: 7011 - protein, 11 aa, Artificial Sequence
  Synthetic Construct
AQPLTNVQGAQ

SEQ ID NO: 7012 - protein, 11 aa, Artificial Sequence
  Synthetic Construct
AQRDMVQTMAQ

SEQ ID NO: 7013 - protein, 11 aa, Artificial Sequence
  Synthetic Construct
AQRLGFATNAQ

SEQ ID NO: 7014 - protein, 11 aa, Artificial Sequence
  Synthetic Construct
AQMSQVTTEAQ

SEQ ID NO: 7015 - protein, 11 aa, Artificial Sequence
  Synthetic Construct
AQSVLPNAIAQ

SEQ ID NO: 7016 - protein, 11 aa, Artificial Sequence
  Synthetic Construct
AQKFSPTLAAQ

SEQ ID NO: 7017 - protein, 11 aa, Artificial Sequence
  Synthetic Construct
AQNIGNMVLAQ

SEQ ID NO: 7018 - protein, 11 aa, Artificial Sequence
  Synthetic Construct
AQSLLTVLSAQ

SEQ ID NO: 7019 - protein, 11 aa, Artificial Sequence
  Synthetic Construct
AQNSNPSMLAQ

SEQ ID NO: 7020 - protein, 11 aa, Artificial Sequence
  Synthetic Construct
AQITAAVRDAQ

SEQ ID NO: 7021 - protein, 11 aa, Artificial Sequence
  Synthetic Construct
AQAYTSNDRAQ

SEQ ID NO: 7022 - protein, 11 aa, Artificial Sequence
  Synthetic Construct
AQNSVGSMKAQ

SEQ ID NO: 7023 - protein, 11 aa, Artificial Sequence
  Synthetic Construct
AQRLDTTWVAQ

SEQ ID NO: 7024 - protein, 11 aa, Artificial Sequence
  Synthetic Construct
AQIAEAGGRAQ

SEQ ID NO: 7025 - protein, 11 aa, Artificial Sequence
  Synthetic Construct
AQSKTNLQLAQ

SEQ ID NO: 7026 - protein, 11 aa, Artificial Sequence
  Synthetic Construct
AQFSKDDAVAQ

SEQ ID NO: 7027 - protein, 11 aa, Artificial Sequence
  Synthetic Construct
AQLTSHSLTAQ

SEQ ID NO: 7028 - protein, 11 aa, Artificial Sequence
  Synthetic Construct
AQHVQLQYPAQ

SEQ ID NO: 7029 - protein, 11 aa, Artificial Sequence
  Synthetic Construct
AQNHNQPSAAQ

SEQ ID NO: 7030 - protein, 11 aa, Artificial Sequence
  Synthetic Construct
AQTEGARSLAQ

SEQ ID NO: 7031 - protein, 11 aa, Artificial Sequence
  Synthetic Construct
AQNQSDSKVAQ

SEQ ID NO: 7032 - protein, 11 aa, Artificial Sequence
  Synthetic Construct
AQVSLPLAPAQ

SEQ ID NO: 7033 - protein, 11 aa, Artificial Sequence
  Synthetic Construct
AQNNTNLSRAQ

SEQ ID NO: 7034 - protein, 11 aa, Artificial Sequence
  Synthetic Construct
AQYSNSNNHAQ

SEQ ID NO: 7035 - protein, 11 aa, Artificial Sequence
  Synthetic Construct
AQGLETRLHAQ

SEQ ID NO: 7036 - protein, 11 aa, Artificial Sequence
  Synthetic Construct
AQLTTTESKAQ

SEQ ID NO: 7037 - protein, 11 aa, Artificial Sequence
  Synthetic Construct
AQMGARMPLAQ

SEQ ID NO: 7038 - protein, 11 aa, Artificial Sequence
  Synthetic Construct
AQSHDHMLIAQ

SEQ ID NO: 7039 - protein, 11 aa, Artificial Sequence
  Synthetic Construct
AQRTEGSDNAQ

SEQ ID NO: 7040 - protein, 11 aa, Artificial Sequence
  Synthetic Construct
AQNFQRDGPAQ

SEQ ID NO: 7041 - protein, 11 aa, Artificial Sequence
  Synthetic Construct
AQLSNINPHAQ

SEQ ID NO: 7042 - protein, 11 aa, Artificial Sequence
  Synthetic Construct
AQSSNHTSRAQ

SEQ ID NO: 7043 - protein, 11 aa, Artificial Sequence
  Synthetic Construct
AQMHVNASPAQ

SEQ ID NO: 7044 - protein, 11 aa, Artificial Sequence
  Synthetic Construct
AQWDSLAAPAQ

SEQ ID NO: 7045 - protein, 11 aa, Artificial Sequence
  Synthetic Construct
AQLDGAHNAAQ

SEQ ID NO: 7046 - protein, 11 aa, Artificial Sequence
  Synthetic Construct
AQSIRSPPPAQ

SEQ ID NO: 7047 - protein, 11 aa, Artificial Sequence
  Synthetic Construct
AQNGTLKGLAQ

SEQ ID NO: 7048 - protein, 11 aa, Artificial Sequence
  Synthetic Construct
AQFYQEQSLAQ

SEQ ID NO: 7049 - protein, 11 aa, Artificial Sequence
  Synthetic Construct
AQYDQKSLAAQ

SEQ ID NO: 7050 - protein, 11 aa, Artificial Sequence
  Synthetic Construct
AQLSTNRTFAQ

SEQ ID NO: 7051 - protein, 11 aa, Artificial Sequence
  Synthetic Construct
AQKQTQDSSAQ

SEQ ID NO: 7052 - protein, 11 aa, Artificial Sequence
  Synthetic Construct
AQYERGPQMAQ

SEQ ID NO: 7053 - protein, 11 aa, Artificial Sequence
  Synthetic Construct
AQTHANSVRAQ

SEQ ID NO: 7054 - protein, 11 aa, Artificial Sequence
  Synthetic Construct
AQSMNTNASAQ

SEQ ID NO: 7055 - protein, 11 aa, Artificial Sequence
  Synthetic Construct
AQLDNEKGRAQ

SEQ ID NO: 7056 - protein, 11 aa, Artificial Sequence
  Synthetic Construct
AQLGQLLQSAQ

SEQ ID NO: 7057 - protein, 11 aa, Artificial Sequence
  Synthetic Construct
AQMRMPVNMAQ

SEQ ID NO: 7058 - protein, 11 aa, Artificial Sequence
  Synthetic Construct
AQGTSNLPSAQ

SEQ ID NO: 7059 - protein, 11 aa, Artificial Sequence
  Synthetic Construct
AQEGEMKSPAQ

SEQ ID NO: 7060 - protein, 11 aa, Artificial Sequence
  Synthetic Construct
AQQLGHDNRAQ

SEQ ID NO: 7061 - protein, 11 aa, Artificial Sequence
  Synthetic Construct
AQLDDSAGRAQ

SEQ ID NO: 7062 - protein, 11 aa, Artificial Sequence
  Synthetic Construct
AQTGAGNGRAQ

SEQ ID NO: 7063 - protein, 11 aa, Artificial Sequence
  Synthetic Construct
AQNTGAAMMAQ

SEQ ID NO: 7064 - protein, 11 aa, Artificial Sequence
  Synthetic Construct
AQMGANTSVAQ

SEQ ID NO: 7065 - protein, 11 aa, Artificial Sequence
  Synthetic Construct
AQPSTHGGSAQ

SEQ ID NO: 7066 - protein, 11 aa, Artificial Sequence
  Synthetic Construct
AQMPQSQPNAQ

SEQ ID NO: 7067 - protein, 11 aa, Artificial Sequence
  Synthetic Construct
AQSTQARLTAQ

SEQ ID NO: 7068 - protein, 11 aa, Artificial Sequence
  Synthetic Construct
AQSEYLLNPAQ

SEQ ID NO: 7069 - protein, 11 aa, Artificial Sequence
  Synthetic Construct
AQTTGPGLNAQ

SEQ ID NO: 7070 - protein, 11 aa, Artificial Sequence
  Synthetic Construct
AQPGSSVSYAQ

SEQ ID NO: 7071 - protein, 11 aa, Artificial Sequence
  Synthetic Construct
AQYFGSAQEAQ

SEQ ID NO: 7072 - protein, 11 aa, Artificial Sequence
  Synthetic Construct
AQAVINNATAQ

SEQ ID NO: 7073 - protein, 11 aa, Artificial Sequence
  Synthetic Construct
AQVAMQDKKAQ

SEQ ID NO: 7074 - protein, 11 aa, Artificial Sequence
  Synthetic Construct
AQADNMNIKAQ

SEQ ID NO: 7075 - protein, 11 aa, Artificial Sequence
  Synthetic Construct
AQGRATTDSAQ

SEQ ID NO: 7076 - protein, 11 aa, Artificial Sequence
  Synthetic Construct
AQMNLHLKGAQ

SEQ ID NO: 7077 - protein, 11 aa, Artificial Sequence
  Synthetic Construct
AQSNQIRDSAQ

SEQ ID NO: 7078 - protein, 11 aa, Artificial Sequence
  Synthetic Construct
AQVNGQSTPAQ

SEQ ID NO: 7079 - protein, 11 aa, Artificial Sequence
  Synthetic Construct
AQILPQLNSAQ

SEQ ID NO: 7080 - protein, 11 aa, Artificial Sequence
  Synthetic Construct
AQVQDSLHFAQ

SEQ ID NO: 7081 - protein, 11 aa, Artificial Sequence
  Synthetic Construct
AQDVSNRNNAQ

SEQ ID NO: 7082 - protein, 11 aa, Artificial Sequence
  Synthetic Construct
AQDASHGSSAQ

SEQ ID NO: 7083 - protein, 11 aa, Artificial Sequence
  Synthetic Construct
AQRASAHPPAQ

SEQ ID NO: 7084 - protein, 11 aa, Artificial Sequence
  Synthetic Construct
AQPSLRALDAQ

SEQ ID NO: 7085 - protein, 11 aa, Artificial Sequence
  Synthetic Construct
AQDKTPPVAAQ

SEQ ID NO: 7086 - protein, 11 aa, Artificial Sequence
  Synthetic Construct
AQLNDVTTRAQ

SEQ ID NO: 7087 - protein, 11 aa, Artificial Sequence
  Synthetic Construct
AQGASNAQAAQ

SEQ ID NO: 7088 - protein, 11 aa, Artificial Sequence
  Synthetic Construct
AQNGSRDALAQ

SEQ ID NO: 7089 - protein, 11 aa, Artificial Sequence
  Synthetic Construct
AQYGVERMSAQ

SEQ ID NO: 7090 - protein, 11 aa, Artificial Sequence
  Synthetic Construct
AQAKVASSFAQ

SEQ ID NO: 7091 - protein, 11 aa, Artificial Sequence
  Synthetic Construct
AQHKQILLDAQ

SEQ ID NO: 7092 - protein, 11 aa, Artificial Sequence
  Synthetic Construct
AQDRANDRIAQ

SEQ ID NO: 7093 - protein, 11 aa, Artificial Sequence
  Synthetic Construct
AQKMSTTMLAQ

SEQ ID NO: 7094 - protein, 11 aa, Artificial Sequence
  Synthetic Construct
AQGGENGVIAQ

SEQ ID NO: 7095 - protein, 11 aa, Artificial Sequence
  Synthetic Construct
AQVTQTLISAQ

SEQ ID NO: 7096 - protein, 11 aa, Artificial Sequence
  Synthetic Construct
AQLYTKALIAQ

SEQ ID NO: 7097 - protein, 11 aa, Artificial Sequence
  Synthetic Construct
AQTLPGHNRAQ

SEQ ID NO: 7098 - protein, 11 aa, Artificial Sequence
  Synthetic Construct
AQSKSGLVGAQ

SEQ ID NO: 7099 - protein, 11 aa, Artificial Sequence
  Synthetic Construct
AQLTLKDTSAQ

SEQ ID NO: 7100 - protein, 11 aa, Artificial Sequence
  Synthetic Construct
AQWNGTGVSAQ

SEQ ID NO: 7101 - protein, 11 aa, Artificial Sequence
  Synthetic Construct
AQLVQNNTMAQ

SEQ ID NO: 7102 - protein, 11 aa, Artificial Sequence
  Synthetic Construct
AQLADRGSAAQ

SEQ ID NO: 7103 - protein, 11 aa, Artificial Sequence
  Synthetic Construct
AQLASTGANAQ

SEQ ID NO: 7104 - protein, 11 aa, Artificial Sequence
  Synthetic Construct
AQLGRNDTLAQ

SEQ ID NO: 7105 - protein, 11 aa, Artificial Sequence
  Synthetic Construct
AQRSTNGEAAQ

SEQ ID NO: 7106 - protein, 11 aa, Artificial Sequence
  Synthetic Construct
AQGATYQRTAQ

SEQ ID NO: 7107 - protein, 11 aa, Artificial Sequence
  Synthetic Construct
AQGKSQLLMAQ

SEQ ID NO: 7108 - protein, 11 aa, Artificial Sequence
  Synthetic Construct
AQNTATFSSAQ

SEQ ID NO: 7109 - protein, 11 aa, Artificial Sequence
  Synthetic Construct
AQYSTTISPAQ

SEQ ID NO: 7110 - protein, 11 aa, Artificial Sequence
  Synthetic Construct
AQPRHSVQDAQ

SEQ ID NO: 7111 - protein, 11 aa, Artificial Sequence
  Synthetic Construct
AQNNNTKMNAQ

SEQ ID NO: 7112 - protein, 11 aa, Artificial Sequence
  Synthetic Construct
AQLTGHHTKAQ

SEQ ID NO: 7113 - protein, 11 aa, Artificial Sequence
  Synthetic Construct
AQNVSSGQRAQ

SEQ ID NO: 7114 - protein, 11 aa, Artificial Sequence
  Synthetic Construct
AQSLQDARLAQ

SEQ ID NO: 7115 - protein, 11 aa, Artificial Sequence
  Synthetic Construct
AQLNRDGSVAQ

SEQ ID NO: 7116 - protein, 11 aa, Artificial Sequence
  Synthetic Construct
AQNSTENSTAQ

SEQ ID NO: 7117 - protein, 11 aa, Artificial Sequence
  Synthetic Construct
AQSLVAQPVAQ

SEQ ID NO: 7118 - protein, 11 aa, Artificial Sequence
  Synthetic Construct
AQHAATVSHAQ

SEQ ID NO: 7119 - protein, 11 aa, Artificial Sequence
  Synthetic Construct
AQNVSGARLAQ

SEQ ID NO: 7120 - protein, 11 aa, Artificial Sequence
  Synthetic Construct
AQRADKFDYAQ

SEQ ID NO: 7121 - protein, 11 aa, Artificial Sequence
  Synthetic Construct
AQSQPDVTYAQ

SEQ ID NO: 7122 - protein, 11 aa, Artificial Sequence
  Synthetic Construct
AQVLTQQTHAQ

SEQ ID NO: 7123 - protein, 11 aa, Artificial Sequence
  Synthetic Construct
AQTDNSTTRAQ

SEQ ID NO: 7124 - protein, 11 aa, Artificial Sequence
  Synthetic Construct
AQYNTRYDAAQ

SEQ ID NO: 7125 - protein, 11 aa, Artificial Sequence
  Synthetic Construct
AQSANDARVAQ

SEQ ID NO: 7126 - protein, 11 aa, Artificial Sequence
  Synthetic Construct
AQILTPDLRAQ

SEQ ID NO: 7127 - protein, 11 aa, Artificial Sequence
  Synthetic Construct
AQPNVGASSAQ

SEQ ID NO: 7128 - protein, 11 aa, Artificial Sequence
  Synthetic Construct
AQLSASHTIAQ

SEQ ID NO: 7129 - protein, 11 aa, Artificial Sequence
  Synthetic Construct
AQTKVLIEKAQ

SEQ ID NO: 7130 - protein, 11 aa, Artificial Sequence
  Synthetic Construct
AQMNTLIPAAQ

SEQ ID NO: 7131 - protein, 11 aa, Artificial Sequence
  Synthetic Construct
AQSSNVVTTAQ

SEQ ID NO: 7132 - protein, 11 aa, Artificial Sequence
  Synthetic Construct
AQMNVRPTTAQ

SEQ ID NO: 7133 - protein, 11 aa, Artificial Sequence
  Synthetic Construct
AQDTGLNNRAQ

SEQ ID NO: 7134 - protein, 11 aa, Artificial Sequence
  Synthetic Construct
AQTLNRDHMAQ

SEQ ID NO: 7135 - protein, 11 aa, Artificial Sequence
  Synthetic Construct
AQLLLSHHAAQ

SEQ ID NO: 7136 - protein, 11 aa, Artificial Sequence
  Synthetic Construct
AQNPAMATFAQ

SEQ ID NO: 7137 - protein, 11 aa, Artificial Sequence
  Synthetic Construct
AQISQRIYAAQ

SEQ ID NO: 7138 - protein, 11 aa, Artificial Sequence
  Synthetic Construct
AQTTGVAGSAQ

SEQ ID NO: 7139 - protein, 11 aa, Artificial Sequence
  Synthetic Construct
AQFGTFPTPAQ

SEQ ID NO: 7140 - protein, 11 aa, Artificial Sequence
  Synthetic Construct
AQRGSDFDSAQ

SEQ ID NO: 7141 - protein, 11 aa, Artificial Sequence
  Synthetic Construct
AQSKASLDSAQ

SEQ ID NO: 7142 - protein, 11 aa, Artificial Sequence
  Synthetic Construct
AQLLNSHSAAQ

SEQ ID NO: 7143 - protein, 11 aa, Artificial Sequence
  Synthetic Construct
AQASIHKDIAQ

SEQ ID NO: 7144 - protein, 11 aa, Artificial Sequence
  Synthetic Construct
AQSDPGKFMAQ

SEQ ID NO: 7145 - protein, 11 aa, Artificial Sequence
  Synthetic Construct
AQGTSSAQRAQ

SEQ ID NO: 7146 - protein, 11 aa, Artificial Sequence
  Synthetic Construct
AQSTNSKLEAQ

SEQ ID NO: 7147 - protein, 11 aa, Artificial Sequence
  Synthetic Construct
AQNLQTVPNAQ

SEQ ID NO: 7148 - protein, 11 aa, Artificial Sequence
  Synthetic Construct
AQVVTHLNAAQ

SEQ ID NO: 7149 - protein, 11 aa, Artificial Sequence
  Synthetic Construct
AQLSTSNNFAQ

SEQ ID NO: 7150 - protein, 11 aa, Artificial Sequence
  Synthetic Construct
AQNNSGHISAQ

SEQ ID NO: 7151 - protein, 11 aa, Artificial Sequence
  Synthetic Construct
AQAYQVNSDAQ

SEQ ID NO: 7152 - protein, 11 aa, Artificial Sequence
  Synthetic Construct
AQQQNYLNHAQ

SEQ ID NO: 7153 - protein, 11 aa, Artificial Sequence
  Synthetic Construct
AQFATTNTGAQ

SEQ ID NO: 7154 - protein, 11 aa, Artificial Sequence
  Synthetic Construct
AQLANKIANAQ

SEQ ID NO: 7155 - protein, 11 aa, Artificial Sequence
  Synthetic Construct
AQQSFQREVAQ

SEQ ID NO: 7156 - protein, 11 aa, Artificial Sequence
  Synthetic Construct
AQLHISEPRAQ

SEQ ID NO: 7157 - protein, 11 aa, Artificial Sequence
  Synthetic Construct
AQRVGEREQAQ

SEQ ID NO: 7158 - protein, 11 aa, Artificial Sequence
  Synthetic Construct
AQVNIIQASAQ

SEQ ID NO: 7159 - protein, 11 aa, Artificial Sequence
  Synthetic Construct
AQGVGLHNKAQ

SEQ ID NO: 7160 - protein, 11 aa, Artificial Sequence
  Synthetic Construct
AQNNPAIPIAQ

SEQ ID NO: 7161 - protein, 11 aa, Artificial Sequence
  Synthetic Construct
AQRLSSQAVAQ

SEQ ID NO: 7162 - protein, 11 aa, Artificial Sequence
  Synthetic Construct
AQHSNELRPAQ

SEQ ID NO: 7163 - protein, 11 aa, Artificial Sequence
  Synthetic Construct
AQSLGPTTNAQ

SEQ ID NO: 7164 - protein, 11 aa, Artificial Sequence
  Synthetic Construct
AQGNQTNRSAQ

SEQ ID NO: 7165 - protein, 11 aa, Artificial Sequence
  Synthetic Construct
AQSNPVGNPAQ

SEQ ID NO: 7166 - protein, 11 aa, Artificial Sequence
  Synthetic Construct
AQQVPPLVPAQ

SEQ ID NO: 7167 - protein, 11 aa, Artificial Sequence
  Synthetic Construct
AQLSTPPTQAQ

SEQ ID NO: 7168 - protein, 11 aa, Artificial Sequence
  Synthetic Construct
AQVGTEPLSAQ

SEQ ID NO: 7169 - protein, 11 aa, Artificial Sequence
  Synthetic Construct
AQRPDATSHAQ

SEQ ID NO: 7170 - protein, 11 aa, Artificial Sequence
  Synthetic Construct
AQVEKQMLNAQ

SEQ ID NO: 7171 - protein, 11 aa, Artificial Sequence
  Synthetic Construct
AQFKSAQATAQ

SEQ ID NO: 7172 - protein, 11 aa, Artificial Sequence
  Synthetic Construct
AQWALSTDGAQ

SEQ ID NO: 7173 - protein, 11 aa, Artificial Sequence
  Synthetic Construct
AQLAGLATNAQ

SEQ ID NO: 7174 - protein, 11 aa, Artificial Sequence
  Synthetic Construct
AQTLTAGTPAQ

SEQ ID NO: 7175 - protein, 11 aa, Artificial Sequence
  Synthetic Construct
AQIPVTSRMAQ

SEQ ID NO: 7176 - protein, 11 aa, Artificial Sequence
  Synthetic Construct
AQGTDYPRSAQ

SEQ ID NO: 7177 - protein, 11 aa, Artificial Sequence
  Synthetic Construct
AQVTEHSKLAQ

SEQ ID NO: 7178 - protein, 11 aa, Artificial Sequence
  Synthetic Construct
AQNMSMPVKAQ

SEQ ID NO: 7179 - protein, 11 aa, Artificial Sequence
  Synthetic Construct
AQSVGVGMSAQ

SEQ ID NO: 7180 - protein, 11 aa, Artificial Sequence
  Synthetic Construct
AQPRTDNEGAQ

SEQ ID NO: 7181 - protein, 11 aa, Artificial Sequence
  Synthetic Construct
AQFSNPDRTAQ

SEQ ID NO: 7182 - protein, 11 aa, Artificial Sequence
  Synthetic Construct
AQMHLVPTTAQ

SEQ ID NO: 7183 - protein, 11 aa, Artificial Sequence
  Synthetic Construct
AQNAPPVSSAQ

SEQ ID NO: 7184 - protein, 11 aa, Artificial Sequence
  Synthetic Construct
AQSNLPTLAAQ

SEQ ID NO: 7185 - protein, 11 aa, Artificial Sequence
  Synthetic Construct
AQIMQGMTTAQ

SEQ ID NO: 7186 - protein, 11 aa, Artificial Sequence
  Synthetic Construct
AQSRETTSPAQ

SEQ ID NO: 7187 - protein, 11 aa, Artificial Sequence
  Synthetic Construct
AQNPTSFSTAQ

SEQ ID NO: 7188 - protein, 11 aa, Artificial Sequence
  Synthetic Construct
AQNLQHGSTAQ

SEQ ID NO: 7189 - protein, 11 aa, Artificial Sequence
  Synthetic Construct
AQNFHSGHTAQ

SEQ ID NO: 7190 - protein, 11 aa, Artificial Sequence
  Synthetic Construct
AQTESVYARAQ

SEQ ID NO: 7191 - protein, 11 aa, Artificial Sequence
  Synthetic Construct
AQTKSEIPNAQ

SEQ ID NO: 7192 - protein, 11 aa, Artificial Sequence
  Synthetic Construct
AQTSLADMRAQ

SEQ ID NO: 7193 - protein, 11 aa, Artificial Sequence
  Synthetic Construct
AQRLKADITAQ

SEQ ID NO: 7194 - protein, 11 aa, Artificial Sequence
  Synthetic Construct
AQLNMNVLAAQ

SEQ ID NO: 7195 - protein, 11 aa, Artificial Sequence
  Synthetic Construct
AQSLRPISVAQ

SEQ ID NO: 7196 - protein, 11 aa, Artificial Sequence
  Synthetic Construct
AQLSVQLVEAQ

SEQ ID NO: 7197 - protein, 11 aa, Artificial Sequence
  Synthetic Construct
AQSFEGVLPAQ

SEQ ID NO: 7198 - protein, 11 aa, Artificial Sequence
  Synthetic Construct
AQIIVGLQPAQ

SEQ ID NO: 7199 - protein, 11 aa, Artificial Sequence
  Synthetic Construct
AQVSSYERLAQ

SEQ ID NO: 7200 - protein, 11 aa, Artificial Sequence
  Synthetic Construct
AQRTNDAIVAQ

SEQ ID NO: 7201 - protein, 11 aa, Artificial Sequence
  Synthetic Construct
AQFSEHRELAQ

SEQ ID NO: 7202 - protein, 11 aa, Artificial Sequence
  Synthetic Construct
AQKEATANTAQ

SEQ ID NO: 7203 - protein, 11 aa, Artificial Sequence
  Synthetic Construct
AQLRASITVAQ

SEQ ID NO: 7204 - protein, 11 aa, Artificial Sequence
  Synthetic Construct
AQWLGITEAAQ

SEQ ID NO: 7205 - protein, 11 aa, Artificial Sequence
  Synthetic Construct
AQSSQKAAEAQ

SEQ ID NO: 7206 - protein, 11 aa, Artificial Sequence
  Synthetic Construct
AQGSTPGLAAQ

SEQ ID NO: 7207 - protein, 11 aa, Artificial Sequence
  Synthetic Construct
AQKGNANDLAQ

SEQ ID NO: 7208 - protein, 11 aa, Artificial Sequence
  Synthetic Construct
AQTSAPLKLAQ

SEQ ID NO: 7209 - protein, 11 aa, Artificial Sequence
  Synthetic Construct
AQPVQTNGHAQ

SEQ ID NO: 7210 - protein, 11 aa, Artificial Sequence
  Synthetic Construct
AQRPAVDSAAQ

SEQ ID NO: 7211 - protein, 11 aa, Artificial Sequence
  Synthetic Construct
AQTTLSQNRAQ

SEQ ID NO: 7212 - protein, 11 aa, Artificial Sequence
  Synthetic Construct
AQVMTVGSLAQ

SEQ ID NO: 7213 - protein, 11 aa, Artificial Sequence
  Synthetic Construct
AQALNKENWAQ

SEQ ID NO: 7214 - protein, 11 aa, Artificial Sequence
  Synthetic Construct
AQHHHLTGNAQ

SEQ ID NO: 7215 - protein, 11 aa, Artificial Sequence
  Synthetic Construct
AQGMRTVNIAQ

SEQ ID NO: 7216 - protein, 11 aa, Artificial Sequence
  Synthetic Construct
AQTLNSSVAAQ

SEQ ID NO: 7217 - protein, 11 aa, Artificial Sequence
  Synthetic Construct
AQSASTILVAQ

SEQ ID NO: 7218 - protein, 11 aa, Artificial Sequence
  Synthetic Construct
AQEMIRPRAAQ

SEQ ID NO: 7219 - protein, 11 aa, Artificial Sequence
  Synthetic Construct
AQMSAASYKAQ

SEQ ID NO: 7220 - protein, 11 aa, Artificial Sequence
  Synthetic Construct
AQHFTTGSVAQ

SEQ ID NO: 7221 - protein, 11 aa, Artificial Sequence
  Synthetic Construct
AQASHTIGLAQ

SEQ ID NO: 7222 - protein, 11 aa, Artificial Sequence
  Synthetic Construct
AQSREHQLYAQ

SEQ ID NO: 7223 - protein, 11 aa, Artificial Sequence
  Synthetic Construct
AQAGTTAPLAQ

SEQ ID NO: 7224 - protein, 11 aa, Artificial Sequence
  Synthetic Construct
AQGKVSGAMAQ

SEQ ID NO: 7225 - protein, 11 aa, Artificial Sequence
  Synthetic Construct
AQKLSGMSVAQ

SEQ ID NO: 7226 - protein, 11 aa, Artificial Sequence
  Synthetic Construct
AQVLPKDDAAQ

SEQ ID NO: 7227 - protein, 11 aa, Artificial Sequence
  Synthetic Construct
AQLAGILTTAQ

SEQ ID NO: 7228 - protein, 11 aa, Artificial Sequence
  Synthetic Construct
AQVVPGAQTAQ

SEQ ID NO: 7229 - protein, 11 aa, Artificial Sequence
  Synthetic Construct
AQGQHSYAHAQ

SEQ ID NO: 7230 - protein, 11 aa, Artificial Sequence
  Synthetic Construct
AQHHLSTSIAQ

SEQ ID NO: 7231 - protein, 11 aa, Artificial Sequence
  Synthetic Construct
AQTLIPPNPAQ

SEQ ID NO: 7232 - protein, 11 aa, Artificial Sequence
  Synthetic Construct
AQEMHNPRAAQ

SEQ ID NO: 7233 - protein, 11 aa, Artificial Sequence
  Synthetic Construct
AQIENPPRGAQ

SEQ ID NO: 7234 - protein, 11 aa, Artificial Sequence
  Synthetic Construct
AQGQFSDARAQ

SEQ ID NO: 7235 - protein, 11 aa, Artificial Sequence
  Synthetic Construct
AQAEASASRAQ

SEQ ID NO: 7236 - protein, 11 aa, Artificial Sequence
  Synthetic Construct
AQLVKGDARAQ

SEQ ID NO: 7237 - protein, 11 aa, Artificial Sequence
  Synthetic Construct
AQQGHTHGNAQ

SEQ ID NO: 7238 - protein, 11 aa, Artificial Sequence
  Synthetic Construct
AQQKPTSTFAQ

SEQ ID NO: 7239 - protein, 11 aa, Artificial Sequence
  Synthetic Construct
AQKLAALGAAQ

SEQ ID NO: 7240 - protein, 11 aa, Artificial Sequence
  Synthetic Construct
AQSSVDQMKAQ

SEQ ID NO: 7241 - protein, 11 aa, Artificial Sequence
  Synthetic Construct
AQGIVTAPLAQ

SEQ ID NO: 7242 - protein, 11 aa, Artificial Sequence
  Synthetic Construct
AQLLKMPSPAQ

SEQ ID NO: 7243 - protein, 11 aa, Artificial Sequence
  Synthetic Construct
AQNVAHTVRAQ

SEQ ID NO: 7244 - protein, 11 aa, Artificial Sequence
  Synthetic Construct
AQLMSTNVSAQ

SEQ ID NO: 7245 - protein, 11 aa, Artificial Sequence
  Synthetic Construct
AQLSNNNALAQ

SEQ ID NO: 7246 - protein, 11 aa, Artificial Sequence
  Synthetic Construct
AQLLIGPTGAQ

SEQ ID NO: 7247 - protein, 11 aa, Artificial Sequence
  Synthetic Construct
AQVRNTMISAQ

SEQ ID NO: 7248 - protein, 11 aa, Artificial Sequence
  Synthetic Construct
AQGATGHLTAQ

SEQ ID NO: 7249 - protein, 11 aa, Artificial Sequence
  Synthetic Construct
AQMTVGNLGAQ

SEQ ID NO: 7250 - protein, 11 aa, Artificial Sequence
  Synthetic Construct
AQSNGLNGLAQ

SEQ ID NO: 7251 - protein, 11 aa, Artificial Sequence
  Synthetic Construct
AQRNENESRAQ

SEQ ID NO: 7252 - protein, 11 aa, Artificial Sequence
  Synthetic Construct
AQGNARDASAQ

SEQ ID NO: 7253 - protein, 11 aa, Artificial Sequence
  Synthetic Construct
AQISKLLLSAQ

SEQ ID NO: 7254 - protein, 11 aa, Artificial Sequence
  Synthetic Construct
AQNDTTNMSAQ

SEQ ID NO: 7255 - protein, 11 aa, Artificial Sequence
  Synthetic Construct
AQGLEANKSAQ

SEQ ID NO: 7256 - protein, 11 aa, Artificial Sequence
  Synthetic Construct
AQHYSTVGVAQ

SEQ ID NO: 7257 - protein, 11 aa, Artificial Sequence
  Synthetic Construct
AQPTISVLPAQ

SEQ ID NO: 7258 - protein, 11 aa, Artificial Sequence
  Synthetic Construct
AQVQTIGHEAQ

SEQ ID NO: 7259 - protein, 11 aa, Artificial Sequence
  Synthetic Construct
AQKPETASDAQ

SEQ ID NO: 7260 - protein, 11 aa, Artificial Sequence
  Synthetic Construct
AQTNTPTSRAQ

SEQ ID NO: 7261 - protein, 11 aa, Artificial Sequence
  Synthetic Construct
AQSLTLSSHAQ

SEQ ID NO: 7262 - protein, 11 aa, Artificial Sequence
  Synthetic Construct
AQHYHSIQAAQ

SEQ ID NO: 7263 - protein, 11 aa, Artificial Sequence
  Synthetic Construct
AQYHGENERAQ

SEQ ID NO: 7264 - protein, 11 aa, Artificial Sequence
  Synthetic Construct
AQLPHTARVAQ

SEQ ID NO: 7265 - protein, 11 aa, Artificial Sequence
  Synthetic Construct
AQTREGSTGAQ

SEQ ID NO: 7266 - protein, 11 aa, Artificial Sequence
  Synthetic Construct
AQVDRRAMLAQ

SEQ ID NO: 7267 - protein, 11 aa, Artificial Sequence
  Synthetic Construct
AQTSVSAVMAQ

SEQ ID NO: 7268 - protein, 11 aa, Artificial Sequence
  Synthetic Construct
AQSQKLTEKAQ

SEQ ID NO: 7269 - protein, 11 aa, Artificial Sequence
  Synthetic Construct
AQRLPSLSVAQ

SEQ ID NO: 7270 - protein, 11 aa, Artificial Sequence
  Synthetic Construct
AQSVSEGSRAQ

SEQ ID NO: 7271 - protein, 11 aa, Artificial Sequence
  Synthetic Construct
AQSIPSVSAAQ

SEQ ID NO: 7272 - protein, 11 aa, Artificial Sequence
  Synthetic Construct
AQTTNNAKSAQ

SEQ ID NO: 7273 - protein, 11 aa, Artificial Sequence
  Synthetic Construct
AQASGEASTAQ

SEQ ID NO: 7274 - protein, 11 aa, Artificial Sequence
  Synthetic Construct
AQDNNSSIAAQ

SEQ ID NO: 7275 - protein, 11 aa, Artificial Sequence
  Synthetic Construct
AQVHDNSKLAQ

SEQ ID NO: 7276 - protein, 11 aa, Artificial Sequence
  Synthetic Construct
AQSTLAGSEAQ

SEQ ID NO: 7277 - protein, 11 aa, Artificial Sequence
  Synthetic Construct
AQPEKSHSSAQ

SEQ ID NO: 7278 - protein, 11 aa, Artificial Sequence
  Synthetic Construct
AQQMLRASVAQ

SEQ ID NO: 7279 - protein, 11 aa, Artificial Sequence
  Synthetic Construct
AQALSNNITAQ

SEQ ID NO: 7280 - protein, 11 aa, Artificial Sequence
  Synthetic Construct
AQSLANQLPAQ

SEQ ID NO: 7281 - protein, 11 aa, Artificial Sequence
  Synthetic Construct
AQEQSRLQTAQ

SEQ ID NO: 7282 - protein, 11 aa, Artificial Sequence
  Synthetic Construct
AQNLSQNVMAQ

SEQ ID NO: 7283 - protein, 11 aa, Artificial Sequence
  Synthetic Construct
AQSHKLSSSAQ

SEQ ID NO: 7284 - protein, 11 aa, Artificial Sequence
  Synthetic Construct
AQPTNTKTAAQ

SEQ ID NO: 7285 - protein, 11 aa, Artificial Sequence
  Synthetic Construct
AQMNPATVAAQ

SEQ ID NO: 7286 - protein, 11 aa, Artificial Sequence
  Synthetic Construct
AQKIERTNFAQ

SEQ ID NO: 7287 - protein, 11 aa, Artificial Sequence
  Synthetic Construct
AQTSPTYKLAQ

SEQ ID NO: 7288 - protein, 11 aa, Artificial Sequence
  Synthetic Construct
AQRSDHIDYAQ

SEQ ID NO: 7289 - protein, 11 aa, Artificial Sequence
  Synthetic Construct
AQTLGLNTNAQ

SEQ ID NO: 7290 - protein, 11 aa, Artificial Sequence
  Synthetic Construct
AQPLSNHGTAQ

SEQ ID NO: 7291 - protein, 11 aa, Artificial Sequence
  Synthetic Construct
AQAVSRLPMAQ

SEQ ID NO: 7292 - protein, 11 aa, Artificial Sequence
  Synthetic Construct
AQLLTESKMAQ

SEQ ID NO: 7293 - protein, 11 aa, Artificial Sequence
  Synthetic Construct
AQHMRTDTAAQ

SEQ ID NO: 7294 - protein, 11 aa, Artificial Sequence
  Synthetic Construct
AQSLTVNAAAQ

SEQ ID NO: 7295 - protein, 11 aa, Artificial Sequence
  Synthetic Construct
AQNPNGVTVAQ

SEQ ID NO: 7296 - protein, 11 aa, Artificial Sequence
  Synthetic Construct
AQTTKLPTLAQ

SEQ ID NO: 7297 - protein, 11 aa, Artificial Sequence
  Synthetic Construct
AQNSTSKQLAQ

SEQ ID NO: 7298 - protein, 11 aa, Artificial Sequence
  Synthetic Construct
AQTLGSSNTAQ

SEQ ID NO: 7299 - protein, 11 aa, Artificial Sequence
  Synthetic Construct
AQPRATDPQAQ

SEQ ID NO: 7300 - protein, 11 aa, Artificial Sequence
  Synthetic Construct
AQSLLNKTTAQ

SEQ ID NO: 7301 - protein, 11 aa, Artificial Sequence
  Synthetic Construct
AQQKSDGSPAQ

SEQ ID NO: 7302 - protein, 11 aa, Artificial Sequence
  Synthetic Construct
AQTVSGFTKAQ

SEQ ID NO: 7303 - protein, 11 aa, Artificial Sequence
  Synthetic Construct
AQTVLVKSTAQ

SEQ ID NO: 7304 - protein, 11 aa, Artificial Sequence
  Synthetic Construct
AQGAHISNPAQ

SEQ ID NO: 7305 - protein, 11 aa, Artificial Sequence
  Synthetic Construct
AQEPSIPRPAQ

SEQ ID NO: 7306 - protein, 11 aa, Artificial Sequence
  Synthetic Construct
AQGTVQARQAQ

SEQ ID NO: 7307 - protein, 11 aa, Artificial Sequence
  Synthetic Construct
AQNNHNYVDAQ

SEQ ID NO: 7308 - protein, 11 aa, Artificial Sequence
  Synthetic Construct
AQRTASVSLAQ

SEQ ID NO: 7309 - protein, 11 aa, Artificial Sequence
  Synthetic Construct
AQISMDNHRAQ

SEQ ID NO: 7310 - protein, 11 aa, Artificial Sequence
  Synthetic Construct
AQSDGHNHSAQ

SEQ ID NO: 7311 - protein, 11 aa, Artificial Sequence
  Synthetic Construct
AQSAGSGIGAQ

SEQ ID NO: 7312 - protein, 11 aa, Artificial Sequence
  Synthetic Construct
AQKATLSEKAQ

SEQ ID NO: 7313 - protein, 11 aa, Artificial Sequence
  Synthetic Construct
AQIHAGGQRAQ

SEQ ID NO: 7314 - protein, 11 aa, Artificial Sequence
  Synthetic Construct
AQLTPSSANAQ

SEQ ID NO: 7315 - protein, 11 aa, Artificial Sequence
  Synthetic Construct
AQDGKAYNHAQ

SEQ ID NO: 7316 - protein, 11 aa, Artificial Sequence
  Synthetic Construct
AQWSAQTMNAQ

SEQ ID NO: 7317 - protein, 11 aa, Artificial Sequence
  Synthetic Construct
AQNSTRIIVAQ

SEQ ID NO: 7318 - protein, 11 aa, Artificial Sequence
  Synthetic Construct
AQKNSSMLLAQ

SEQ ID NO: 7319 - protein, 11 aa, Artificial Sequence
  Synthetic Construct
AQRQVSGTSAQ

SEQ ID NO: 7320 - protein, 11 aa, Artificial Sequence
  Synthetic Construct
AQPVTGNSDAQ

SEQ ID NO: 7321 - protein, 11 aa, Artificial Sequence
  Synthetic Construct
AQMYPDRHSAQ

SEQ ID NO: 7322 - protein, 11 aa, Artificial Sequence
  Synthetic Construct
AQTYQIGAVAQ

SEQ ID NO: 7323 - protein, 11 aa, Artificial Sequence
  Synthetic Construct
AQKTGSLSAAQ

SEQ ID NO: 7324 - protein, 11 aa, Artificial Sequence
  Synthetic Construct
AQIIPASSPAQ

SEQ ID NO: 7325 - protein, 11 aa, Artificial Sequence
  Synthetic Construct
AQDNQGTKHAQ

SEQ ID NO: 7326 - protein, 11 aa, Artificial Sequence
  Synthetic Construct
AQSYKESPSAQ

SEQ ID NO: 7327 - protein, 11 aa, Artificial Sequence
  Synthetic Construct
AQAIISNNRAQ

SEQ ID NO: 7328 - protein, 11 aa, Artificial Sequence
  Synthetic Construct
AQTDQIRTYAQ

SEQ ID NO: 7329 - protein, 11 aa, Artificial Sequence
  Synthetic Construct
AQHSATNIDAQ

SEQ ID NO: 7330 - protein, 11 aa, Artificial Sequence
  Synthetic Construct
AQGTVNISAAQ

SEQ ID NO: 7331 - protein, 11 aa, Artificial Sequence
  Synthetic Construct
AQAVVPAMQAQ

SEQ ID NO: 7332 - protein, 11 aa, Artificial Sequence
  Synthetic Construct
AQIPRSDPSAQ

SEQ ID NO: 7333 - protein, 11 aa, Artificial Sequence
  Synthetic Construct
AQTKYTLQSAQ

SEQ ID NO: 7334 - protein, 11 aa, Artificial Sequence
  Synthetic Construct
AQSLRETSIAQ

SEQ ID NO: 7335 - protein, 11 aa, Artificial Sequence
  Synthetic Construct
AQEGDNKRLAQ

SEQ ID NO: 7336 - protein, 11 aa, Artificial Sequence
  Synthetic Construct
AQIVSSTSSAQ

SEQ ID NO: 7337 - protein, 11 aa, Artificial Sequence
  Synthetic Construct
AQLVNSGAHAQ

SEQ ID NO: 7338 - protein, 11 aa, Artificial Sequence
  Synthetic Construct
AQRTSDNQTAQ

SEQ ID NO: 7339 - protein, 11 aa, Artificial Sequence
  Synthetic Construct
AQPDGKSLAAQ

SEQ ID NO: 7340 - protein, 11 aa, Artificial Sequence
  Synthetic Construct
AQHKNMLETAQ

SEQ ID NO: 7341 - protein, 11 aa, Artificial Sequence
  Synthetic Construct
AQLSPGVTAAQ

SEQ ID NO: 7342 - protein, 11 aa, Artificial Sequence
  Synthetic Construct
AQTNHTRNTAQ

SEQ ID NO: 7343 - protein, 11 aa, Artificial Sequence
  Synthetic Construct
AQLGDSERNAQ

SEQ ID NO: 7344 - protein, 11 aa, Artificial Sequence
  Synthetic Construct
AQLLKIEQMAQ

SEQ ID NO: 7345 - protein, 11 aa, Artificial Sequence
  Synthetic Construct
AQSHLKEHPAQ

SEQ ID NO: 7346 - protein, 11 aa, Artificial Sequence
  Synthetic Construct
AQPIDNRQYAQ

SEQ ID NO: 7347 - protein, 11 aa, Artificial Sequence
  Synthetic Construct
AQDMHSGVKAQ

SEQ ID NO: 7348 - protein, 11 aa, Artificial Sequence
  Synthetic Construct
AQPSSPIPNAQ

SEQ ID NO: 7349 - protein, 11 aa, Artificial Sequence
  Synthetic Construct
AQLSSTLDDAQ

SEQ ID NO: 7350 - protein, 11 aa, Artificial Sequence
  Synthetic Construct
AQPNTAHSSAQ

SEQ ID NO: 7351 - protein, 11 aa, Artificial Sequence
  Synthetic Construct
AQATRVDVIAQ

SEQ ID NO: 7352 - protein, 11 aa, Artificial Sequence
  Synthetic Construct
AQSTNVTTVAQ

SEQ ID NO: 7353 - protein, 11 aa, Artificial Sequence
  Synthetic Construct
AQYGNNSFSAQ

SEQ ID NO: 7354 - protein, 11 aa, Artificial Sequence
  Synthetic Construct
AQPTAKPMYAQ

SEQ ID NO: 7355 - protein, 11 aa, Artificial Sequence
  Synthetic Construct
AQLPNLPTIAQ

SEQ ID NO: 7356 - protein, 11 aa, Artificial Sequence
  Synthetic Construct
AQTRLPNISAQ

SEQ ID NO: 7357 - protein, 11 aa, Artificial Sequence
  Synthetic Construct
AQHKHSTQGAQ

SEQ ID NO: 7358 - protein, 11 aa, Artificial Sequence
  Synthetic Construct
AQNGTNGFTAQ

SEQ ID NO: 7359 - protein, 11 aa, Artificial Sequence
  Synthetic Construct
AQSTDAIRFAQ

SEQ ID NO: 7360 - protein, 11 aa, Artificial Sequence
  Synthetic Construct
AQLVRDHTAAQ

SEQ ID NO: 7361 - protein, 11 aa, Artificial Sequence
  Synthetic Construct
AQISLGYSKAQ

SEQ ID NO: 7362 - protein, 11 aa, Artificial Sequence
  Synthetic Construct
AQLFGSSHTAQ

SEQ ID NO: 7363 - protein, 11 aa, Artificial Sequence
  Synthetic Construct
AQSTITPRLAQ

SEQ ID NO: 7364 - protein, 11 aa, Artificial Sequence
  Synthetic Construct
AQQITNGLRAQ

SEQ ID NO: 7365 - protein, 11 aa, Artificial Sequence
  Synthetic Construct
AQTTEYNIRAQ

SEQ ID NO: 7366 - protein, 11 aa, Artificial Sequence
  Synthetic Construct
AQTDLGRGTAQ

SEQ ID NO: 7367 - protein, 11 aa, Artificial Sequence
  Synthetic Construct
AQERSPTILAQ

SEQ ID NO: 7368 - protein, 11 aa, Artificial Sequence
  Synthetic Construct
AQHGDSARTAQ

SEQ ID NO: 7369 - protein, 11 aa, Artificial Sequence
  Synthetic Construct
AQLSVPNQQAQ

SEQ ID NO: 7370 - protein, 11 aa, Artificial Sequence
  Synthetic Construct
AQSDGPVPRAQ

SEQ ID NO: 7371 - protein, 11 aa, Artificial Sequence
  Synthetic Construct
AQNMNHIASAQ

SEQ ID NO: 7372 - protein, 11 aa, Artificial Sequence
  Synthetic Construct
AQVPNSPQRAQ

SEQ ID NO: 7373 - protein, 11 aa, Artificial Sequence
  Synthetic Construct
AQDRMASSRAQ

SEQ ID NO: 7374 - protein, 11 aa, Artificial Sequence
  Synthetic Construct
AQLLSNSSQAQ

SEQ ID NO: 7375 - protein, 11 aa, Artificial Sequence
  Synthetic Construct
AQETAVLNHAQ

SEQ ID NO: 7376 - protein, 11 aa, Artificial Sequence
  Synthetic Construct
AQEQRTPSPAQ

SEQ ID NO: 7377 - protein, 11 aa, Artificial Sequence
  Synthetic Construct
AQQHLNGSIAQ

SEQ ID NO: 7378 - protein, 11 aa, Artificial Sequence
  Synthetic Construct
AQSVLQVEGAQ

SEQ ID NO: 7379 - protein, 11 aa, Artificial Sequence
  Synthetic Construct
AQFLSGTTKAQ

SEQ ID NO: 7380 - protein, 11 aa, Artificial Sequence
  Synthetic Construct
AQGNPNDRQAQ

SEQ ID NO: 7381 - protein, 11 aa, Artificial Sequence
  Synthetic Construct
AQTDKAVQIAQ

SEQ ID NO: 7382 - protein, 11 aa, Artificial Sequence
  Synthetic Construct
AQEKYTGSPAQ

SEQ ID NO: 7383 - protein, 11 aa, Artificial Sequence
  Synthetic Construct
AQLAGSRNLAQ

SEQ ID NO: 7384 - protein, 11 aa, Artificial Sequence
  Synthetic Construct
AQMIPSTNFAQ

SEQ ID NO: 7385 - protein, 11 aa, Artificial Sequence
  Synthetic Construct
AQPLTGSSAAQ

SEQ ID NO: 7386 - protein, 11 aa, Artificial Sequence
  Synthetic Construct
AQSVSNAFSAQ

SEQ ID NO: 7387 - protein, 11 aa, Artificial Sequence
  Synthetic Construct
AQQGGQALRAQ

SEQ ID NO: 7388 - protein, 11 aa, Artificial Sequence
  Synthetic Construct
AQHPGQTLSAQ

SEQ ID NO: 7389 - protein, 11 aa, Artificial Sequence
  Synthetic Construct
AQKEYNTYSAQ

SEQ ID NO: 7390 - protein, 11 aa, Artificial Sequence
  Synthetic Construct
AQTHTAQPSAQ

SEQ ID NO: 7391 - protein, 11 aa, Artificial Sequence
  Synthetic Construct
AQMTPQVPRAQ

SEQ ID NO: 7392 - protein, 11 aa, Artificial Sequence
  Synthetic Construct
AQTRVSSLAAQ

SEQ ID NO: 7393 - protein, 11 aa, Artificial Sequence
  Synthetic Construct
AQHADLKIVAQ

SEQ ID NO: 7394 - protein, 11 aa, Artificial Sequence
  Synthetic Construct
AQNRNTDTVAQ

SEQ ID NO: 7395 - protein, 11 aa, Artificial Sequence
  Synthetic Construct
AQAHKDNHLAQ

SEQ ID NO: 7396 - protein, 11 aa, Artificial Sequence
  Synthetic Construct
AQSVPVPAAAQ

SEQ ID NO: 7397 - protein, 11 aa, Artificial Sequence
  Synthetic Construct
AQQTNSALMAQ

SEQ ID NO: 7398 - protein, 11 aa, Artificial Sequence
  Synthetic Construct
AQLGRDTAYAQ

SEQ ID NO: 7399 - protein, 11 aa, Artificial Sequence
  Synthetic Construct
AQSSVALVVAQ

SEQ ID NO: 7400 - protein, 11 aa, Artificial Sequence
  Synthetic Construct
AQMNAATTQAQ

SEQ ID NO: 7401 - protein, 11 aa, Artificial Sequence
  Synthetic Construct
AQMVSTAKDAQ

SEQ ID NO: 7402 - protein, 11 aa, Artificial Sequence
  Synthetic Construct
AQLGQMYSPAQ

SEQ ID NO: 7403 - protein, 11 aa, Artificial Sequence
  Synthetic Construct
AQDSKEKPNAQ

SEQ ID NO: 7404 - protein, 11 aa, Artificial Sequence
  Synthetic Construct
AQSPPVQGLAQ

SEQ ID NO: 7405 - protein, 11 aa, Artificial Sequence
  Synthetic Construct
AQTASDRLPAQ

SEQ ID NO: 7406 - protein, 11 aa, Artificial Sequence
  Synthetic Construct
AQIYSPTTVAQ

SEQ ID NO: 7407 - protein, 11 aa, Artificial Sequence
  Synthetic Construct
AQSQSKELRAQ

SEQ ID NO: 7408 - protein, 11 aa, Artificial Sequence
  Synthetic Construct
AQGALNGGVAQ

SEQ ID NO: 7409 - protein, 11 aa, Artificial Sequence
  Synthetic Construct
AQTIINSSKAQ

SEQ ID NO: 7410 - protein, 11 aa, Artificial Sequence
  Synthetic Construct
AQPVSAQPVAQ

SEQ ID NO: 7411 - protein, 11 aa, Artificial Sequence
  Synthetic Construct
AQSNEAVTNAQ

SEQ ID NO: 7412 - protein, 11 aa, Artificial Sequence
  Synthetic Construct
AQASMQMNRAQ

SEQ ID NO: 7413 - protein, 11 aa, Artificial Sequence
  Synthetic Construct
AQSVGKSELAQ

SEQ ID NO: 7414 - protein, 11 aa, Artificial Sequence
  Synthetic Construct
AQSQVNPSSAQ

SEQ ID NO: 7415 - protein, 11 aa, Artificial Sequence
  Synthetic Construct
AQITTDQPFAQ

SEQ ID NO: 7416 - protein, 11 aa, Artificial Sequence
  Synthetic Construct
AQNNGSGSYAQ

SEQ ID NO: 7417 - protein, 11 aa, Artificial Sequence
  Synthetic Construct
AQTLARSSVAQ

SEQ ID NO: 7418 - protein, 11 aa, Artificial Sequence
  Synthetic Construct
AQNASTMTRAQ

SEQ ID NO: 7419 - protein, 11 aa, Artificial Sequence
  Synthetic Construct
AQTNQVRYVAQ

SEQ ID NO: 7420 - protein, 11 aa, Artificial Sequence
  Synthetic Construct
AQSTQSPNRAQ

SEQ ID NO: 7421 - protein, 11 aa, Artificial Sequence
  Synthetic Construct
AQDTGARGLAQ

SEQ ID NO: 7422 - protein, 11 aa, Artificial Sequence
  Synthetic Construct
AQPGSHVVAAQ

SEQ ID NO: 7423 - protein, 11 aa, Artificial Sequence
  Synthetic Construct
AQANGIETKAQ

SEQ ID NO: 7424 - protein, 11 aa, Artificial Sequence
  Synthetic Construct
AQAHGQVQEAQ

SEQ ID NO: 7425 - protein, 11 aa, Artificial Sequence
  Synthetic Construct
AQALSHDLSAQ

SEQ ID NO: 7426 - protein, 11 aa, Artificial Sequence
  Synthetic Construct
AQLGSSLTAAQ

SEQ ID NO: 7427 - protein, 11 aa, Artificial Sequence
  Synthetic Construct
AQGNNTAKLAQ

SEQ ID NO: 7428 - protein, 11 aa, Artificial Sequence
  Synthetic Construct
AQNYAQSALAQ

SEQ ID NO: 7429 - protein, 11 aa, Artificial Sequence
  Synthetic Construct
AQDSQSKTFAQ

SEQ ID NO: 7430 - protein, 11 aa, Artificial Sequence
  Synthetic Construct
AQTNHVKFTAQ

SEQ ID NO: 7431 - protein, 11 aa, Artificial Sequence
  Synthetic Construct
AQSTPTHGLAQ

SEQ ID NO: 7432 - protein, 11 aa, Artificial Sequence
  Synthetic Construct
AQSVGLTMVAQ

SEQ ID NO: 7433 - protein, 11 aa, Artificial Sequence
  Synthetic Construct
AQIPKGSGAAQ

SEQ ID NO: 7434 - protein, 11 aa, Artificial Sequence
  Synthetic Construct
AQTAQARVLAQ

SEQ ID NO: 7435 - protein, 11 aa, Artificial Sequence
  Synthetic Construct
AQWHAGSVGAQ

SEQ ID NO: 7436 - protein, 11 aa, Artificial Sequence
  Synthetic Construct
AQSQSLLVEAQ

SEQ ID NO: 7437 - protein, 11 aa, Artificial Sequence
  Synthetic Construct
AQNNSGPLKAQ

SEQ ID NO: 7438 - protein, 11 aa, Artificial Sequence
  Synthetic Construct
AQRDNAIEHAQ

SEQ ID NO: 7439 - protein, 11 aa, Artificial Sequence
  Synthetic Construct
AQTMSNITRAQ

SEQ ID NO: 7440 - protein, 11 aa, Artificial Sequence
  Synthetic Construct
AQLSTLSQMAQ

SEQ ID NO: 7441 - protein, 11 aa, Artificial Sequence
  Synthetic Construct
AQVMQNYGSAQ

SEQ ID NO: 7442 - protein, 11 aa, Artificial Sequence
  Synthetic Construct
AQTHSAQQNAQ

SEQ ID NO: 7443 - protein, 11 aa, Artificial Sequence
  Synthetic Construct
AQSVPPNRNAQ

SEQ ID NO: 7444 - protein, 11 aa, Artificial Sequence
  Synthetic Construct
AQSVAASPRAQ

SEQ ID NO: 7445 - protein, 11 aa, Artificial Sequence
  Synthetic Construct
AQNNTSTLHAQ

SEQ ID NO: 7446 - protein, 11 aa, Artificial Sequence
  Synthetic Construct
AQNLSDHMPAQ

SEQ ID NO: 7447 - protein, 11 aa, Artificial Sequence
  Synthetic Construct
AQGLYATTSAQ

SEQ ID NO: 7448 - protein, 11 aa, Artificial Sequence
  Synthetic Construct
AQRNGGANVAQ

SEQ ID NO: 7449 - protein, 11 aa, Artificial Sequence
  Synthetic Construct
AQFHNLTLSAQ

SEQ ID NO: 7450 - protein, 11 aa, Artificial Sequence
  Synthetic Construct
AQWKSPAAIAQ

SEQ ID NO: 7451 - protein, 11 aa, Artificial Sequence
  Synthetic Construct
AQPKGLSGEAQ

SEQ ID NO: 7452 - protein, 11 aa, Artificial Sequence
  Synthetic Construct
AQSHYQLHPAQ

SEQ ID NO: 7453 - protein, 11 aa, Artificial Sequence
  Synthetic Construct
AQTTFRSAPAQ

SEQ ID NO: 7454 - protein, 11 aa, Artificial Sequence
  Synthetic Construct
AQYDATHSAAQ

SEQ ID NO: 7455 - protein, 11 aa, Artificial Sequence
  Synthetic Construct
AQNQSGPLKAQ

SEQ ID NO: 7456 - protein, 11 aa, Artificial Sequence
  Synthetic Construct
AQHTNMTSMAQ

SEQ ID NO: 7457 - protein, 11 aa, Artificial Sequence
  Synthetic Construct
AQHMKSQLPAQ

SEQ ID NO: 7458 - protein, 11 aa, Artificial Sequence
  Synthetic Construct
AQKLPTMANAQ

SEQ ID NO: 7459 - protein, 11 aa, Artificial Sequence
  Synthetic Construct
AQVGTNANHAQ

SEQ ID NO: 7460 - protein, 11 aa, Artificial Sequence
  Synthetic Construct
AQLKTDPFLAQ

SEQ ID NO: 7461 - protein, 11 aa, Artificial Sequence
  Synthetic Construct
AQHLQQNLTAQ

SEQ ID NO: 7462 - protein, 11 aa, Artificial Sequence
  Synthetic Construct
AQTQNKNSHAQ

SEQ ID NO: 7463 - protein, 11 aa, Artificial Sequence
  Synthetic Construct
AQPNAQSQRAQ

SEQ ID NO: 7464 - protein, 11 aa, Artificial Sequence
  Synthetic Construct
AQGSGHSTLAQ

SEQ ID NO: 7465 - protein, 11 aa, Artificial Sequence
  Synthetic Construct
AQLTGRLEKAQ

SEQ ID NO: 7466 - protein, 11 aa, Artificial Sequence
  Synthetic Construct
AQPSRNASLAQ

SEQ ID NO: 7467 - protein, 11 aa, Artificial Sequence
  Synthetic Construct
AQVFRTSDLAQ

SEQ ID NO: 7468 - protein, 11 aa, Artificial Sequence
  Synthetic Construct
AQIASTYSSAQ

SEQ ID NO: 7469 - protein, 11 aa, Artificial Sequence
  Synthetic Construct
AQTINHATSAQ

SEQ ID NO: 7470 - protein, 11 aa, Artificial Sequence
  Synthetic Construct
AQAMNNRAHAQ

SEQ ID NO: 7471 - protein, 11 aa, Artificial Sequence
  Synthetic Construct
AQSHHEQVSAQ

SEQ ID NO: 7472 - protein, 11 aa, Artificial Sequence
  Synthetic Construct
AQSGVTSKLAQ

SEQ ID NO: 7473 - protein, 11 aa, Artificial Sequence
  Synthetic Construct
AQVFTNDVPAQ

SEQ ID NO: 7474 - protein, 11 aa, Artificial Sequence
  Synthetic Construct
AQAAVLVAPAQ

SEQ ID NO: 7475 - protein, 11 aa, Artificial Sequence
  Synthetic Construct
AQPTAGRYLAQ

SEQ ID NO: 7476 - protein, 11 aa, Artificial Sequence
  Synthetic Construct
AQHLNSQNMAQ

SEQ ID NO: 7477 - protein, 11 aa, Artificial Sequence
  Synthetic Construct
AQPNPNVGRAQ

SEQ ID NO: 7478 - protein, 11 aa, Artificial Sequence
  Synthetic Construct
AQASENLRSAQ

SEQ ID NO: 7479 - protein, 11 aa, Artificial Sequence
  Synthetic Construct
AQNSPMRTAAQ

SEQ ID NO: 7480 - protein, 11 aa, Artificial Sequence
  Synthetic Construct
AQVAGTNQPAQ

SEQ ID NO: 7481 - protein, 11 aa, Artificial Sequence
  Synthetic Construct
AQGSESSMRAQ

SEQ ID NO: 7482 - protein, 11 aa, Artificial Sequence
  Synthetic Construct
AQTLASASRAQ

SEQ ID NO: 7483 - protein, 11 aa, Artificial Sequence
  Synthetic Construct
AQISQSWTAAQ

SEQ ID NO: 7484 - protein, 11 aa, Artificial Sequence
  Synthetic Construct
AQSGDSRSTAQ

SEQ ID NO: 7485 - protein, 11 aa, Artificial Sequence
  Synthetic Construct
AQPNIKTDLAQ

SEQ ID NO: 7486 - protein, 11 aa, Artificial Sequence
  Synthetic Construct
AQWQATDTAAQ

SEQ ID NO: 7487 - protein, 11 aa, Artificial Sequence
  Synthetic Construct
AQNNNVVTYAQ

SEQ ID NO: 7488 - protein, 11 aa, Artificial Sequence
  Synthetic Construct
AQKAISTANAQ

SEQ ID NO: 7489 - protein, 11 aa, Artificial Sequence
  Synthetic Construct
AQRQEVSGNAQ

SEQ ID NO: 7490 - protein, 11 aa, Artificial Sequence
  Synthetic Construct
AQWQDLNVVAQ

SEQ ID NO: 7491 - protein, 11 aa, Artificial Sequence
  Synthetic Construct
AQSRSDNPLAQ

SEQ ID NO: 7492 - protein, 11 aa, Artificial Sequence
  Synthetic Construct
AQIGSSTKPAQ

SEQ ID NO: 7493 - protein, 11 aa, Artificial Sequence
  Synthetic Construct
AQSPIINTSAQ

SEQ ID NO: 7494 - protein, 11 aa, Artificial Sequence
  Synthetic Construct
AQDKDTAAPAQ

SEQ ID NO: 7495 - protein, 11 aa, Artificial Sequence
  Synthetic Construct
AQSKVDSSYAQ

SEQ ID NO: 7496 - protein, 11 aa, Artificial Sequence
  Synthetic Construct
AQTLTRGTPAQ

SEQ ID NO: 7497 - protein, 11 aa, Artificial Sequence
  Synthetic Construct
AQTRTSPIQAQ

SEQ ID NO: 7498 - protein, 11 aa, Artificial Sequence
  Synthetic Construct
AQLTSATTNAQ

SEQ ID NO: 7499 - protein, 11 aa, Artificial Sequence
  Synthetic Construct
AQTINIHSAAQ

SEQ ID NO: 7500 - protein, 11 aa, Artificial Sequence
  Synthetic Construct
AQSFSPENRAQ

SEQ ID NO: 7501 - protein, 11 aa, Artificial Sequence
  Synthetic Construct
AQGMALGTGAQ

SEQ ID NO: 7502 - protein, 11 aa, Artificial Sequence
  Synthetic Construct
AQYNGTQGRAQ

SEQ ID NO: 7503 - protein, 11 aa, Artificial Sequence
  Synthetic Construct
AQNKLLEHPAQ

SEQ ID NO: 7504 - protein, 11 aa, Artificial Sequence
  Synthetic Construct
AQYVNNVAPAQ

SEQ ID NO: 7505 - protein, 11 aa, Artificial Sequence
  Synthetic Construct
AQYSVVHDKAQ

SEQ ID NO: 7506 - protein, 11 aa, Artificial Sequence
  Synthetic Construct
AQGLETRHMAQ

SEQ ID NO: 7507 - protein, 11 aa, Artificial Sequence
  Synthetic Construct
AQAPNLMADAQ

SEQ ID NO: 7508 - protein, 11 aa, Artificial Sequence
  Synthetic Construct
AQNSNGMAPAQ

SEQ ID NO: 7509 - protein, 11 aa, Artificial Sequence
  Synthetic Construct
AQSLNYSQNAQ

SEQ ID NO: 7510 - protein, 11 aa, Artificial Sequence
  Synthetic Construct
AQTEYANGRAQ

SEQ ID NO: 7511 - protein, 11 aa, Artificial Sequence
  Synthetic Construct
AQPLGHVRSAQ

SEQ ID NO: 7512 - protein, 11 aa, Artificial Sequence
  Synthetic Construct
AQLRDSPGLAQ

SEQ ID NO: 7513 - protein, 11 aa, Artificial Sequence
  Synthetic Construct
AQVIRSNTHAQ

SEQ ID NO: 7514 - protein, 11 aa, Artificial Sequence
  Synthetic Construct
AQASVSNLSAQ

SEQ ID NO: 7515 - protein, 11 aa, Artificial Sequence
  Synthetic Construct
AQWAQRTSQAQ

SEQ ID NO: 7516 - protein, 11 aa, Artificial Sequence
  Synthetic Construct
AQNDKGMSRAQ

SEQ ID NO: 7517 - protein, 11 aa, Artificial Sequence
  Synthetic Construct
AQQNDTRNYAQ

SEQ ID NO: 7518 - protein, 11 aa, Artificial Sequence
  Synthetic Construct
AQGEVAGRLAQ

SEQ ID NO: 7519 - protein, 11 aa, Artificial Sequence
  Synthetic Construct
AQTTTNTVSAQ

SEQ ID NO: 7520 - protein, 11 aa, Artificial Sequence
  Synthetic Construct
AQPVMSNKDAQ

SEQ ID NO: 7521 - protein, 11 aa, Artificial Sequence
  Synthetic Construct
AQNGGTTFIAQ

SEQ ID NO: 7522 - protein, 11 aa, Artificial Sequence
  Synthetic Construct
AQVLKTTAIAQ

SEQ ID NO: 7523 - protein, 11 aa, Artificial Sequence
  Synthetic Construct
AQPHGVGSAAQ

SEQ ID NO: 7524 - protein, 11 aa, Artificial Sequence
  Synthetic Construct
AQSNAHPLAAQ

SEQ ID NO: 7525 - protein, 11 aa, Artificial Sequence
  Synthetic Construct
AQKSTSLDPAQ

SEQ ID NO: 7526 - protein, 11 aa, Artificial Sequence
  Synthetic Construct
AQFNKTNDMAQ

SEQ ID NO: 7527 - protein, 11 aa, Artificial Sequence
  Synthetic Construct
AQHQTSELRAQ

SEQ ID NO: 7528 - protein, 11 aa, Artificial Sequence
  Synthetic Construct
AQWAKVLDKAQ

SEQ ID NO: 7529 - protein, 11 aa, Artificial Sequence
  Synthetic Construct
AQMSSNNKSAQ

SEQ ID NO: 7530 - protein, 11 aa, Artificial Sequence
  Synthetic Construct
AQDGTHLKLAQ

SEQ ID NO: 7531 - protein, 11 aa, Artificial Sequence
  Synthetic Construct
AQTVISDQRAQ

SEQ ID NO: 7532 - protein, 11 aa, Artificial Sequence
  Synthetic Construct
AQMHSQLLPAQ

SEQ ID NO: 7533 - protein, 11 aa, Artificial Sequence
  Synthetic Construct
AQSSYGTAAAQ

SEQ ID NO: 7534 - protein, 11 aa, Artificial Sequence
  Synthetic Construct
AQVLSTMAVAQ

SEQ ID NO: 7535 - protein, 11 aa, Artificial Sequence
  Synthetic Construct
AQSASNFASAQ

SEQ ID NO: 7536 - protein, 11 aa, Artificial Sequence
  Synthetic Construct
AQSKAGLSDAQ

SEQ ID NO: 7537 - protein, 11 aa, Artificial Sequence
  Synthetic Construct
AQINRIVSGAQ

SEQ ID NO: 7538 - protein, 11 aa, Artificial Sequence
  Synthetic Construct
AQKLDTPGKAQ

SEQ ID NO: 7539 - protein, 11 aa, Artificial Sequence
  Synthetic Construct
AQMDRIVKMAQ

SEQ ID NO: 7540 - protein, 11 aa, Artificial Sequence
  Synthetic Construct
AQRERSTDAAQ

SEQ ID NO: 7541 - protein, 11 aa, Artificial Sequence
  Synthetic Construct
AQLRDSTGHAQ

SEQ ID NO: 7542 - protein, 11 aa, Artificial Sequence
  Synthetic Construct
AQMRGQGVHAQ

SEQ ID NO: 7543 - protein, 11 aa, Artificial Sequence
  Synthetic Construct
AQSAQMISPAQ

SEQ ID NO: 7544 - protein, 11 aa, Artificial Sequence
  Synthetic Construct
AQWTNGVAKAQ

SEQ ID NO: 7545 - protein, 11 aa, Artificial Sequence
  Synthetic Construct
AQTAISIQVAQ

SEQ ID NO: 7546 - protein, 11 aa, Artificial Sequence
  Synthetic Construct
AQPSGSQSHAQ

SEQ ID NO: 7547 - protein, 11 aa, Artificial Sequence
  Synthetic Construct
AQNRLTPGSAQ

SEQ ID NO: 7548 - protein, 11 aa, Artificial Sequence
  Synthetic Construct
AQIALEHRNAQ

SEQ ID NO: 7549 - protein, 11 aa, Artificial Sequence
  Synthetic Construct
AQPARTPPQAQ

SEQ ID NO: 7550 - protein, 11 aa, Artificial Sequence
  Synthetic Construct
AQMGKSNGVAQ

SEQ ID NO: 7551 - protein, 11 aa, Artificial Sequence
  Synthetic Construct
AQPIVRSTSAQ

SEQ ID NO: 7552 - protein, 11 aa, Artificial Sequence
  Synthetic Construct
AQVTQLSPRAQ

SEQ ID NO: 7553 - protein, 11 aa, Artificial Sequence
  Synthetic Construct
AQKALLPLTAQ

SEQ ID NO: 7554 - protein, 11 aa, Artificial Sequence
  Synthetic Construct
AQSGNSRLQAQ

SEQ ID NO: 7555 - protein, 11 aa, Artificial Sequence
  Synthetic Construct
AQRNQSAPLAQ

SEQ ID NO: 7556 - protein, 11 aa, Artificial Sequence
  Synthetic Construct
AQNLQNMIQAQ

SEQ ID NO: 7557 - protein, 11 aa, Artificial Sequence
  Synthetic Construct
AQSSYDKSLAQ

SEQ ID NO: 7558 - protein, 11 aa, Artificial Sequence
  Synthetic Construct
AQVLANQQIAQ

SEQ ID NO: 7559 - protein, 11 aa, Artificial Sequence
  Synthetic Construct
AQRTTNEPTAQ

SEQ ID NO: 7560 - protein, 11 aa, Artificial Sequence
  Synthetic Construct
AQIVSNQMSAQ

SEQ ID NO: 7561 - protein, 11 aa, Artificial Sequence
  Synthetic Construct
AQNATHANVAQ

SEQ ID NO: 7562 - protein, 11 aa, Artificial Sequence
  Synthetic Construct
AQKGNEPLRAQ

SEQ ID NO: 7563 - protein, 11 aa, Artificial Sequence
  Synthetic Construct
AQLGTYLSPAQ

SEQ ID NO: 7564 - protein, 11 aa, Artificial Sequence
  Synthetic Construct
AQTNVLPLPAQ

SEQ ID NO: 7565 - protein, 11 aa, Artificial Sequence
  Synthetic Construct
AQKLSHEPSAQ

SEQ ID NO: 7566 - protein, 11 aa, Artificial Sequence
  Synthetic Construct
AQFDKQNPTAQ

SEQ ID NO: 7567 - protein, 11 aa, Artificial Sequence
  Synthetic Construct
AQFGGRYEKAQ

SEQ ID NO: 7568 - protein, 11 aa, Artificial Sequence
  Synthetic Construct
AQTVQNHTNAQ

SEQ ID NO: 7569 - protein, 11 aa, Artificial Sequence
  Synthetic Construct
AQPLKPMQTAQ

SEQ ID NO: 7570 - protein, 11 aa, Artificial Sequence
  Synthetic Construct
AQQGETNHRAQ

SEQ ID NO: 7571 - protein, 11 aa, Artificial Sequence
  Synthetic Construct
AQAHSNMVNAQ

SEQ ID NO: 7572 - protein, 11 aa, Artificial Sequence
  Synthetic Construct
AQVSASSNKAQ

SEQ ID NO: 7573 - protein, 11 aa, Artificial Sequence
  Synthetic Construct
AQTNQSKNFAQ

SEQ ID NO: 7574 - protein, 11 aa, Artificial Sequence
  Synthetic Construct
AQKMKDMSIAQ

SEQ ID NO: 7575 - protein, 11 aa, Artificial Sequence
  Synthetic Construct
AQHPSGSTLAQ

SEQ ID NO: 7576 - protein, 11 aa, Artificial Sequence
  Synthetic Construct
AQIKDTVSGAQ

SEQ ID NO: 7577 - protein, 11 aa, Artificial Sequence
  Synthetic Construct
AQMNTLTNVAQ

SEQ ID NO: 7578 - protein, 11 aa, Artificial Sequence
  Synthetic Construct
AQTDSAPHPAQ

SEQ ID NO: 7579 - protein, 11 aa, Artificial Sequence
  Synthetic Construct
AQPRPVSNGAQ

SEQ ID NO: 7580 - protein, 11 aa, Artificial Sequence
  Synthetic Construct
AQSVDRRPQAQ

SEQ ID NO: 7581 - protein, 11 aa, Artificial Sequence
  Synthetic Construct
AQMDSPIRNAQ

SEQ ID NO: 7582 - protein, 11 aa, Artificial Sequence
  Synthetic Construct
AQATRMSIPAQ

SEQ ID NO: 7583 - protein, 11 aa, Artificial Sequence
  Synthetic Construct
AQNVPTSLPAQ

SEQ ID NO: 7584 - protein, 11 aa, Artificial Sequence
  Synthetic Construct
AQSLRIESKAQ

SEQ ID NO: 7585 - protein, 11 aa, Artificial Sequence
  Synthetic Construct
AQNSGNTLGAQ

SEQ ID NO: 7586 - protein, 11 aa, Artificial Sequence
  Synthetic Construct
AQRLDHASIAQ

SEQ ID NO: 7587 - protein, 11 aa, Artificial Sequence
  Synthetic Construct
AQSHLVVSAAQ

SEQ ID NO: 7588 - protein, 11 aa, Artificial Sequence
  Synthetic Construct
AQPASPRSHAQ

SEQ ID NO: 7589 - protein, 11 aa, Artificial Sequence
  Synthetic Construct
AQNHTLVPPAQ

SEQ ID NO: 7590 - protein, 11 aa, Artificial Sequence
  Synthetic Construct
AQMQMTGTAAQ

SEQ ID NO: 7591 - protein, 11 aa, Artificial Sequence
  Synthetic Construct
AQNTQANPRAQ

SEQ ID NO: 7592 - protein, 11 aa, Artificial Sequence
  Synthetic Construct
AQTRDLNAIAQ

SEQ ID NO: 7593 - protein, 11 aa, Artificial Sequence
  Synthetic Construct
AQTDASSPFAQ

SEQ ID NO: 7594 - protein, 11 aa, Artificial Sequence
  Synthetic Construct
AQADQRQPKAQ

SEQ ID NO: 7595 - protein, 11 aa, Artificial Sequence
  Synthetic Construct
AQAVNPNYAAQ

SEQ ID NO: 7596 - protein, 11 aa, Artificial Sequence
  Synthetic Construct
AQLTATNVRAQ

SEQ ID NO: 7597 - protein, 11 aa, Artificial Sequence
  Synthetic Construct
AQLTASTYSAQ

SEQ ID NO: 7598 - protein, 11 aa, Artificial Sequence
  Synthetic Construct
AQGSRDNSVAQ

SEQ ID NO: 7599 - protein, 11 aa, Artificial Sequence
  Synthetic Construct
AQTDTQNRLAQ

SEQ ID NO: 7600 - protein, 11 aa, Artificial Sequence
  Synthetic Construct
AQNSTVNTGAQ

SEQ ID NO: 7601 - protein, 11 aa, Artificial Sequence
  Synthetic Construct
AQLSHAMRSAQ

SEQ ID NO: 7602 - protein, 11 aa, Artificial Sequence
  Synthetic Construct
AQRLPMTTMAQ

SEQ ID NO: 7603 - protein, 11 aa, Artificial Sequence
  Synthetic Construct
AQLYHESQTAQ

SEQ ID NO: 7604 - protein, 11 aa, Artificial Sequence
  Synthetic Construct
AQILHQSSTAQ

SEQ ID NO: 7605 - protein, 11 aa, Artificial Sequence
  Synthetic Construct
AQTSLATQTAQ

SEQ ID NO: 7606 - protein, 11 aa, Artificial Sequence
  Synthetic Construct
AQRTPTLTVAQ

SEQ ID NO: 7607 - protein, 11 aa, Artificial Sequence
  Synthetic Construct
AQATRESRTAQ

SEQ ID NO: 7608 - protein, 11 aa, Artificial Sequence
  Synthetic Construct
AQLSESLRIAQ

SEQ ID NO: 7609 - protein, 11 aa, Artificial Sequence
  Synthetic Construct
AQSVTGGMVAQ

SEQ ID NO: 7610 - protein, 11 aa, Artificial Sequence
  Synthetic Construct
AQPRTSDSNAQ

SEQ ID NO: 7611 - protein, 11 aa, Artificial Sequence
  Synthetic Construct
AQVHSTVTSAQ

SEQ ID NO: 7612 - protein, 11 aa, Artificial Sequence
  Synthetic Construct
AQGTNMNHLAQ

SEQ ID NO: 7613 - protein, 11 aa, Artificial Sequence
  Synthetic Construct
AQMKAELYAAQ

SEQ ID NO: 7614 - protein, 11 aa, Artificial Sequence
  Synthetic Construct
AQLRSPSVDAQ

SEQ ID NO: 7615 - protein, 11 aa, Artificial Sequence
  Synthetic Construct
AQTNSPQFPAQ

SEQ ID NO: 7616 - protein, 11 aa, Artificial Sequence
  Synthetic Construct
AQNNSLRSNAQ

SEQ ID NO: 7617 - protein, 11 aa, Artificial Sequence
  Synthetic Construct
AQDSHMGKYAQ

SEQ ID NO: 7618 - protein, 11 aa, Artificial Sequence
  Synthetic Construct
AQVNSMTPRAQ

SEQ ID NO: 7619 - protein, 11 aa, Artificial Sequence
  Synthetic Construct
AQLAPISLNAQ

SEQ ID NO: 7620 - protein, 11 aa, Artificial Sequence
  Synthetic Construct
AQNMPSIMQAQ

SEQ ID NO: 7621 - protein, 11 aa, Artificial Sequence
  Synthetic Construct
AQGNMIKVAAQ

SEQ ID NO: 7622 - protein, 11 aa, Artificial Sequence
  Synthetic Construct
AQTGVSLQVAQ

SEQ ID NO: 7623 - protein, 11 aa, Artificial Sequence
  Synthetic Construct
AQPQFNTASAQ

SEQ ID NO: 7624 - protein, 11 aa, Artificial Sequence
  Synthetic Construct
AQTEAYRNTAQ

SEQ ID NO: 7625 - protein, 11 aa, Artificial Sequence
  Synthetic Construct
AQLMKADTVAQ

SEQ ID NO: 7626 - protein, 11 aa, Artificial Sequence
  Synthetic Construct
AQNHKEFMLAQ

SEQ ID NO: 7627 - protein, 11 aa, Artificial Sequence
  Synthetic Construct
AQLNGTLTVAQ

SEQ ID NO: 7628 - protein, 11 aa, Artificial Sequence
  Synthetic Construct
AQTAKILTMAQ

SEQ ID NO: 7629 - protein, 11 aa, Artificial Sequence
  Synthetic Construct
AQLRDSLPVAQ

SEQ ID NO: 7630 - protein, 11 aa, Artificial Sequence
  Synthetic Construct
AQLKGGDSWAQ

SEQ ID NO: 7631 - protein, 11 aa, Artificial Sequence
  Synthetic Construct
AQKTVDIMGAQ

SEQ ID NO: 7632 - protein, 11 aa, Artificial Sequence
  Synthetic Construct
AQLNMGQMKAQ

SEQ ID NO: 7633 - protein, 11 aa, Artificial Sequence
  Synthetic Construct
AQSVPSLDRAQ

SEQ ID NO: 7634 - protein, 11 aa, Artificial Sequence
  Synthetic Construct
AQQLLGTSKAQ

SEQ ID NO: 7635 - protein, 11 aa, Artificial Sequence
  Synthetic Construct
AQMNPKHGLAQ

SEQ ID NO: 7636 - protein, 11 aa, Artificial Sequence
  Synthetic Construct
AQSPEGSLKAQ

SEQ ID NO: 7637 - protein, 11 aa, Artificial Sequence
  Synthetic Construct
AQANMPNSRAQ

SEQ ID NO: 7638 - protein, 11 aa, Artificial Sequence
  Synthetic Construct
AQAYISSGVAQ

SEQ ID NO: 7639 - protein, 11 aa, Artificial Sequence
  Synthetic Construct
AQERGSQANAQ

SEQ ID NO: 7640 - protein, 11 aa, Artificial Sequence
  Synthetic Construct
AQGHDRLSPAQ

SEQ ID NO: 7641 - protein, 11 aa, Artificial Sequence
  Synthetic Construct
AQTSNVTGTAQ

SEQ ID NO: 7642 - protein, 11 aa, Artificial Sequence
  Synthetic Construct
AQLTHNVGVAQ

SEQ ID NO: 7643 - protein, 11 aa, Artificial Sequence
  Synthetic Construct
AQREDGVAKAQ

SEQ ID NO: 7644 - protein, 11 aa, Artificial Sequence
  Synthetic Construct
AQPADGYKLAQ

SEQ ID NO: 7645 - protein, 11 aa, Artificial Sequence
  Synthetic Construct
AQQLDATRAAQ

SEQ ID NO: 7646 - protein, 11 aa, Artificial Sequence
  Synthetic Construct
AQVTGMTTRAQ

SEQ ID NO: 7647 - protein, 11 aa, Artificial Sequence
  Synthetic Construct
AQSDSRTYEAQ

SEQ ID NO: 7648 - protein, 11 aa, Artificial Sequence
  Synthetic Construct
AQVEPLKPDAQ

SEQ ID NO: 7649 - protein, 11 aa, Artificial Sequence
  Synthetic Construct
AQGVLASNRAQ

SEQ ID NO: 7650 - protein, 11 aa, Artificial Sequence
  Synthetic Construct
AQMGERMSIAQ

SEQ ID NO: 7651 - protein, 11 aa, Artificial Sequence
  Synthetic Construct
AQFTKTEDLAQ

SEQ ID NO: 7652 - protein, 11 aa, Artificial Sequence
  Synthetic Construct
AQVKNTELLAQ

SEQ ID NO: 7653 - protein, 11 aa, Artificial Sequence
  Synthetic Construct
AQTVTSTVVAQ

SEQ ID NO: 7654 - protein, 11 aa, Artificial Sequence
  Synthetic Construct
AQAKYGDPTAQ

SEQ ID NO: 7655 - protein, 11 aa, Artificial Sequence
  Synthetic Construct
AQTSDRLLGAQ

SEQ ID NO: 7656 - protein, 11 aa, Artificial Sequence
  Synthetic Construct
AQAVGNTKMAQ

SEQ ID NO: 7657 - protein, 11 aa, Artificial Sequence
  Synthetic Construct
AQQTYNKMDAQ

SEQ ID NO: 7658 - protein, 11 aa, Artificial Sequence
  Synthetic Construct
AQAWASQSSAQ

SEQ ID NO: 7659 - protein, 11 aa, Artificial Sequence
  Synthetic Construct
AQNAFLTGGAQ

SEQ ID NO: 7660 - protein, 11 aa, Artificial Sequence
  Synthetic Construct
AQSIGDKYTAQ

SEQ ID NO: 7661 - protein, 11 aa, Artificial Sequence
  Synthetic Construct
AQSNHHHTGAQ

SEQ ID NO: 7662 - protein, 11 aa, Artificial Sequence
  Synthetic Construct
AQITNKPMTAQ

SEQ ID NO: 7663 - protein, 11 aa, Artificial Sequence
  Synthetic Construct
AQLSGQVSNAQ

SEQ ID NO: 7664 - protein, 11 aa, Artificial Sequence
  Synthetic Construct
AQNSMSGHLAQ

SEQ ID NO: 7665 - protein, 11 aa, Artificial Sequence
  Synthetic Construct
AQPAVHGYAAQ

SEQ ID NO: 7666 - protein, 11 aa, Artificial Sequence
  Synthetic Construct
AQLMRTKQPAQ

SEQ ID NO: 7667 - protein, 11 aa, Artificial Sequence
  Synthetic Construct
AQSSLAVNKAQ

SEQ ID NO: 7668 - protein, 11 aa, Artificial Sequence
  Synthetic Construct
AQNTQSEPRAQ

SEQ ID NO: 7669 - protein, 11 aa, Artificial Sequence
  Synthetic Construct
AQDHLVSVPAQ

SEQ ID NO: 7670 - protein, 11 aa, Artificial Sequence
  Synthetic Construct
AQWATSTHDAQ

SEQ ID NO: 7671 - protein, 11 aa, Artificial Sequence
  Synthetic Construct
AQPQQQPIGAQ

SEQ ID NO: 7672 - protein, 11 aa, Artificial Sequence
  Synthetic Construct
AQSLSTHSDAQ

SEQ ID NO: 7673 - protein, 11 aa, Artificial Sequence
  Synthetic Construct
AQGSMAARSAQ

SEQ ID NO: 7674 - protein, 11 aa, Artificial Sequence
  Synthetic Construct
AQAPGMTARAQ

SEQ ID NO: 7675 - protein, 11 aa, Artificial Sequence
  Synthetic Construct
AQVLANMTAAQ

SEQ ID NO: 7676 - protein, 11 aa, Artificial Sequence
  Synthetic Construct
AQLTKQESAAQ

SEQ ID NO: 7677 - protein, 11 aa, Artificial Sequence
  Synthetic Construct
AQGANSGGVAQ

SEQ ID NO: 7678 - protein, 11 aa, Artificial Sequence
  Synthetic Construct
AQQSEPKRPAQ

SEQ ID NO: 7679 - protein, 11 aa, Artificial Sequence
  Synthetic Construct
AQVHGERSVAQ

SEQ ID NO: 7680 - protein, 11 aa, Artificial Sequence
  Synthetic Construct
AQAHQTAASAQ

SEQ ID NO: 7681 - protein, 11 aa, Artificial Sequence
  Synthetic Construct
AQVREMQTAAQ

SEQ ID NO: 7682 - protein, 11 aa, Artificial Sequence
  Synthetic Construct
AQVAPSALHAQ

SEQ ID NO: 7683 - protein, 11 aa, Artificial Sequence
  Synthetic Construct
AQSVGHHNMAQ

SEQ ID NO: 7684 - protein, 11 aa, Artificial Sequence
  Synthetic Construct
AQFLTQGDVAQ

SEQ ID NO: 7685 - protein, 11 aa, Artificial Sequence
  Synthetic Construct
AQFSTQFQHAQ

SEQ ID NO: 7686 - protein, 11 aa, Artificial Sequence
  Synthetic Construct
AQQNTTRSNAQ

SEQ ID NO: 7687 - protein, 11 aa, Artificial Sequence
  Synthetic Construct
AQPAVTSIAAQ

SEQ ID NO: 7688 - protein, 11 aa, Artificial Sequence
  Synthetic Construct
AQASTNTYVAQ

SEQ ID NO: 7689 - protein, 11 aa, Artificial Sequence
  Synthetic Construct
AQSTATPTSAQ

SEQ ID NO: 7690 - protein, 11 aa, Artificial Sequence
  Synthetic Construct
AQHFNRTSPAQ

SEQ ID NO: 7691 - protein, 11 aa, Artificial Sequence
  Synthetic Construct
AQSVAGMLPAQ

SEQ ID NO: 7692 - protein, 11 aa, Artificial Sequence
  Synthetic Construct
AQPMSSESSAQ

SEQ ID NO: 7693 - protein, 11 aa, Artificial Sequence
  Synthetic Construct
AQSLASTTVAQ

SEQ ID NO: 7694 - protein, 11 aa, Artificial Sequence
  Synthetic Construct
AQTSTPAQVAQ

SEQ ID NO: 7695 - protein, 11 aa, Artificial Sequence
  Synthetic Construct
AQSLTAQQPAQ

SEQ ID NO: 7696 - protein, 11 aa, Artificial Sequence
  Synthetic Construct
AQSGRVPVAAQ

SEQ ID NO: 7697 - protein, 11 aa, Artificial Sequence
  Synthetic Construct
AQLDAAKSLAQ

SEQ ID NO: 7698 - protein, 11 aa, Artificial Sequence
  Synthetic Construct
AQNFANKNVAQ

SEQ ID NO: 7699 - protein, 11 aa, Artificial Sequence
  Synthetic Construct
AQGPASVTPAQ

SEQ ID NO: 7700 - protein, 11 aa, Artificial Sequence
  Synthetic Construct
AQYSREATNAQ

SEQ ID NO: 7701 - protein, 11 aa, Artificial Sequence
  Synthetic Construct
AQTGSSFAMAQ

SEQ ID NO: 7702 - protein, 11 aa, Artificial Sequence
  Synthetic Construct
AQGIKGDPVAQ

SEQ ID NO: 7703 - protein, 11 aa, Artificial Sequence
  Synthetic Construct
AQVTSTSHAAQ

SEQ ID NO: 7704 - protein, 11 aa, Artificial Sequence
  Synthetic Construct
AQTSQNNLRAQ

SEQ ID NO: 7705 - protein, 11 aa, Artificial Sequence
  Synthetic Construct
AQMRQEGLSAQ

SEQ ID NO: 7706 - protein, 11 aa, Artificial Sequence
  Synthetic Construct
AQLNLNAIAAQ

SEQ ID NO: 7707 - protein, 11 aa, Artificial Sequence
  Synthetic Construct
AQSKNEGPTAQ

SEQ ID NO: 7708 - protein, 11 aa, Artificial Sequence
  Synthetic Construct
AQDSRSTTNAQ

SEQ ID NO: 7709 - protein, 11 aa, Artificial Sequence
  Synthetic Construct
AQSTGDALRAQ

SEQ ID NO: 7710 - protein, 11 aa, Artificial Sequence
  Synthetic Construct
AQINKPGTPAQ

SEQ ID NO: 7711 - protein, 11 aa, Artificial Sequence
  Synthetic Construct
AQVSAPLNIAQ

SEQ ID NO: 7712 - protein, 11 aa, Artificial Sequence
  Synthetic Construct
AQVSLGSLAAQ

SEQ ID NO: 7713 - protein, 11 aa, Artificial Sequence
  Synthetic Construct
AQLNHINEKAQ

SEQ ID NO: 7714 - protein, 11 aa, Artificial Sequence
  Synthetic Construct
AQKSVTILSAQ

SEQ ID NO: 7715 - protein, 11 aa, Artificial Sequence
  Synthetic Construct
AQSNVSSLVAQ

SEQ ID NO: 7716 - protein, 11 aa, Artificial Sequence
  Synthetic Construct
AQFSQTVGGAQ

SEQ ID NO: 7717 - protein, 11 aa, Artificial Sequence
  Synthetic Construct
AQRPSITHDAQ

SEQ ID NO: 7718 - protein, 11 aa, Artificial Sequence
  Synthetic Construct
AQRQESTTLAQ

SEQ ID NO: 7719 - protein, 11 aa, Artificial Sequence
  Synthetic Construct
AQGPYVTPQAQ

SEQ ID NO: 7720 - protein, 11 aa, Artificial Sequence
  Synthetic Construct
AQNGLVTTAAQ

SEQ ID NO: 7721 - protein, 11 aa, Artificial Sequence
  Synthetic Construct
AQHAGNVPGAQ

SEQ ID NO: 7722 - protein, 11 aa, Artificial Sequence
  Synthetic Construct
AQPMGNNLVAQ

SEQ ID NO: 7723 - protein, 11 aa, Artificial Sequence
  Synthetic Construct
AQVYNDRSHAQ

SEQ ID NO: 7724 - protein, 11 aa, Artificial Sequence
  Synthetic Construct
AQTHKESGYAQ

SEQ ID NO: 7725 - protein, 11 aa, Artificial Sequence
  Synthetic Construct
AQGMNSVLLAQ

SEQ ID NO: 7726 - protein, 11 aa, Artificial Sequence
  Synthetic Construct
AQYLENQYSAQ

SEQ ID NO: 7727 - protein, 11 aa, Artificial Sequence
  Synthetic Construct
AQSITSRPNAQ

SEQ ID NO: 7728 - protein, 11 aa, Artificial Sequence
  Synthetic Construct
AQSHQNTARAQ

SEQ ID NO: 7729 - protein, 11 aa, Artificial Sequence
  Synthetic Construct
AQRLVQSAEAQ

SEQ ID NO: 7730 - protein, 11 aa, Artificial Sequence
  Synthetic Construct
AQYPKSATNAQ

SEQ ID NO: 7731 - protein, 11 aa, Artificial Sequence
  Synthetic Construct
AQINSSPPLAQ

SEQ ID NO: 7732 - protein, 11 aa, Artificial Sequence
  Synthetic Construct
AQTQNLAGGAQ

SEQ ID NO: 7733 - protein, 11 aa, Artificial Sequence
  Synthetic Construct
AQFQVAKDRAQ

SEQ ID NO: 7734 - protein, 11 aa, Artificial Sequence
  Synthetic Construct
AQRLSGNQNAQ

SEQ ID NO: 7735 - protein, 11 aa, Artificial Sequence
  Synthetic Construct
AQTTDRVSHAQ

SEQ ID NO: 7736 - protein, 11 aa, Artificial Sequence
  Synthetic Construct
AQTATVTARAQ

SEQ ID NO: 7737 - protein, 11 aa, Artificial Sequence
  Synthetic Construct
AQLSMMSDKAQ

SEQ ID NO: 7738 - protein, 11 aa, Artificial Sequence
  Synthetic Construct
AQTLIQTSPAQ

SEQ ID NO: 7739 - protein, 11 aa, Artificial Sequence
  Synthetic Construct
AQPMHITNAAQ

SEQ ID NO: 7740 - protein, 11 aa, Artificial Sequence
  Synthetic Construct
AQTVGQPAHAQ

SEQ ID NO: 7741 - protein, 11 aa, Artificial Sequence
  Synthetic Construct
AQEDKDVRLAQ

SEQ ID NO: 7742 - protein, 11 aa, Artificial Sequence
  Synthetic Construct
AQMKVAQPMAQ

SEQ ID NO: 7743 - protein, 11 aa, Artificial Sequence
  Synthetic Construct
AQVGVPNLPAQ

SEQ ID NO: 7744 - protein, 11 aa, Artificial Sequence
  Synthetic Construct
AQAPLSSDPAQ

SEQ ID NO: 7745 - protein, 11 aa, Artificial Sequence
  Synthetic Construct
AQFLHASVDAQ

SEQ ID NO: 7746 - protein, 11 aa, Artificial Sequence
  Synthetic Construct
AQPTVGTYIAQ

SEQ ID NO: 7747 - protein, 11 aa, Artificial Sequence
  Synthetic Construct
AQEPLHRNSAQ

SEQ ID NO: 7748 - protein, 11 aa, Artificial Sequence
  Synthetic Construct
AQASTVTVEAQ

SEQ ID NO: 7749 - protein, 11 aa, Artificial Sequence
  Synthetic Construct
AQAPRIDNAAQ

SEQ ID NO: 7750 - protein, 11 aa, Artificial Sequence
  Synthetic Construct
AQYRDSAAPAQ

SEQ ID NO: 7751 - protein, 11 aa, Artificial Sequence
  Synthetic Construct
AQLTQNASVAQ

SEQ ID NO: 7752 - protein, 11 aa, Artificial Sequence
  Synthetic Construct
AQLSARLTTAQ

SEQ ID NO: 7753 - protein, 11 aa, Artificial Sequence
  Synthetic Construct
AQNGKSSDKAQ

SEQ ID NO: 7754 - protein, 11 aa, Artificial Sequence
  Synthetic Construct
AQALVKDTTAQ

SEQ ID NO: 7755 - protein, 11 aa, Artificial Sequence
  Synthetic Construct
AQMLVTTGEAQ

SEQ ID NO: 7756 - protein, 11 aa, Artificial Sequence
  Synthetic Construct
AQSGNPSYAAQ

SEQ ID NO: 7757 - protein, 11 aa, Artificial Sequence
  Synthetic Construct
AQVITGGMSAQ

SEQ ID NO: 7758 - protein, 11 aa, Artificial Sequence
  Synthetic Construct
AQLEPNVQTAQ

SEQ ID NO: 7759 - protein, 11 aa, Artificial Sequence
  Synthetic Construct
AQRFSEVTPAQ

SEQ ID NO: 7760 - protein, 11 aa, Artificial Sequence
  Synthetic Construct
AQDPGKASLAQ

SEQ ID NO: 7761 - protein, 11 aa, Artificial Sequence
  Synthetic Construct
AQIAHESTDAQ

SEQ ID NO: 7762 - protein, 11 aa, Artificial Sequence
  Synthetic Construct
AQYPSNSMHAQ

SEQ ID NO: 7763 - protein, 11 aa, Artificial Sequence
  Synthetic Construct
AQSTTPPSGAQ

SEQ ID NO: 7764 - protein, 11 aa, Artificial Sequence
  Synthetic Construct
AQVEQNSKNAQ

SEQ ID NO: 7765 - protein, 11 aa, Artificial Sequence
  Synthetic Construct
AQTIAGRLVAQ

SEQ ID NO: 7766 - protein, 11 aa, Artificial Sequence
  Synthetic Construct
AQARHTGEMAQ

SEQ ID NO: 7767 - protein, 11 aa, Artificial Sequence
  Synthetic Construct
AQQHLPNHIAQ

SEQ ID NO: 7768 - protein, 11 aa, Artificial Sequence
  Synthetic Construct
AQTTMGTYPAQ

SEQ ID NO: 7769 - protein, 11 aa, Artificial Sequence
  Synthetic Construct
AQTESVMPRAQ

SEQ ID NO: 7770 - protein, 11 aa, Artificial Sequence
  Synthetic Construct
AQGAKPSNDAQ

SEQ ID NO: 7771 - protein, 11 aa, Artificial Sequence
  Synthetic Construct
AQAVSSDMSAQ

SEQ ID NO: 7772 - protein, 11 aa, Artificial Sequence
  Synthetic Construct
AQHSPQLGGAQ

SEQ ID NO: 7773 - protein, 11 aa, Artificial Sequence
  Synthetic Construct
AQLYTNPNTAQ

SEQ ID NO: 7774 - protein, 11 aa, Artificial Sequence
  Synthetic Construct
AQTVALNMAAQ

SEQ ID NO: 7775 - protein, 11 aa, Artificial Sequence
  Synthetic Construct
AQQRVPAYQAQ

SEQ ID NO: 7776 - protein, 11 aa, Artificial Sequence
  Synthetic Construct
AQSDVSKVYAQ

SEQ ID NO: 7777 - protein, 11 aa, Artificial Sequence
  Synthetic Construct
AQSNTGEQVAQ

SEQ ID NO: 7778 - protein, 11 aa, Artificial Sequence
  Synthetic Construct
AQFTTGLNHAQ

SEQ ID NO: 7779 - protein, 11 aa, Artificial Sequence
  Synthetic Construct
AQNDTQYKHAQ

SEQ ID NO: 7780 - protein, 11 aa, Artificial Sequence
  Synthetic Construct
AQVHDVKGIAQ

SEQ ID NO: 7781 - protein, 11 aa, Artificial Sequence
  Synthetic Construct
AQYGGRDSYAQ

SEQ ID NO: 7782 - protein, 11 aa, Artificial Sequence
  Synthetic Construct
AQHSTATTHAQ

SEQ ID NO: 7783 - protein, 11 aa, Artificial Sequence
  Synthetic Construct
AQPSPTTRTAQ

SEQ ID NO: 7784 - protein, 11 aa, Artificial Sequence
  Synthetic Construct
AQGHAEAAMAQ

SEQ ID NO: 7785 - protein, 11 aa, Artificial Sequence
  Synthetic Construct
AQSLSTRPVAQ

SEQ ID NO: 7786 - protein, 11 aa, Artificial Sequence
  Synthetic Construct
AQSPVPGKPAQ

SEQ ID NO: 7787 - protein, 11 aa, Artificial Sequence
  Synthetic Construct
AQTRINSPLAQ

SEQ ID NO: 7788 - protein, 11 aa, Artificial Sequence
  Synthetic Construct
AQESTYAKLAQ

SEQ ID NO: 7789 - protein, 11 aa, Artificial Sequence
  Synthetic Construct
AQQINQGTRAQ

SEQ ID NO: 7790 - protein, 11 aa, Artificial Sequence
  Synthetic Construct
AQGSRTGSIAQ

SEQ ID NO: 7791 - protein, 11 aa, Artificial Sequence
  Synthetic Construct
AQGNASWSAAQ

SEQ ID NO: 7792 - protein, 11 aa, Artificial Sequence
  Synthetic Construct
AQAAHDIGKAQ

SEQ ID NO: 7793 - protein, 11 aa, Artificial Sequence
  Synthetic Construct
AQKDRPFVEAQ

SEQ ID NO: 7794 - protein, 11 aa, Artificial Sequence
  Synthetic Construct
AQLPHTKPFAQ

SEQ ID NO: 7795 - protein, 11 aa, Artificial Sequence
  Synthetic Construct
AQPGKGVSLAQ

SEQ ID NO: 7796 - protein, 11 aa, Artificial Sequence
  Synthetic Construct
AQDRQNASAAQ

SEQ ID NO: 7797 - protein, 11 aa, Artificial Sequence
  Synthetic Construct
AQVQPSLSVAQ

SEQ ID NO: 7798 - protein, 11 aa, Artificial Sequence
  Synthetic Construct
AQKPTPIEFAQ

SEQ ID NO: 7799 - protein, 11 aa, Artificial Sequence
  Synthetic Construct
AQLLHDMKSAQ

SEQ ID NO: 7800 - protein, 11 aa, Artificial Sequence
  Synthetic Construct
AQNSDRTLSAQ

SEQ ID NO: 7801 - protein, 11 aa, Artificial Sequence
  Synthetic Construct
AQKVGHGFNAQ

SEQ ID NO: 7802 - protein, 11 aa, Artificial Sequence
  Synthetic Construct
AQTKPAVSFAQ

SEQ ID NO: 7803 - protein, 11 aa, Artificial Sequence
  Synthetic Construct
AQAMTNIPKAQ

SEQ ID NO: 7804 - protein, 11 aa, Artificial Sequence
  Synthetic Construct
AQFSHMSLPAQ

SEQ ID NO: 7805 - protein, 11 aa, Artificial Sequence
  Synthetic Construct
AQGSVRDNPAQ

SEQ ID NO: 7806 - protein, 11 aa, Artificial Sequence
  Synthetic Construct
AQSSSQGPTAQ

SEQ ID NO: 7807 - protein, 11 aa, Artificial Sequence
  Synthetic Construct
AQLVGRPVTAQ

SEQ ID NO: 7808 - protein, 11 aa, Artificial Sequence
  Synthetic Construct
AQINYGVQKAQ

SEQ ID NO: 7809 - protein, 11 aa, Artificial Sequence
  Synthetic Construct
AQINKDNNQAQ

SEQ ID NO: 7810 - protein, 11 aa, Artificial Sequence
  Synthetic Construct
AQSGQSSAMAQ

SEQ ID NO: 7811 - protein, 11 aa, Artificial Sequence
  Synthetic Construct
AQEYNSTKLAQ

SEQ ID NO: 7812 - protein, 11 aa, Artificial Sequence
  Synthetic Construct
AQFMTLERAAQ

SEQ ID NO: 7813 - protein, 11 aa, Artificial Sequence
  Synthetic Construct
AQFGKDYVNAQ

SEQ ID NO: 7814 - protein, 11 aa, Artificial Sequence
  Synthetic Construct
AQLLLGGTPAQ

SEQ ID NO: 7815 - protein, 11 aa, Artificial Sequence
  Synthetic Construct
AQTTTYTRNAQ

SEQ ID NO: 7816 - protein, 11 aa, Artificial Sequence
  Synthetic Construct
AQDRGMRGAAQ

SEQ ID NO: 7817 - protein, 11 aa, Artificial Sequence
  Synthetic Construct
AQAVSGTRTAQ

SEQ ID NO: 7818 - protein, 11 aa, Artificial Sequence
  Synthetic Construct
AQNFSGVAKAQ

SEQ ID NO: 7819 - protein, 11 aa, Artificial Sequence
  Synthetic Construct
AQDRNNSISAQ

SEQ ID NO: 7820 - protein, 11 aa, Artificial Sequence
  Synthetic Construct
AQIPQRPLDAQ

SEQ ID NO: 7821 - protein, 11 aa, Artificial Sequence
  Synthetic Construct
AQPAANQYVAQ

SEQ ID NO: 7822 - protein, 11 aa, Artificial Sequence
  Synthetic Construct
AQYSGTAIRAQ

SEQ ID NO: 7823 - protein, 11 aa, Artificial Sequence
  Synthetic Construct
AQWVQRTESAQ

SEQ ID NO: 7824 - protein, 11 aa, Artificial Sequence
  Synthetic Construct
AQPKDGGAIAQ

SEQ ID NO: 7825 - protein, 11 aa, Artificial Sequence
  Synthetic Construct
AQLATPQEEAQ

SEQ ID NO: 7826 - protein, 11 aa, Artificial Sequence
  Synthetic Construct
AQLNSPVMAAQ

SEQ ID NO: 7827 - protein, 11 aa, Artificial Sequence
  Synthetic Construct
AQGATGTRAAQ

SEQ ID NO: 7828 - protein, 11 aa, Artificial Sequence
  Synthetic Construct
AQRTDVRTNAQ

SEQ ID NO: 7829 - protein, 11 aa, Artificial Sequence
  Synthetic Construct
AQRNLAHPYAQ

SEQ ID NO: 7830 - protein, 11 aa, Artificial Sequence
  Synthetic Construct
AQLSTSYSTAQ

SEQ ID NO: 7831 - protein, 11 aa, Artificial Sequence
  Synthetic Construct
AQGVNQTARAQ

SEQ ID NO: 7832 - protein, 11 aa, Artificial Sequence
  Synthetic Construct
AQLPASSARAQ

SEQ ID NO: 7833 - protein, 11 aa, Artificial Sequence
  Synthetic Construct
AQQLYSVNAAQ

SEQ ID NO: 7834 - protein, 11 aa, Artificial Sequence
  Synthetic Construct
AQVGTYTATAQ

SEQ ID NO: 7835 - protein, 11 aa, Artificial Sequence
  Synthetic Construct
AQRSMTVIEAQ

SEQ ID NO: 7836 - protein, 11 aa, Artificial Sequence
  Synthetic Construct
AQFGRGDTGAQ

SEQ ID NO: 7837 - protein, 11 aa, Artificial Sequence
  Synthetic Construct
AQAAGRSNPAQ

SEQ ID NO: 7838 - protein, 11 aa, Artificial Sequence
  Synthetic Construct
AQMPQSSLAAQ

SEQ ID NO: 7839 - protein, 11 aa, Artificial Sequence
  Synthetic Construct
AQPSKHERYAQ

SEQ ID NO: 7840 - protein, 11 aa, Artificial Sequence
  Synthetic Construct
AQLFDSSKTAQ

SEQ ID NO: 7841 - protein, 11 aa, Artificial Sequence
  Synthetic Construct
AQSPQPRLSAQ

SEQ ID NO: 7842 - protein, 11 aa, Artificial Sequence
  Synthetic Construct
AQRRPDVENAQ

SEQ ID NO: 7843 - protein, 11 aa, Artificial Sequence
  Synthetic Construct
AQPMGSAGSAQ

SEQ ID NO: 7844 - protein, 11 aa, Artificial Sequence
  Synthetic Construct
AQWSTGMTSAQ

SEQ ID NO: 7845 - protein, 11 aa, Artificial Sequence
  Synthetic Construct
AQGLVRNGVAQ

SEQ ID NO: 7846 - protein, 11 aa, Artificial Sequence
  Synthetic Construct
AQEGSYSTSAQ

SEQ ID NO: 7847 - protein, 11 aa, Artificial Sequence
  Synthetic Construct
AQATSMLTHAQ

SEQ ID NO: 7848 - protein, 11 aa, Artificial Sequence
  Synthetic Construct
AQSTTGPPSAQ

SEQ ID NO: 7849 - protein, 11 aa, Artificial Sequence
  Synthetic Construct
AQRGASVSMAQ

SEQ ID NO: 7850 - protein, 11 aa, Artificial Sequence
  Synthetic Construct
AQVHEHGASAQ

SEQ ID NO: 7851 - protein, 11 aa, Artificial Sequence
  Synthetic Construct
AQHSPSQPRAQ

SEQ ID NO: 7852 - protein, 11 aa, Artificial Sequence
  Synthetic Construct
AQGIGQNTAAQ

SEQ ID NO: 7853 - protein, 11 aa, Artificial Sequence
  Synthetic Construct
AQHRVENSYAQ

SEQ ID NO: 7854 - protein, 11 aa, Artificial Sequence
  Synthetic Construct
AQTEFKPPSAQ

SEQ ID NO: 7855 - protein, 11 aa, Artificial Sequence
  Synthetic Construct
AQYGNLGVNAQ

SEQ ID NO: 7856 - protein, 11 aa, Artificial Sequence
  Synthetic Construct
AQLTRVLTGAQ

SEQ ID NO: 7857 - protein, 11 aa, Artificial Sequence
  Synthetic Construct
AQMKNSNGAAQ

SEQ ID NO: 7858 - protein, 11 aa, Artificial Sequence
  Synthetic Construct
AQGTQTHLQAQ

SEQ ID NO: 7859 - protein, 11 aa, Artificial Sequence
  Synthetic Construct
AQNALARTMAQ

SEQ ID NO: 7860 - protein, 11 aa, Artificial Sequence
  Synthetic Construct
AQNNSMQTVAQ

SEQ ID NO: 7861 - protein, 11 aa, Artificial Sequence
  Synthetic Construct
AQQQGNGRSAQ

SEQ ID NO: 7862 - protein, 11 aa, Artificial Sequence
  Synthetic Construct
AQLTKSQGYAQ

SEQ ID NO: 7863 - protein, 11 aa, Artificial Sequence
  Synthetic Construct
AQAPAEPKTAQ

SEQ ID NO: 7864 - protein, 11 aa, Artificial Sequence
  Synthetic Construct
AQYSNQVSNAQ

SEQ ID NO: 7865 - protein, 11 aa, Artificial Sequence
  Synthetic Construct
AQTRTGFSPAQ

SEQ ID NO: 7866 - protein, 11 aa, Artificial Sequence
  Synthetic Construct
AQPVYKTDDAQ

SEQ ID NO: 7867 - protein, 11 aa, Artificial Sequence
  Synthetic Construct
AQSDRPAPEAQ

SEQ ID NO: 7868 - protein, 11 aa, Artificial Sequence
  Synthetic Construct
AQVQEKSRPAQ

SEQ ID NO: 7869 - protein, 11 aa, Artificial Sequence
  Synthetic Construct
AQSGGLTERAQ

SEQ ID NO: 7870 - protein, 11 aa, Artificial Sequence
  Synthetic Construct
AQSGGTREGAQ

SEQ ID NO: 7871 - protein, 11 aa, Artificial Sequence
  Synthetic Construct
AQAVPGETRAQ

SEQ ID NO: 7872 - protein, 11 aa, Artificial Sequence
  Synthetic Construct
AQPRPERMYAQ

SEQ ID NO: 7873 - protein, 11 aa, Artificial Sequence
  Synthetic Construct
AQSNGNISRAQ

SEQ ID NO: 7874 - protein, 11 aa, Artificial Sequence
  Synthetic Construct
AQARTERNQAQ

SEQ ID NO: 7875 - protein, 11 aa, Artificial Sequence
  Synthetic Construct
AQSPQQFSKAQ

SEQ ID NO: 7876 - protein, 11 aa, Artificial Sequence
  Synthetic Construct
AQSTGPFPQAQ

SEQ ID NO: 7877 - protein, 11 aa, Artificial Sequence
  Synthetic Construct
AQANIGTSTAQ

SEQ ID NO: 7878 - protein, 11 aa, Artificial Sequence
  Synthetic Construct
AQYRDNTSGAQ

SEQ ID NO: 7879 - protein, 11 aa, Artificial Sequence
  Synthetic Construct
AQVQTRSPMAQ

SEQ ID NO: 7880 - protein, 11 aa, Artificial Sequence
  Synthetic Construct
AQIHTSIVDAQ

SEQ ID NO: 7881 - protein, 11 aa, Artificial Sequence
  Synthetic Construct
AQMTRTSSEAQ

SEQ ID NO: 7882 - protein, 11 aa, Artificial Sequence
  Synthetic Construct
AQPSNFPGSAQ

SEQ ID NO: 7883 - protein, 11 aa, Artificial Sequence
  Synthetic Construct
AQMIGGTQSAQ

SEQ ID NO: 7884 - protein, 11 aa, Artificial Sequence
  Synthetic Construct
AQKLDKHESAQ

SEQ ID NO: 7885 - protein, 11 aa, Artificial Sequence
  Synthetic Construct
AQLTSSNSAAQ

SEQ ID NO: 7886 - protein, 11 aa, Artificial Sequence
  Synthetic Construct
AQSTRDTHFAQ

SEQ ID NO: 7887 - protein, 11 aa, Artificial Sequence
  Synthetic Construct
AQDTLKAVRAQ

SEQ ID NO: 7888 - protein, 11 aa, Artificial Sequence
  Synthetic Construct
AQQRNPSLHAQ

SEQ ID NO: 7889 - protein, 11 aa, Artificial Sequence
  Synthetic Construct
AQSGDGNRSAQ

SEQ ID NO: 7890 - protein, 11 aa, Artificial Sequence
  Synthetic Construct
AQGVYKTLHAQ

SEQ ID NO: 7891 - protein, 11 aa, Artificial Sequence
  Synthetic Construct
AQINSNQVSAQ

SEQ ID NO: 7892 - protein, 11 aa, Artificial Sequence
  Synthetic Construct
AQHYNEHMTAQ

SEQ ID NO: 7893 - protein, 11 aa, Artificial Sequence
  Synthetic Construct
AQTVQVRDRAQ

SEQ ID NO: 7894 - protein, 11 aa, Artificial Sequence
  Synthetic Construct
AQGNDIRSRAQ

SEQ ID NO: 7895 - protein, 11 aa, Artificial Sequence
  Synthetic Construct
AQVSVSMGPAQ

SEQ ID NO: 7896 - protein, 11 aa, Artificial Sequence
  Synthetic Construct
AQFKTNISAAQ

SEQ ID NO: 7897 - protein, 11 aa, Artificial Sequence
  Synthetic Construct
AQFPKVERYAQ

SEQ ID NO: 7898 - protein, 11 aa, Artificial Sequence
  Synthetic Construct
AQLSKFQTTAQ

SEQ ID NO: 7899 - protein, 11 aa, Artificial Sequence
  Synthetic Construct
AQSLMNSRSAQ

SEQ ID NO: 7900 - protein, 11 aa, Artificial Sequence
  Synthetic Construct
AQGRGVLESAQ

SEQ ID NO: 7901 - protein, 11 aa, Artificial Sequence
  Synthetic Construct
AQPNGSQMIAQ

SEQ ID NO: 7902 - protein, 11 aa, Artificial Sequence
  Synthetic Construct
AQPTVGNSYAQ

SEQ ID NO: 7903 - protein, 11 aa, Artificial Sequence
  Synthetic Construct
AQSSDIMKAAQ

SEQ ID NO: 7904 - protein, 11 aa, Artificial Sequence
  Synthetic Construct
AQLMTSAGRAQ

SEQ ID NO: 7905 - protein, 11 aa, Artificial Sequence
  Synthetic Construct
AQPAMSSSRAQ

SEQ ID NO: 7906 - protein, 11 aa, Artificial Sequence
  Synthetic Construct
AQRDKAISTAQ

SEQ ID NO: 7907 - protein, 11 aa, Artificial Sequence
  Synthetic Construct
AQLTLKQGIAQ

SEQ ID NO: 7908 - protein, 11 aa, Artificial Sequence
  Synthetic Construct
AQSHANGFSAQ

SEQ ID NO: 7909 - protein, 11 aa, Artificial Sequence
  Synthetic Construct
AQPNLKAPQAQ

SEQ ID NO: 7910 - protein, 11 aa, Artificial Sequence
  Synthetic Construct
AQSYGREVRAQ

SEQ ID NO: 7911 - protein, 11 aa, Artificial Sequence
  Synthetic Construct
AQNDTQSPKAQ

SEQ ID NO: 7912 - protein, 11 aa, Artificial Sequence
  Synthetic Construct
AQDERAPKHAQ

SEQ ID NO: 7913 - protein, 11 aa, Artificial Sequence
  Synthetic Construct
AQNGRPMGMAQ

SEQ ID NO: 7914 - protein, 11 aa, Artificial Sequence
  Synthetic Construct
AQHTQSVTMAQ

SEQ ID NO: 7915 - protein, 11 aa, Artificial Sequence
  Synthetic Construct
AQNNFNASLAQ

SEQ ID NO: 7916 - protein, 11 aa, Artificial Sequence
  Synthetic Construct
AQEYLKGSAAQ

SEQ ID NO: 7917 - protein, 11 aa, Artificial Sequence
  Synthetic Construct
AQSKTPDMLAQ

SEQ ID NO: 7918 - protein, 11 aa, Artificial Sequence
  Synthetic Construct
AQVNTGHVRAQ

SEQ ID NO: 7919 - protein, 11 aa, Artificial Sequence
  Synthetic Construct
AQGSQSDARAQ

SEQ ID NO: 7920 - protein, 11 aa, Artificial Sequence
  Synthetic Construct
AQSLTFSKDAQ

SEQ ID NO: 7921 - protein, 11 aa, Artificial Sequence
  Synthetic Construct
AQNALESRMAQ

SEQ ID NO: 7922 - protein, 11 aa, Artificial Sequence
  Synthetic Construct
AQNGIAREPAQ

SEQ ID NO: 7923 - protein, 11 aa, Artificial Sequence
  Synthetic Construct
AQNLVSVSTAQ

SEQ ID NO: 7924 - protein, 11 aa, Artificial Sequence
  Synthetic Construct
AQDMLSYKPAQ

SEQ ID NO: 7925 - protein, 11 aa, Artificial Sequence
  Synthetic Construct
AQRSTDSMTAQ

SEQ ID NO: 7926 - protein, 11 aa, Artificial Sequence
  Synthetic Construct
AQEMNHSLSAQ

SEQ ID NO: 7927 - protein, 11 aa, Artificial Sequence
  Synthetic Construct
AQALSKEASAQ

SEQ ID NO: 7928 - protein, 11 aa, Artificial Sequence
  Synthetic Construct
AQNGHNMSQAQ

SEQ ID NO: 7929 - protein, 11 aa, Artificial Sequence
  Synthetic Construct
AQTTAEATRAQ

SEQ ID NO: 7930 - protein, 11 aa, Artificial Sequence
  Synthetic Construct
AQRESAHHNAQ

SEQ ID NO: 7931 - protein, 11 aa, Artificial Sequence
  Synthetic Construct
AQMFTGNGQAQ

SEQ ID NO: 7932 - protein, 11 aa, Artificial Sequence
  Synthetic Construct
AQHLQTPPAAQ

SEQ ID NO: 7933 - protein, 11 aa, Artificial Sequence
  Synthetic Construct
AQSLVGQGKAQ

SEQ ID NO: 7934 - protein, 11 aa, Artificial Sequence
  Synthetic Construct
AQLPLTPIAAQ

SEQ ID NO: 7935 - protein, 11 aa, Artificial Sequence
  Synthetic Construct
AQAMKQSSIAQ

SEQ ID NO: 7936 - protein, 11 aa, Artificial Sequence
  Synthetic Construct
AQYPTNVKSAQ

SEQ ID NO: 7937 - protein, 11 aa, Artificial Sequence
  Synthetic Construct
AQSNSLPSRAQ

SEQ ID NO: 7938 - protein, 11 aa, Artificial Sequence
  Synthetic Construct
AQPTAATGTAQ

SEQ ID NO: 7939 - protein, 11 aa, Artificial Sequence
  Synthetic Construct
AQIAQNGPGAQ

SEQ ID NO: 7940 - protein, 11 aa, Artificial Sequence
  Synthetic Construct
AQTTHQLTPAQ

SEQ ID NO: 7941 - protein, 11 aa, Artificial Sequence
  Synthetic Construct
AQLIPARDVAQ

SEQ ID NO: 7942 - protein, 11 aa, Artificial Sequence
  Synthetic Construct
AQKIAHGDIAQ

SEQ ID NO: 7943 - protein, 11 aa, Artificial Sequence
  Synthetic Construct
AQARPQSDKAQ

SEQ ID NO: 7944 - protein, 11 aa, Artificial Sequence
  Synthetic Construct
AQPRPNVLDAQ

SEQ ID NO: 7945 - protein, 11 aa, Artificial Sequence
  Synthetic Construct
AQLNKGSSNAQ

SEQ ID NO: 7946 - protein, 11 aa, Artificial Sequence
  Synthetic Construct
AQRVYNGDLAQ

SEQ ID NO: 7947 - protein, 11 aa, Artificial Sequence
  Synthetic Construct
AQTVPANSSAQ

SEQ ID NO: 7948 - protein, 11 aa, Artificial Sequence
  Synthetic Construct
AQTRHTSLTAQ

SEQ ID NO: 7949 - protein, 11 aa, Artificial Sequence
  Synthetic Construct
AQNHAVTNSAQ

SEQ ID NO: 7950 - protein, 11 aa, Artificial Sequence
  Synthetic Construct
AQLASHSTLAQ

SEQ ID NO: 7951 - protein, 11 aa, Artificial Sequence
  Synthetic Construct
AQVAFKSGIAQ

SEQ ID NO: 7952 - protein, 11 aa, Artificial Sequence
  Synthetic Construct
AQRVGPESSAQ

SEQ ID NO: 7953 - protein, 11 aa, Artificial Sequence
  Synthetic Construct
AQAPSNVHTAQ

SEQ ID NO: 7954 - protein, 11 aa, Artificial Sequence
  Synthetic Construct
AQTRSEVMKAQ

SEQ ID NO: 7955 - protein, 11 aa, Artificial Sequence
  Synthetic Construct
AQLKEQHGGAQ

SEQ ID NO: 7956 - protein, 11 aa, Artificial Sequence
  Synthetic Construct
AQKAESHATAQ

SEQ ID NO: 7957 - protein, 11 aa, Artificial Sequence
  Synthetic Construct
AQYRTDMLSAQ

SEQ ID NO: 7958 - protein, 11 aa, Artificial Sequence
  Synthetic Construct
AQDTQGRMRAQ

SEQ ID NO: 7959 - protein, 11 aa, Artificial Sequence
  Synthetic Construct
AQCLPKGCTAQ

SEQ ID NO: 7960 - protein, 11 aa, Artificial Sequence
  Synthetic Construct
AQGSPTVVHAQ

SEQ ID NO: 7961 - protein, 11 aa, Artificial Sequence
  Synthetic Construct
AQLSLSTQRAQ

SEQ ID NO: 7962 - protein, 11 aa, Artificial Sequence
  Synthetic Construct
AQNMAQNARAQ

SEQ ID NO: 7963 - protein, 11 aa, Artificial Sequence
  Synthetic Construct
AQLSTNVLLAQ

SEQ ID NO: 7964 - protein, 11 aa, Artificial Sequence
  Synthetic Construct
AQTSPVIRTAQ

SEQ ID NO: 7965 - protein, 11 aa, Artificial Sequence
  Synthetic Construct
AQPSAGHVLAQ

SEQ ID NO: 7966 - protein, 11 aa, Artificial Sequence
  Synthetic Construct
AQLSGTATSAQ

SEQ ID NO: 7967 - protein, 11 aa, Artificial Sequence
  Synthetic Construct
AQTGNPNPTAQ

SEQ ID NO: 7968 - protein, 11 aa, Artificial Sequence
  Synthetic Construct
AQQFEHSLPAQ

SEQ ID NO: 7969 - protein, 11 aa, Artificial Sequence
  Synthetic Construct
AQLTPGQIRAQ

SEQ ID NO: 7970 - protein, 11 aa, Artificial Sequence
  Synthetic Construct
AQLMNAKTTAQ

SEQ ID NO: 7971 - protein, 11 aa, Artificial Sequence
  Synthetic Construct
AQQRDTNMAAQ

SEQ ID NO: 7972 - protein, 11 aa, Artificial Sequence
  Synthetic Construct
AQNLLEIGRAQ

SEQ ID NO: 7973 - protein, 11 aa, Artificial Sequence
  Synthetic Construct
AQDVKDKQIAQ

SEQ ID NO: 7974 - protein, 11 aa, Artificial Sequence
  Synthetic Construct
AQVTISNKPAQ

SEQ ID NO: 7975 - protein, 11 aa, Artificial Sequence
  Synthetic Construct
AQSTPINSRAQ

SEQ ID NO: 7976 - protein, 11 aa, Artificial Sequence
  Synthetic Construct
AQGTHGLTSAQ

SEQ ID NO: 7977 - protein, 11 aa, Artificial Sequence
  Synthetic Construct
AQQSPGMIHAQ

SEQ ID NO: 7978 - protein, 11 aa, Artificial Sequence
  Synthetic Construct
AQQTGPVLSAQ

SEQ ID NO: 7979 - protein, 11 aa, Artificial Sequence
  Synthetic Construct
AQTYVSSGPAQ

SEQ ID NO: 7980 - protein, 11 aa, Artificial Sequence
  Synthetic Construct
AQTSTLPRLAQ

SEQ ID NO: 7981 - protein, 11 aa, Artificial Sequence
  Synthetic Construct
AQYTHKDNDAQ

SEQ ID NO: 7982 - protein, 11 aa, Artificial Sequence
  Synthetic Construct
AQLGAQSTLAQ

SEQ ID NO: 7983 - protein, 11 aa, Artificial Sequence
  Synthetic Construct
AQLAQVRPAAQ

SEQ ID NO: 7984 - protein, 11 aa, Artificial Sequence
  Synthetic Construct
AQGRVVASNAQ

SEQ ID NO: 7985 - protein, 11 aa, Artificial Sequence
  Synthetic Construct
AQSNRVRDLAQ

SEQ ID NO: 7986 - protein, 11 aa, Artificial Sequence
  Synthetic Construct
AQERDREKLAQ

SEQ ID NO: 7987 - protein, 11 aa, Artificial Sequence
  Synthetic Construct
AQKSGTSSTAQ

SEQ ID NO: 7988 - protein, 11 aa, Artificial Sequence
  Synthetic Construct
AQAGQSTIYAQ

SEQ ID NO: 7989 - protein, 11 aa, Artificial Sequence
  Synthetic Construct
AQEFSQPRLAQ

SEQ ID NO: 7990 - protein, 11 aa, Artificial Sequence
  Synthetic Construct
AQTYARSDKAQ

SEQ ID NO: 7991 - protein, 11 aa, Artificial Sequence
  Synthetic Construct
AQGKFNGHTAQ

SEQ ID NO: 7992 - protein, 11 aa, Artificial Sequence
  Synthetic Construct
AQRLISNGNAQ

SEQ ID NO: 7993 - protein, 11 aa, Artificial Sequence
  Synthetic Construct
AQLKESLGPAQ

SEQ ID NO: 7994 - protein, 11 aa, Artificial Sequence
  Synthetic Construct
AQNRHTLAVAQ

SEQ ID NO: 7995 - protein, 11 aa, Artificial Sequence
  Synthetic Construct
AQRDTRLSAAQ

SEQ ID NO: 7996 - protein, 11 aa, Artificial Sequence
  Synthetic Construct
AQVSRLGSIAQ

SEQ ID NO: 7997 - protein, 11 aa, Artificial Sequence
  Synthetic Construct
AQLTTSVISAQ

SEQ ID NO: 7998 - protein, 11 aa, Artificial Sequence
  Synthetic Construct
AQFKGVAHIAQ

SEQ ID NO: 7999 - protein, 11 aa, Artificial Sequence
  Synthetic Construct
AQKTTEALPAQ

SEQ ID NO: 8000 - protein, 11 aa, Artificial Sequence
  Synthetic Construct
AQRNQHDTTAQ

SEQ ID NO: 8001 - protein, 11 aa, Artificial Sequence
  Synthetic Construct
AQNKLLPRSAQ

SEQ ID NO: 8002 - protein, 11 aa, Artificial Sequence
  Synthetic Construct
AQVNSHERAAQ

SEQ ID NO: 8003 - protein, 11 aa, Artificial Sequence
  Synthetic Construct
AQAKGSLNMAQ

SEQ ID NO: 8004 - protein, 11 aa, Artificial Sequence
  Synthetic Construct
AQVKTDRVLAQ

SEQ ID NO: 8005 - protein, 11 aa, Artificial Sequence
  Synthetic Construct
AQPRSDQIRAQ

SEQ ID NO: 8006 - protein, 11 aa, Artificial Sequence
  Synthetic Construct
AQNRVGTERAQ

SEQ ID NO: 8007 - protein, 11 aa, Artificial Sequence
  Synthetic Construct
AQGVPTAGTAQ

SEQ ID NO: 8008 - protein, 11 aa, Artificial Sequence
  Synthetic Construct
AQSLMKQSHAQ

SEQ ID NO: 8009 - protein, 11 aa, Artificial Sequence
  Synthetic Construct
AQGTSSNIMAQ

SEQ ID NO: 8010 - protein, 11 aa, Artificial Sequence
  Synthetic Construct
AQLRSDISTAQ

SEQ ID NO: 8011 - protein, 11 aa, Artificial Sequence
  Synthetic Construct
AQMTTGRDLAQ

SEQ ID NO: 8012 - protein, 11 aa, Artificial Sequence
  Synthetic Construct
AQSGVANSYAQ

SEQ ID NO: 8013 - protein, 11 aa, Artificial Sequence
  Synthetic Construct
AQAVPSYNNAQ

SEQ ID NO: 8014 - protein, 11 aa, Artificial Sequence
  Synthetic Construct
AQLNGGNSPAQ

SEQ ID NO: 8015 - protein, 11 aa, Artificial Sequence
  Synthetic Construct
AQNSHSTSWAQ

SEQ ID NO: 8016 - protein, 11 aa, Artificial Sequence
  Synthetic Construct
AQMYHTGQVAQ

SEQ ID NO: 8017 - protein, 11 aa, Artificial Sequence
  Synthetic Construct
AQRDKLYIAAQ

SEQ ID NO: 8018 - protein, 11 aa, Artificial Sequence
  Synthetic Construct
AQRKSEAVLAQ

SEQ ID NO: 8019 - protein, 11 aa, Artificial Sequence
  Synthetic Construct
AQHKGIQVIAQ

SEQ ID NO: 8020 - protein, 11 aa, Artificial Sequence
  Synthetic Construct
AQIGKDAPKAQ

SEQ ID NO: 8021 - protein, 11 aa, Artificial Sequence
  Synthetic Construct
AQSLAGLQDAQ

SEQ ID NO: 8022 - protein, 11 aa, Artificial Sequence
  Synthetic Construct
AQFRVSVAEAQ

SEQ ID NO: 8023 - protein, 11 aa, Artificial Sequence
  Synthetic Construct
AQTHKEHSIAQ

SEQ ID NO: 8024 - protein, 11 aa, Artificial Sequence
  Synthetic Construct
AQNSNHTYRAQ

SEQ ID NO: 8025 - protein, 11 aa, Artificial Sequence
  Synthetic Construct
AQFNGVRTVAQ

SEQ ID NO: 8026 - protein, 11 aa, Artificial Sequence
  Synthetic Construct
AQHMGMRDGAQ

SEQ ID NO: 8027 - protein, 11 aa, Artificial Sequence
  Synthetic Construct
AQGQQSMAVAQ

SEQ ID NO: 8028 - protein, 11 aa, Artificial Sequence
  Synthetic Construct
AQWSSQVNRAQ

SEQ ID NO: 8029 - protein, 11 aa, Artificial Sequence
  Synthetic Construct
AQGSHVGMPAQ

SEQ ID NO: 8030 - protein, 11 aa, Artificial Sequence
  Synthetic Construct
AQKGSLTASAQ

SEQ ID NO: 8031 - protein, 11 aa, Artificial Sequence
  Synthetic Construct
AQGAQSNIVAQ

SEQ ID NO: 8032 - protein, 11 aa, Artificial Sequence
  Synthetic Construct
AQNDYNHTRAQ

SEQ ID NO: 8033 - protein, 11 aa, Artificial Sequence
  Synthetic Construct
AQQINPSSVAQ

SEQ ID NO: 8034 - protein, 11 aa, Artificial Sequence
  Synthetic Construct
AQALRGASNAQ

SEQ ID NO: 8035 - protein, 11 aa, Artificial Sequence
  Synthetic Construct
AQSASTMSFAQ

SEQ ID NO: 8036 - protein, 11 aa, Artificial Sequence
  Synthetic Construct
AQLSSNNNNAQ

SEQ ID NO: 8037 - protein, 11 aa, Artificial Sequence
  Synthetic Construct
AQSTTLASKAQ

SEQ ID NO: 8038 - protein, 11 aa, Artificial Sequence
  Synthetic Construct
AQHRMLDGVAQ

SEQ ID NO: 8039 - protein, 11 aa, Artificial Sequence
  Synthetic Construct
AQSSESSTPAQ

SEQ ID NO: 8040 - protein, 11 aa, Artificial Sequence
  Synthetic Construct
AQLYDSSHSAQ

SEQ ID NO: 8041 - protein, 11 aa, Artificial Sequence
  Synthetic Construct
AQGNYNLSVAQ

SEQ ID NO: 8042 - protein, 11 aa, Artificial Sequence
  Synthetic Construct
AQMHNVATVAQ

SEQ ID NO: 8043 - protein, 11 aa, Artificial Sequence
  Synthetic Construct
AQTNYGDSVAQ

SEQ ID NO: 8044 - protein, 11 aa, Artificial Sequence
  Synthetic Construct
AQNRGEDARAQ

SEQ ID NO: 8045 - protein, 11 aa, Artificial Sequence
  Synthetic Construct
AQFGKTAATAQ

SEQ ID NO: 8046 - protein, 11 aa, Artificial Sequence
  Synthetic Construct
AQNTKVNTEAQ

SEQ ID NO: 8047 - protein, 11 aa, Artificial Sequence
  Synthetic Construct
AQVTGHLSSAQ

SEQ ID NO: 8048 - protein, 11 aa, Artificial Sequence
  Synthetic Construct
AQVATSHLKAQ

SEQ ID NO: 8049 - protein, 11 aa, Artificial Sequence
  Synthetic Construct
AQYTPGSDRAQ

SEQ ID NO: 8050 - protein, 11 aa, Artificial Sequence
  Synthetic Construct
AQGFTTVTHAQ

SEQ ID NO: 8051 - protein, 11 aa, Artificial Sequence
  Synthetic Construct
AQAAATSTTAQ

SEQ ID NO: 8052 - protein, 11 aa, Artificial Sequence
  Synthetic Construct
AQANIHVHGAQ

SEQ ID NO: 8053 - protein, 11 aa, Artificial Sequence
  Synthetic Construct
AQYSLRGNDAQ

SEQ ID NO: 8054 - protein, 11 aa, Artificial Sequence
  Synthetic Construct
AQIDQIVQRAQ

SEQ ID NO: 8055 - protein, 11 aa, Artificial Sequence
  Synthetic Construct
AQFNSDLAMAQ

SEQ ID NO: 8056 - protein, 11 aa, Artificial Sequence
  Synthetic Construct
AQNMESQRYAQ

SEQ ID NO: 8057 - protein, 11 aa, Artificial Sequence
  Synthetic Construct
AQPLSSSLSAQ

SEQ ID NO: 8058 - protein, 11 aa, Artificial Sequence
  Synthetic Construct
AQQGTLHAEAQ

SEQ ID NO: 8059 - protein, 11 aa, Artificial Sequence
  Synthetic Construct
AQPDRATALAQ

SEQ ID NO: 8060 - protein, 11 aa, Artificial Sequence
  Synthetic Construct
AQANGKIQLAQ

SEQ ID NO: 8061 - protein, 11 aa, Artificial Sequence
  Synthetic Construct
AQYSKDRHDAQ

SEQ ID NO: 8062 - protein, 11 aa, Artificial Sequence
  Synthetic Construct
AQDSTSRAWAQ

SEQ ID NO: 8063 - protein, 11 aa, Artificial Sequence
  Synthetic Construct
AQGLSVAIPAQ

SEQ ID NO: 8064 - protein, 11 aa, Artificial Sequence
  Synthetic Construct
AQSYLTNHVAQ

SEQ ID NO: 8065 - protein, 11 aa, Artificial Sequence
  Synthetic Construct
AQVITHNMPAQ

SEQ ID NO: 8066 - protein, 11 aa, Artificial Sequence
  Synthetic Construct
AQNRTHVPQAQ

SEQ ID NO: 8067 - protein, 11 aa, Artificial Sequence
  Synthetic Construct
AQLQTTRAVAQ

SEQ ID NO: 8068 - protein, 11 aa, Artificial Sequence
  Synthetic Construct
AQAPNAIDVAQ

SEQ ID NO: 8069 - protein, 11 aa, Artificial Sequence
  Synthetic Construct
AQVRDNTVYAQ

SEQ ID NO: 8070 - protein, 11 aa, Artificial Sequence
  Synthetic Construct
AQTRIGTSLAQ

SEQ ID NO: 8071 - protein, 11 aa, Artificial Sequence
  Synthetic Construct
AQTLTSGNVAQ

SEQ ID NO: 8072 - protein, 11 aa, Artificial Sequence
  Synthetic Construct
AQHLDTMRGAQ

SEQ ID NO: 8073 - protein, 11 aa, Artificial Sequence
  Synthetic Construct
AQLSSTTLNAQ

SEQ ID NO: 8074 - protein, 11 aa, Artificial Sequence
  Synthetic Construct
AQVQSNRTNAQ

SEQ ID NO: 8075 - protein, 11 aa, Artificial Sequence
  Synthetic Construct
AQNNNITTSAQ

SEQ ID NO: 8076 - protein, 11 aa, Artificial Sequence
  Synthetic Construct
AQVGTAGKLAQ

SEQ ID NO: 8077 - protein, 11 aa, Artificial Sequence
  Synthetic Construct
AQPAISTDHAQ

SEQ ID NO: 8078 - protein, 11 aa, Artificial Sequence
  Synthetic Construct
AQSNLGNVPAQ

SEQ ID NO: 8079 - protein, 11 aa, Artificial Sequence
  Synthetic Construct
AQQNQSRFTAQ

SEQ ID NO: 8080 - protein, 11 aa, Artificial Sequence
  Synthetic Construct
AQASKGMTLAQ

SEQ ID NO: 8081 - protein, 11 aa, Artificial Sequence
  Synthetic Construct
AQATAQDKTAQ

SEQ ID NO: 8082 - protein, 11 aa, Artificial Sequence
  Synthetic Construct
AQWDSSSVRAQ

SEQ ID NO: 8083 - protein, 11 aa, Artificial Sequence
  Synthetic Construct
AQTNGSEKSAQ

SEQ ID NO: 8084 - protein, 11 aa, Artificial Sequence
  Synthetic Construct
AQSAENHTYAQ

SEQ ID NO: 8085 - protein, 11 aa, Artificial Sequence
  Synthetic Construct
AQSVPQAYQAQ

SEQ ID NO: 8086 - protein, 11 aa, Artificial Sequence
  Synthetic Construct
AQKDYVVTNAQ

SEQ ID NO: 8087 - protein, 11 aa, Artificial Sequence
  Synthetic Construct
AQVVQMKQTAQ

SEQ ID NO: 8088 - protein, 11 aa, Artificial Sequence
  Synthetic Construct
AQRTLSLTAAQ

SEQ ID NO: 8089 - protein, 11 aa, Artificial Sequence
  Synthetic Construct
AQNTVVGSSAQ

SEQ ID NO: 8090 - protein, 11 aa, Artificial Sequence
  Synthetic Construct
AQSLNSPTTAQ

SEQ ID NO: 8091 - protein, 11 aa, Artificial Sequence
  Synthetic Construct
AQTTGMDVKAQ

SEQ ID NO: 8092 - protein, 11 aa, Artificial Sequence
  Synthetic Construct
AQNNRDTTNAQ

SEQ ID NO: 8093 - protein, 11 aa, Artificial Sequence
  Synthetic Construct
AQWGNYTPTAQ

SEQ ID NO: 8094 - protein, 11 aa, Artificial Sequence
  Synthetic Construct
AQGITRSDTAQ

SEQ ID NO: 8095 - protein, 11 aa, Artificial Sequence
  Synthetic Construct
AQHILRTPEAQ

SEQ ID NO: 8096 - protein, 11 aa, Artificial Sequence
  Synthetic Construct
AQRSASVENAQ

SEQ ID NO: 8097 - protein, 11 aa, Artificial Sequence
  Synthetic Construct
AQSLSLGKGAQ

SEQ ID NO: 8098 - protein, 11 aa, Artificial Sequence
  Synthetic Construct
AQKREVVGDAQ

SEQ ID NO: 8099 - protein, 11 aa, Artificial Sequence
  Synthetic Construct
AQIQPSNHEAQ

SEQ ID NO: 8100 - protein, 11 aa, Artificial Sequence
  Synthetic Construct
AQMNLGNAPAQ

SEQ ID NO: 8101 - protein, 11 aa, Artificial Sequence
  Synthetic Construct
AQQPNNTNSAQ

SEQ ID NO: 8102 - protein, 11 aa, Artificial Sequence
  Synthetic Construct
AQLQSMVQGAQ

SEQ ID NO: 8103 - protein, 11 aa, Artificial Sequence
  Synthetic Construct
AQHGNTTSTAQ

SEQ ID NO: 8104 - protein, 11 aa, Artificial Sequence
  Synthetic Construct
AQIQSTVTLAQ

SEQ ID NO: 8105 - protein, 11 aa, Artificial Sequence
  Synthetic Construct
AQDDRQGPRAQ

SEQ ID NO: 8106 - protein, 11 aa, Artificial Sequence
  Synthetic Construct
AQQTATNILAQ

SEQ ID NO: 8107 - protein, 11 aa, Artificial Sequence
  Synthetic Construct
AQRQHADTVAQ

SEQ ID NO: 8108 - protein, 11 aa, Artificial Sequence
  Synthetic Construct
AQTRSESSLAQ

SEQ ID NO: 8109 - protein, 11 aa, Artificial Sequence
  Synthetic Construct
AQRGHDPAVAQ

SEQ ID NO: 8110 - protein, 11 aa, Artificial Sequence
  Synthetic Construct
AQSTSQTDLAQ

SEQ ID NO: 8111 - protein, 11 aa, Artificial Sequence
  Synthetic Construct
AQVSTSAVLAQ

SEQ ID NO: 8112 - protein, 11 aa, Artificial Sequence
  Synthetic Construct
AQSMPPERFAQ

SEQ ID NO: 8113 - protein, 11 aa, Artificial Sequence
  Synthetic Construct
AQVTSAHPVAQ

SEQ ID NO: 8114 - protein, 11 aa, Artificial Sequence
  Synthetic Construct
AQTSRQVGLAQ

SEQ ID NO: 8115 - protein, 11 aa, Artificial Sequence
  Synthetic Construct
AQTPKFSYEAQ

SEQ ID NO: 8116 - protein, 11 aa, Artificial Sequence
  Synthetic Construct
AQNRMASTMAQ

SEQ ID NO: 8117 - protein, 11 aa, Artificial Sequence
  Synthetic Construct
AQLLDNTRPAQ

SEQ ID NO: 8118 - protein, 11 aa, Artificial Sequence
  Synthetic Construct
AQLTTIPSTAQ

SEQ ID NO: 8119 - protein, 11 aa, Artificial Sequence
  Synthetic Construct
AQANRIRDNAQ

SEQ ID NO: 8120 - protein, 11 aa, Artificial Sequence
  Synthetic Construct
AQPRDIQRTAQ

SEQ ID NO: 8121 - protein, 11 aa, Artificial Sequence
  Synthetic Construct
AQMPHGLKNAQ

SEQ ID NO: 8122 - protein, 11 aa, Artificial Sequence
  Synthetic Construct
AQPFTQNHLAQ

SEQ ID NO: 8123 - protein, 11 aa, Artificial Sequence
  Synthetic Construct
AQNANGNTRAQ

SEQ ID NO: 8124 - protein, 11 aa, Artificial Sequence
  Synthetic Construct
AQLAYSTSAAQ

SEQ ID NO: 8125 - protein, 11 aa, Artificial Sequence
  Synthetic Construct
AQTDRYNIKAQ

SEQ ID NO: 8126 - protein, 11 aa, Artificial Sequence
  Synthetic Construct
AQYVTSAEHAQ

SEQ ID NO: 8127 - protein, 11 aa, Artificial Sequence
  Synthetic Construct
AQSHQQTTVAQ

SEQ ID NO: 8128 - protein, 11 aa, Artificial Sequence
  Synthetic Construct
AQLNMQTRGAQ

SEQ ID NO: 8129 - protein, 11 aa, Artificial Sequence
  Synthetic Construct
AQYTPQLKSAQ

SEQ ID NO: 8130 - protein, 11 aa, Artificial Sequence
  Synthetic Construct
AQQINGQVIAQ

SEQ ID NO: 8131 - protein, 11 aa, Artificial Sequence
  Synthetic Construct
AQTREGVLPAQ

SEQ ID NO: 8132 - protein, 11 aa, Artificial Sequence
  Synthetic Construct
AQVHQSVPLAQ

SEQ ID NO: 8133 - protein, 11 aa, Artificial Sequence
  Synthetic Construct
AQPYSMGHPAQ

SEQ ID NO: 8134 - protein, 11 aa, Artificial Sequence
  Synthetic Construct
AQGTKTHSLAQ

SEQ ID NO: 8135 - protein, 11 aa, Artificial Sequence
  Synthetic Construct
AQTLTTGSKAQ

SEQ ID NO: 8136 - protein, 11 aa, Artificial Sequence
  Synthetic Construct
AQFTIGVTGAQ

SEQ ID NO: 8137 - protein, 11 aa, Artificial Sequence
  Synthetic Construct
AQLSSHNHNAQ

SEQ ID NO: 8138 - protein, 11 aa, Artificial Sequence
  Synthetic Construct
AQTGKMPLEAQ

SEQ ID NO: 8139 - protein, 11 aa, Artificial Sequence
  Synthetic Construct
AQTANPHATAQ

SEQ ID NO: 8140 - protein, 11 aa, Artificial Sequence
  Synthetic Construct
AQHDSVASSAQ

SEQ ID NO: 8141 - protein, 11 aa, Artificial Sequence
  Synthetic Construct
AQTRADVLMAQ

SEQ ID NO: 8142 - protein, 11 aa, Artificial Sequence
  Synthetic Construct
AQANHASNAAQ

SEQ ID NO: 8143 - protein, 11 aa, Artificial Sequence
  Synthetic Construct
AQSHIVGVEAQ

SEQ ID NO: 8144 - protein, 11 aa, Artificial Sequence
  Synthetic Construct
AQYTAQKTSAQ

SEQ ID NO: 8145 - protein, 11 aa, Artificial Sequence
  Synthetic Construct
AQLPAVQKMAQ

SEQ ID NO: 8146 - protein, 11 aa, Artificial Sequence
  Synthetic Construct
AQSGIQTAKAQ

SEQ ID NO: 8147 - protein, 11 aa, Artificial Sequence
  Synthetic Construct
AQDPVKIGHAQ

SEQ ID NO: 8148 - protein, 11 aa, Artificial Sequence
  Synthetic Construct
AQSQTMSKSAQ

SEQ ID NO: 8149 - protein, 11 aa, Artificial Sequence
  Synthetic Construct
AQSLTPTNIAQ

SEQ ID NO: 8150 - protein, 11 aa, Artificial Sequence
  Synthetic Construct
AQYLNNTNSAQ

SEQ ID NO: 8151 - protein, 11 aa, Artificial Sequence
  Synthetic Construct
AQMTRMSQNAQ

SEQ ID NO: 8152 - protein, 11 aa, Artificial Sequence
  Synthetic Construct
AQVNQSLSRAQ

SEQ ID NO: 8153 - protein, 11 aa, Artificial Sequence
  Synthetic Construct
AQRTVTDNRAQ

SEQ ID NO: 8154 - protein, 11 aa, Artificial Sequence
  Synthetic Construct
AQITGVFANAQ

SEQ ID NO: 8155 - protein, 11 aa, Artificial Sequence
  Synthetic Construct
AQSPGLSRVAQ

SEQ ID NO: 8156 - protein, 11 aa, Artificial Sequence
  Synthetic Construct
AQVVNPQTRAQ

SEQ ID NO: 8157 - protein, 11 aa, Artificial Sequence
  Synthetic Construct
AQWSQSLSAAQ

SEQ ID NO: 8158 - protein, 11 aa, Artificial Sequence
  Synthetic Construct
AQPRDASNDAQ

SEQ ID NO: 8159 - protein, 11 aa, Artificial Sequence
  Synthetic Construct
AQYTSMTEFAQ

SEQ ID NO: 8160 - protein, 11 aa, Artificial Sequence
  Synthetic Construct
AQNNSPSPRAQ

SEQ ID NO: 8161 - protein, 11 aa, Artificial Sequence
  Synthetic Construct
AQNSLSHGDAQ

SEQ ID NO: 8162 - protein, 11 aa, Artificial Sequence
  Synthetic Construct
AQRVAGEMAAQ

SEQ ID NO: 8163 - protein, 11 aa, Artificial Sequence
  Synthetic Construct
AQGIGSRELAQ

SEQ ID NO: 8164 - protein, 11 aa, Artificial Sequence
  Synthetic Construct
AQYVSRIRDAQ

SEQ ID NO: 8165 - protein, 11 aa, Artificial Sequence
  Synthetic Construct
AQYPSPNDNAQ

SEQ ID NO: 8166 - protein, 11 aa, Artificial Sequence
  Synthetic Construct
AQLQRTAHNAQ

SEQ ID NO: 8167 - protein, 11 aa, Artificial Sequence
  Synthetic Construct
AQLDSLSRHAQ

SEQ ID NO: 8168 - protein, 11 aa, Artificial Sequence
  Synthetic Construct
AQTKISAGSAQ

SEQ ID NO: 8169 - protein, 11 aa, Artificial Sequence
  Synthetic Construct
AQKDNSPVVAQ

SEQ ID NO: 8170 - protein, 11 aa, Artificial Sequence
  Synthetic Construct
AQTGQGSSLAQ

SEQ ID NO: 8171 - protein, 11 aa, Artificial Sequence
  Synthetic Construct
AQDTHLSRHAQ

SEQ ID NO: 8172 - protein, 11 aa, Artificial Sequence
  Synthetic Construct
AQDIVRRQAAQ

SEQ ID NO: 8173 - protein, 11 aa, Artificial Sequence
  Synthetic Construct
AQAMKYAQTAQ

SEQ ID NO: 8174 - protein, 11 aa, Artificial Sequence
  Synthetic Construct
AQRLADQHPAQ

SEQ ID NO: 8175 - protein, 11 aa, Artificial Sequence
  Synthetic Construct
AQAPDSTRMAQ

SEQ ID NO: 8176 - protein, 11 aa, Artificial Sequence
  Synthetic Construct
AQSRVSPSSAQ

SEQ ID NO: 8177 - protein, 11 aa, Artificial Sequence
  Synthetic Construct
AQVHGQGEPAQ

SEQ ID NO: 8178 - protein, 11 aa, Artificial Sequence
  Synthetic Construct
AQMRDSSTRAQ

SEQ ID NO: 8179 - protein, 11 aa, Artificial Sequence
  Synthetic Construct
AQWPQHTNTAQ

SEQ ID NO: 8180 - protein, 11 aa, Artificial Sequence
  Synthetic Construct
AQVGSYPVTAQ

SEQ ID NO: 8181 - protein, 11 aa, Artificial Sequence
  Synthetic Construct
AQTATQGANAQ

SEQ ID NO: 8182 - protein, 11 aa, Artificial Sequence
  Synthetic Construct
AQKNNSMDSAQ

SEQ ID NO: 8183 - protein, 11 aa, Artificial Sequence
  Synthetic Construct
AQHTNAVKEAQ

SEQ ID NO: 8184 - protein, 11 aa, Artificial Sequence
  Synthetic Construct
AQLHSVTTPAQ

SEQ ID NO: 8185 - protein, 11 aa, Artificial Sequence
  Synthetic Construct
AQAPGQQNFAQ

SEQ ID NO: 8186 - protein, 11 aa, Artificial Sequence
  Synthetic Construct
AQSYTNRTMAQ

SEQ ID NO: 8187 - protein, 11 aa, Artificial Sequence
  Synthetic Construct
AQSGQSNTKAQ

SEQ ID NO: 8188 - protein, 11 aa, Artificial Sequence
  Synthetic Construct
AQDSYRAQSAQ

SEQ ID NO: 8189 - protein, 11 aa, Artificial Sequence
  Synthetic Construct
AQMYKHNSDAQ

SEQ ID NO: 8190 - protein, 11 aa, Artificial Sequence
  Synthetic Construct
AQSLAMVNPAQ

SEQ ID NO: 8191 - protein, 11 aa, Artificial Sequence
  Synthetic Construct
AQPLTSKSMAQ

SEQ ID NO: 8192 - protein, 11 aa, Artificial Sequence
  Synthetic Construct
AQLGAQPTPAQ

SEQ ID NO: 8193 - protein, 11 aa, Artificial Sequence
  Synthetic Construct
AQEGNQKPQAQ

SEQ ID NO: 8194 - protein, 11 aa, Artificial Sequence
  Synthetic Construct
AQQVRPGAHAQ

SEQ ID NO: 8195 - protein, 11 aa, Artificial Sequence
  Synthetic Construct
AQSGNITAMAQ

SEQ ID NO: 8196 - protein, 11 aa, Artificial Sequence
  Synthetic Construct
AQNDSKIAEAQ

SEQ ID NO: 8197 - protein, 11 aa, Artificial Sequence
  Synthetic Construct
AQIMKNEHNAQ

SEQ ID NO: 8198 - protein, 11 aa, Artificial Sequence
  Synthetic Construct
AQLLTNTDRAQ

SEQ ID NO: 8199 - protein, 11 aa, Artificial Sequence
  Synthetic Construct
AQDTAQSRNAQ

SEQ ID NO: 8200 - protein, 11 aa, Artificial Sequence
  Synthetic Construct
AQIDHGKTNAQ

SEQ ID NO: 8201 - protein, 11 aa, Artificial Sequence
  Synthetic Construct
AQTSPRSLLAQ

SEQ ID NO: 8202 - protein, 11 aa, Artificial Sequence
  Synthetic Construct
AQSNPRDSSAQ

SEQ ID NO: 8203 - protein, 11 aa, Artificial Sequence
  Synthetic Construct
AQIMQSIQNAQ

SEQ ID NO: 8204 - protein, 11 aa, Artificial Sequence
  Synthetic Construct
AQKVSPSSTAQ

SEQ ID NO: 8205 - protein, 11 aa, Artificial Sequence
  Synthetic Construct
AQTGPSPSLAQ

SEQ ID NO: 8206 - protein, 11 aa, Artificial Sequence
  Synthetic Construct
AQGAARAQAAQ

SEQ ID NO: 8207 - protein, 11 aa, Artificial Sequence
  Synthetic Construct
AQKFQSPEPAQ

SEQ ID NO: 8208 - protein, 11 aa, Artificial Sequence
  Synthetic Construct
AQMATNSTEAQ

SEQ ID NO: 8209 - protein, 11 aa, Artificial Sequence
  Synthetic Construct
AQNVLTNISAQ

SEQ ID NO: 8210 - protein, 11 aa, Artificial Sequence
  Synthetic Construct
AQKNGMNLVAQ

SEQ ID NO: 8211 - protein, 11 aa, Artificial Sequence
  Synthetic Construct
AQTPTQPSSAQ

SEQ ID NO: 8212 - protein, 11 aa, Artificial Sequence
  Synthetic Construct
AQTKELVIHAQ

SEQ ID NO: 8213 - protein, 11 aa, Artificial Sequence
  Synthetic Construct
AQIMNQSVQAQ

SEQ ID NO: 8214 - protein, 11 aa, Artificial Sequence
  Synthetic Construct
AQVSNARDKAQ

SEQ ID NO: 8215 - protein, 11 aa, Artificial Sequence
  Synthetic Construct
AQSNHTRSYAQ

SEQ ID NO: 8216 - protein, 11 aa, Artificial Sequence
  Synthetic Construct
AQHTDRLNPAQ

SEQ ID NO: 8217 - protein, 11 aa, Artificial Sequence
  Synthetic Construct
AQAAPSMSDAQ

SEQ ID NO: 8218 - protein, 11 aa, Artificial Sequence
  Synthetic Construct
AQFSNTHALAQ

SEQ ID NO: 8219 - protein, 11 aa, Artificial Sequence
  Synthetic Construct
AQAHDLHRVAQ

SEQ ID NO: 8220 - protein, 11 aa, Artificial Sequence
  Synthetic Construct
AQLQVNHVAAQ

SEQ ID NO: 8221 - protein, 11 aa, Artificial Sequence
  Synthetic Construct
AQSGPNLSRAQ

SEQ ID NO: 8222 - protein, 11 aa, Artificial Sequence
  Synthetic Construct
AQTYTSTPGAQ

SEQ ID NO: 8223 - protein, 11 aa, Artificial Sequence
  Synthetic Construct
AQYGTPPSTAQ

SEQ ID NO: 8224 - protein, 11 aa, Artificial Sequence
  Synthetic Construct
AQYGVSSGSAQ

SEQ ID NO: 8225 - protein, 11 aa, Artificial Sequence
  Synthetic Construct
AQPTRDLMSAQ

SEQ ID NO: 8226 - protein, 11 aa, Artificial Sequence
  Synthetic Construct
AQKIDAMTQAQ

SEQ ID NO: 8227 - protein, 11 aa, Artificial Sequence
  Synthetic Construct
AQRIGTSEVAQ

SEQ ID NO: 8228 - protein, 11 aa, Artificial Sequence
  Synthetic Construct
AQFDPLQSSAQ

SEQ ID NO: 8229 - protein, 11 aa, Artificial Sequence
  Synthetic Construct
AQLLHHVEVAQ

SEQ ID NO: 8230 - protein, 11 aa, Artificial Sequence
  Synthetic Construct
AQVTLGNSVAQ

SEQ ID NO: 8231 - protein, 11 aa, Artificial Sequence
  Synthetic Construct
AQLLNDRSVAQ

SEQ ID NO: 8232 - protein, 11 aa, Artificial Sequence
  Synthetic Construct
AQFVDRRPQAQ

SEQ ID NO: 8233 - protein, 11 aa, Artificial Sequence
  Synthetic Construct
AQTNVTTTTAQ

SEQ ID NO: 8234 - protein, 11 aa, Artificial Sequence
  Synthetic Construct
AQDETNKRWAQ

SEQ ID NO: 8235 - protein, 11 aa, Artificial Sequence
  Synthetic Construct
AQTSTSAIRAQ

SEQ ID NO: 8236 - protein, 11 aa, Artificial Sequence
  Synthetic Construct
AQGTSRVQGAQ

SEQ ID NO: 8237 - protein, 11 aa, Artificial Sequence
  Synthetic Construct
AQLNTMALPAQ

SEQ ID NO: 8238 - protein, 11 aa, Artificial Sequence
  Synthetic Construct
AQSTHATDRAQ

SEQ ID NO: 8239 - protein, 11 aa, Artificial Sequence
  Synthetic Construct
AQHHGVTSGAQ

SEQ ID NO: 8240 - protein, 11 aa, Artificial Sequence
  Synthetic Construct
AQGLMANNPAQ

SEQ ID NO: 8241 - protein, 11 aa, Artificial Sequence
  Synthetic Construct
AQGSSSNSFAQ

SEQ ID NO: 8242 - protein, 11 aa, Artificial Sequence
  Synthetic Construct
AQREKMTLLAQ

SEQ ID NO: 8243 - protein, 11 aa, Artificial Sequence
  Synthetic Construct
AQSPVSSDSAQ

SEQ ID NO: 8244 - protein, 11 aa, Artificial Sequence
  Synthetic Construct
AQDVAHKDRAQ

SEQ ID NO: 8245 - protein, 11 aa, Artificial Sequence
  Synthetic Construct
AQSMVSNIAAQ

SEQ ID NO: 8246 - protein, 11 aa, Artificial Sequence
  Synthetic Construct
AQMMHNMQSAQ

SEQ ID NO: 8247 - protein, 11 aa, Artificial Sequence
  Synthetic Construct
AQVSNSSRMAQ

SEQ ID NO: 8248 - protein, 11 aa, Artificial Sequence
  Synthetic Construct
AQYTATKASAQ

SEQ ID NO: 8249 - protein, 11 aa, Artificial Sequence
  Synthetic Construct
AQSTSGGVRAQ

SEQ ID NO: 8250 - protein, 11 aa, Artificial Sequence
  Synthetic Construct
AQFTRAEPAAQ

SEQ ID NO: 8251 - protein, 11 aa, Artificial Sequence
  Synthetic Construct
AQPITRGTIAQ

SEQ ID NO: 8252 - protein, 11 aa, Artificial Sequence
  Synthetic Construct
AQYHNSMLGAQ

SEQ ID NO: 8253 - protein, 11 aa, Artificial Sequence
  Synthetic Construct
AQSNSPGNAAQ

SEQ ID NO: 8254 - protein, 11 aa, Artificial Sequence
  Synthetic Construct
AQQKGVQLPAQ

SEQ ID NO: 8255 - protein, 11 aa, Artificial Sequence
  Synthetic Construct
AQRSETNNTAQ

SEQ ID NO: 8256 - protein, 11 aa, Artificial Sequence
  Synthetic Construct
AQVDQMLAPAQ

SEQ ID NO: 8257 - protein, 11 aa, Artificial Sequence
  Synthetic Construct
AQQTRHTSMAQ

SEQ ID NO: 8258 - protein, 11 aa, Artificial Sequence
  Synthetic Construct
AQMHADRALAQ

SEQ ID NO: 8259 - protein, 11 aa, Artificial Sequence
  Synthetic Construct
AQSTTHAPKAQ

SEQ ID NO: 8260 - protein, 11 aa, Artificial Sequence
  Synthetic Construct
AQSNQTIMTAQ

SEQ ID NO: 8261 - protein, 11 aa, Artificial Sequence
  Synthetic Construct
AQVSSPSGLAQ

SEQ ID NO: 8262 - protein, 11 aa, Artificial Sequence
  Synthetic Construct
AQKRGEEMVAQ

SEQ ID NO: 8263 - protein, 11 aa, Artificial Sequence
  Synthetic Construct
AQQDSGNSYAQ

SEQ ID NO: 8264 - protein, 11 aa, Artificial Sequence
  Synthetic Construct
AQSHATTGGAQ

SEQ ID NO: 8265 - protein, 11 aa, Artificial Sequence
  Synthetic Construct
AQKLSETSHAQ

SEQ ID NO: 8266 - protein, 11 aa, Artificial Sequence
  Synthetic Construct
AQLNYKEAPAQ

SEQ ID NO: 8267 - protein, 11 aa, Artificial Sequence
  Synthetic Construct
AQSVDSVRLAQ

SEQ ID NO: 8268 - protein, 11 aa, Artificial Sequence
  Synthetic Construct
AQQPNVIQTAQ

SEQ ID NO: 8269 - protein, 11 aa, Artificial Sequence
  Synthetic Construct
AQRMTNLQTAQ

SEQ ID NO: 8270 - protein, 11 aa, Artificial Sequence
  Synthetic Construct
AQATPGGSGAQ

SEQ ID NO: 8271 - protein, 11 aa, Artificial Sequence
  Synthetic Construct
AQDVNSMSSAQ

SEQ ID NO: 8272 - protein, 11 aa, Artificial Sequence
  Synthetic Construct
AQLPRSHLDAQ

SEQ ID NO: 8273 - protein, 11 aa, Artificial Sequence
  Synthetic Construct
AQPAPRYDKAQ

SEQ ID NO: 8274 - protein, 11 aa, Artificial Sequence
  Synthetic Construct
AQRNYSDKDAQ

SEQ ID NO: 8275 - protein, 11 aa, Artificial Sequence
  Synthetic Construct
AQSENLLSRAQ

SEQ ID NO: 8276 - protein, 11 aa, Artificial Sequence
  Synthetic Construct
AQSSLNMKDAQ

SEQ ID NO: 8277 - protein, 11 aa, Artificial Sequence
  Synthetic Construct
AQSDKEYGRAQ

SEQ ID NO: 8278 - protein, 11 aa, Artificial Sequence
  Synthetic Construct
AQYVSQSGMAQ

SEQ ID NO: 8279 - protein, 11 aa, Artificial Sequence
  Synthetic Construct
AQNVVSVRQAQ

SEQ ID NO: 8280 - protein, 11 aa, Artificial Sequence
  Synthetic Construct
AQTGKEGRTAQ

SEQ ID NO: 8281 - protein, 11 aa, Artificial Sequence
  Synthetic Construct
AQFKNTVATAQ

SEQ ID NO: 8282 - protein, 11 aa, Artificial Sequence
  Synthetic Construct
AQGSREPSSAQ

SEQ ID NO: 8283 - protein, 11 aa, Artificial Sequence
  Synthetic Construct
AQREKVSTPAQ

SEQ ID NO: 8284 - protein, 11 aa, Artificial Sequence
  Synthetic Construct
AQQEPARHNAQ

SEQ ID NO: 8285 - protein, 11 aa, Artificial Sequence
  Synthetic Construct
AQTSHSNGRAQ

SEQ ID NO: 8286 - protein, 11 aa, Artificial Sequence
  Synthetic Construct
AQDLSSPKMAQ

SEQ ID NO: 8287 - protein, 11 aa, Artificial Sequence
  Synthetic Construct
AQLATTPKPAQ

SEQ ID NO: 8288 - protein, 11 aa, Artificial Sequence
  Synthetic Construct
AQSGPNVSLAQ

SEQ ID NO: 8289 - protein, 11 aa, Artificial Sequence
  Synthetic Construct
AQPVYNASPAQ

SEQ ID NO: 8290 - protein, 11 aa, Artificial Sequence
  Synthetic Construct
AQNSTTLVMAQ

SEQ ID NO: 8291 - protein, 11 aa, Artificial Sequence
  Synthetic Construct
AQRNAVVSMAQ

SEQ ID NO: 8292 - protein, 11 aa, Artificial Sequence
  Synthetic Construct
AQKDLLAKLAQ

SEQ ID NO: 8293 - protein, 11 aa, Artificial Sequence
  Synthetic Construct
AQPHEGSSRAQ

SEQ ID NO: 8294 - protein, 11 aa, Artificial Sequence
  Synthetic Construct
AQRDTVSRYAQ

SEQ ID NO: 8295 - protein, 11 aa, Artificial Sequence
  Synthetic Construct
AQGQAAQGHAQ

SEQ ID NO: 8296 - protein, 11 aa, Artificial Sequence
  Synthetic Construct
AQRAETAHVAQ

SEQ ID NO: 8297 - protein, 11 aa, Artificial Sequence
  Synthetic Construct
AQENRTVPTAQ

SEQ ID NO: 8298 - protein, 11 aa, Artificial Sequence
  Synthetic Construct
AQSSNDARVAQ

SEQ ID NO: 8299 - protein, 11 aa, Artificial Sequence
  Synthetic Construct
AQPGQVDRRAQ

SEQ ID NO: 8300 - protein, 11 aa, Artificial Sequence
  Synthetic Construct
AQGPGANTTAQ

SEQ ID NO: 8301 - protein, 11 aa, Artificial Sequence
  Synthetic Construct
AQMPENLKEAQ

SEQ ID NO: 8302 - protein, 11 aa, Artificial Sequence
  Synthetic Construct
AQTNAVASNAQ

SEQ ID NO: 8303 - protein, 11 aa, Artificial Sequence
  Synthetic Construct
AQYGKIELYAQ

SEQ ID NO: 8304 - protein, 11 aa, Artificial Sequence
  Synthetic Construct
AQNPNGTGFAQ

SEQ ID NO: 8305 - protein, 11 aa, Artificial Sequence
  Synthetic Construct
AQSRNTMGSAQ

SEQ ID NO: 8306 - protein, 11 aa, Artificial Sequence
  Synthetic Construct
AQPSHGITAAQ

SEQ ID NO: 8307 - protein, 11 aa, Artificial Sequence
  Synthetic Construct
AQLETLRGPAQ

SEQ ID NO: 8308 - protein, 11 aa, Artificial Sequence
  Synthetic Construct
AQDRSPDIRAQ

SEQ ID NO: 8309 - protein, 11 aa, Artificial Sequence
  Synthetic Construct
AQKDLASAKAQ

SEQ ID NO: 8310 - protein, 11 aa, Artificial Sequence
  Synthetic Construct
AQITSHGNSAQ

SEQ ID NO: 8311 - protein, 11 aa, Artificial Sequence
  Synthetic Construct
AQHSKMPSTAQ

SEQ ID NO: 8312 - protein, 11 aa, Artificial Sequence
  Synthetic Construct
AQIATFTTAAQ

SEQ ID NO: 8313 - protein, 11 aa, Artificial Sequence
  Synthetic Construct
AQAASGYLNAQ

SEQ ID NO: 8314 - protein, 11 aa, Artificial Sequence
  Synthetic Construct
AQDSVRPAIAQ

SEQ ID NO: 8315 - protein, 11 aa, Artificial Sequence
  Synthetic Construct
AQRLSEEMRAQ

SEQ ID NO: 8316 - protein, 11 aa, Artificial Sequence
  Synthetic Construct
AQLPISATEAQ

SEQ ID NO: 8317 - protein, 11 aa, Artificial Sequence
  Synthetic Construct
AQSNVAAQMAQ

SEQ ID NO: 8318 - protein, 11 aa, Artificial Sequence
  Synthetic Construct
AQYQSLISEAQ

SEQ ID NO: 8319 - protein, 11 aa, Artificial Sequence
  Synthetic Construct
AQYQSGYDKAQ

SEQ ID NO: 8320 - protein, 11 aa, Artificial Sequence
  Synthetic Construct
AQLRTGELTAQ

SEQ ID NO: 8321 - protein, 11 aa, Artificial Sequence
  Synthetic Construct
AQPATNNMRAQ

SEQ ID NO: 8322 - protein, 11 aa, Artificial Sequence
  Synthetic Construct
AQVSSSKFSAQ

SEQ ID NO: 8323 - protein, 11 aa, Artificial Sequence
  Synthetic Construct
AQTTLLDKAAQ

SEQ ID NO: 8324 - protein, 11 aa, Artificial Sequence
  Synthetic Construct
AQSPALHPSAQ

SEQ ID NO: 8325 - protein, 11 aa, Artificial Sequence
  Synthetic Construct
AQFNHNRTDAQ

SEQ ID NO: 8326 - protein, 11 aa, Artificial Sequence
  Synthetic Construct
AQAEKTANGAQ

SEQ ID NO: 8327 - protein, 11 aa, Artificial Sequence
  Synthetic Construct
AQNLRVTASAQ

SEQ ID NO: 8328 - protein, 11 aa, Artificial Sequence
  Synthetic Construct
AQMKDGSRIAQ

SEQ ID NO: 8329 - protein, 11 aa, Artificial Sequence
  Synthetic Construct
AQRIGANATAQ

SEQ ID NO: 8330 - protein, 11 aa, Artificial Sequence
  Synthetic Construct
AQANLTPNRAQ

SEQ ID NO: 8331 - protein, 11 aa, Artificial Sequence
  Synthetic Construct
AQSVSDKSHAQ

SEQ ID NO: 8332 - protein, 11 aa, Artificial Sequence
  Synthetic Construct
AQYSTLHTAAQ

SEQ ID NO: 8333 - protein, 11 aa, Artificial Sequence
  Synthetic Construct
AQTKFGGIQAQ

SEQ ID NO: 8334 - protein, 11 aa, Artificial Sequence
  Synthetic Construct
AQDIPKGSSAQ

SEQ ID NO: 8335 - protein, 11 aa, Artificial Sequence
  Synthetic Construct
AQILPSSSQAQ

SEQ ID NO: 8336 - protein, 11 aa, Artificial Sequence
  Synthetic Construct
AQVSQTTSSAQ

SEQ ID NO: 8337 - protein, 11 aa, Artificial Sequence
  Synthetic Construct
AQTIHLHKDAQ

SEQ ID NO: 8338 - protein, 11 aa, Artificial Sequence
  Synthetic Construct
AQVTDRVGNAQ

SEQ ID NO: 8339 - protein, 11 aa, Artificial Sequence
  Synthetic Construct
AQLPARAANAQ

SEQ ID NO: 8340 - protein, 11 aa, Artificial Sequence
  Synthetic Construct
AQHTQSMTVAQ

SEQ ID NO: 8341 - protein, 11 aa, Artificial Sequence
  Synthetic Construct
AQLLNSSQLAQ

SEQ ID NO: 8342 - protein, 11 aa, Artificial Sequence
  Synthetic Construct
AQRNSELRAAQ

SEQ ID NO: 8343 - protein, 11 aa, Artificial Sequence
  Synthetic Construct
AQQKSPNGLAQ

SEQ ID NO: 8344 - protein, 11 aa, Artificial Sequence
  Synthetic Construct
AQKSGDHLTAQ

SEQ ID NO: 8345 - protein, 11 aa, Artificial Sequence
  Synthetic Construct
AQGNRTTSSAQ

SEQ ID NO: 8346 - protein, 11 aa, Artificial Sequence
  Synthetic Construct
AQMVALTVGAQ

SEQ ID NO: 8347 - protein, 11 aa, Artificial Sequence
  Synthetic Construct
AQLSSNSPRAQ

SEQ ID NO: 8348 - protein, 11 aa, Artificial Sequence
  Synthetic Construct
AQASNNQTYAQ

SEQ ID NO: 8349 - protein, 11 aa, Artificial Sequence
  Synthetic Construct
AQNNIVTTSAQ

SEQ ID NO: 8350 - protein, 11 aa, Artificial Sequence
  Synthetic Construct
AQHDTKKPMAQ

SEQ ID NO: 8351 - protein, 11 aa, Artificial Sequence
  Synthetic Construct
AQINTASYKAQ

SEQ ID NO: 8352 - protein, 11 aa, Artificial Sequence
  Synthetic Construct
AQSGMVSMSAQ

SEQ ID NO: 8353 - protein, 11 aa, Artificial Sequence
  Synthetic Construct
AQLVTASARAQ

SEQ ID NO: 8354 - protein, 11 aa, Artificial Sequence
  Synthetic Construct
AQSRAPSAMAQ

SEQ ID NO: 8355 - protein, 11 aa, Artificial Sequence
  Synthetic Construct
AQNNNQKVYAQ

SEQ ID NO: 8356 - protein, 11 aa, Artificial Sequence
  Synthetic Construct
AQTSVVANPAQ

SEQ ID NO: 8357 - protein, 11 aa, Artificial Sequence
  Synthetic Construct
AQGNAGPSLAQ

SEQ ID NO: 8358 - protein, 11 aa, Artificial Sequence
  Synthetic Construct
AQYSTSLELAQ

SEQ ID NO: 8359 - protein, 11 aa, Artificial Sequence
  Synthetic Construct
AQPSNPPKEAQ

SEQ ID NO: 8360 - protein, 11 aa, Artificial Sequence
  Synthetic Construct
AQTNSKPSWAQ

SEQ ID NO: 8361 - protein, 11 aa, Artificial Sequence
  Synthetic Construct
AQSIDRQQLAQ

SEQ ID NO: 8362 - protein, 11 aa, Artificial Sequence
  Synthetic Construct
AQNKAGPASAQ

SEQ ID NO: 8363 - protein, 11 aa, Artificial Sequence
  Synthetic Construct
AQSMTTNRSAQ

SEQ ID NO: 8364 - protein, 11 aa, Artificial Sequence
  Synthetic Construct
AQGNSAVQLAQ

SEQ ID NO: 8365 - protein, 11 aa, Artificial Sequence
  Synthetic Construct
AQRSSDVNTAQ

SEQ ID NO: 8366 - protein, 11 aa, Artificial Sequence
  Synthetic Construct
AQHNGVQSVAQ

SEQ ID NO: 8367 - protein, 11 aa, Artificial Sequence
  Synthetic Construct
AQEKDHGMAAQ

SEQ ID NO: 8368 - protein, 11 aa, Artificial Sequence
  Synthetic Construct
AQYRLPDGRAQ

SEQ ID NO: 8369 - protein, 11 aa, Artificial Sequence
  Synthetic Construct
AQSSRELRLAQ

SEQ ID NO: 8370 - protein, 11 aa, Artificial Sequence
  Synthetic Construct
AQNQVESRVAQ

SEQ ID NO: 8371 - protein, 11 aa, Artificial Sequence
  Synthetic Construct
AQALHSVPKAQ

SEQ ID NO: 8372 - protein, 11 aa, Artificial Sequence
  Synthetic Construct
AQTGPSTVPAQ

SEQ ID NO: 8373 - protein, 11 aa, Artificial Sequence
  Synthetic Construct
AQEPLGVHPAQ

SEQ ID NO: 8374 - protein, 11 aa, Artificial Sequence
  Synthetic Construct
AQTRTDTTNAQ

SEQ ID NO: 8375 - protein, 11 aa, Artificial Sequence
  Synthetic Construct
AQSHNLTADAQ

SEQ ID NO: 8376 - protein, 11 aa, Artificial Sequence
  Synthetic Construct
AQNVRRDDTAQ

SEQ ID NO: 8377 - protein, 11 aa, Artificial Sequence
  Synthetic Construct
AQFAANLVAAQ

SEQ ID NO: 8378 - protein, 11 aa, Artificial Sequence
  Synthetic Construct
AQIGAQARMAQ

SEQ ID NO: 8379 - protein, 11 aa, Artificial Sequence
  Synthetic Construct
AQNSMSKAYAQ

SEQ ID NO: 8380 - protein, 11 aa, Artificial Sequence
  Synthetic Construct
AQNVNKDRVAQ

SEQ ID NO: 8381 - protein, 11 aa, Artificial Sequence
  Synthetic Construct
AQSFQGSARAQ

SEQ ID NO: 8382 - protein, 11 aa, Artificial Sequence
  Synthetic Construct
AQANSDHIHAQ

SEQ ID NO: 8383 - protein, 11 aa, Artificial Sequence
  Synthetic Construct
AQVSLASKSAQ

SEQ ID NO: 8384 - protein, 11 aa, Artificial Sequence
  Synthetic Construct
AQPKDRATSAQ

SEQ ID NO: 8385 - protein, 11 aa, Artificial Sequence
  Synthetic Construct
AQVRSQSDSAQ

SEQ ID NO: 8386 - protein, 11 aa, Artificial Sequence
  Synthetic Construct
AQLGNSVFKAQ

SEQ ID NO: 8387 - protein, 11 aa, Artificial Sequence
  Synthetic Construct
AQSTKESPKAQ

SEQ ID NO: 8388 - protein, 11 aa, Artificial Sequence
  Synthetic Construct
AQLQPTTFSAQ

SEQ ID NO: 8389 - protein, 11 aa, Artificial Sequence
  Synthetic Construct
AQPMHTAMVAQ

SEQ ID NO: 8390 - protein, 11 aa, Artificial Sequence
  Synthetic Construct
AQVFAHTGLAQ

SEQ ID NO: 8391 - protein, 11 aa, Artificial Sequence
  Synthetic Construct
AQQKATSIHAQ

SEQ ID NO: 8392 - protein, 11 aa, Artificial Sequence
  Synthetic Construct
AQGSKSDNLAQ

SEQ ID NO: 8393 - protein, 11 aa, Artificial Sequence
  Synthetic Construct
AQSGTNVVSAQ

SEQ ID NO: 8394 - protein, 11 aa, Artificial Sequence
  Synthetic Construct
AQTKLTTLSAQ

SEQ ID NO: 8395 - protein, 11 aa, Artificial Sequence
  Synthetic Construct
AQPILHNQIAQ

SEQ ID NO: 8396 - protein, 11 aa, Artificial Sequence
  Synthetic Construct
AQVTNPIKPAQ

SEQ ID NO: 8397 - protein, 11 aa, Artificial Sequence
  Synthetic Construct
AQTNALHMKAQ

SEQ ID NO: 8398 - protein, 11 aa, Artificial Sequence
  Synthetic Construct
AQVAHAYPAAQ

SEQ ID NO: 8399 - protein, 11 aa, Artificial Sequence
  Synthetic Construct
AQAEHGLGPAQ

SEQ ID NO: 8400 - protein, 11 aa, Artificial Sequence
  Synthetic Construct
AQMNKYSPAAQ

SEQ ID NO: 8401 - protein, 11 aa, Artificial Sequence
  Synthetic Construct
AQTMQDRLTAQ

SEQ ID NO: 8402 - protein, 11 aa, Artificial Sequence
  Synthetic Construct
AQGVKILNSAQ

SEQ ID NO: 8403 - protein, 11 aa, Artificial Sequence
  Synthetic Construct
AQAQNKMTSAQ

SEQ ID NO: 8404 - protein, 11 aa, Artificial Sequence
  Synthetic Construct
AQTSALTDIAQ

SEQ ID NO: 8405 - protein, 11 aa, Artificial Sequence
  Synthetic Construct
AQDLRHADIAQ

SEQ ID NO: 8406 - protein, 11 aa, Artificial Sequence
  Synthetic Construct
AQQNKALTVAQ

SEQ ID NO: 8407 - protein, 11 aa, Artificial Sequence
  Synthetic Construct
AQTQGITIVAQ

SEQ ID NO: 8408 - protein, 11 aa, Artificial Sequence
  Synthetic Construct
AQTATILSGAQ

SEQ ID NO: 8409 - protein, 11 aa, Artificial Sequence
  Synthetic Construct
AQFAASNISAQ

SEQ ID NO: 8410 - protein, 11 aa, Artificial Sequence
  Synthetic Construct
AQRNTMETMAQ

SEQ ID NO: 8411 - protein, 11 aa, Artificial Sequence
  Synthetic Construct
AQSSGTSYSAQ

SEQ ID NO: 8412 - protein, 11 aa, Artificial Sequence
  Synthetic Construct
AQANHGLNAAQ

SEQ ID NO: 8413 - protein, 11 aa, Artificial Sequence
  Synthetic Construct
AQMLSNSRSAQ

SEQ ID NO: 8414 - protein, 11 aa, Artificial Sequence
  Synthetic Construct
AQAAIHATPAQ

SEQ ID NO: 8415 - protein, 11 aa, Artificial Sequence
  Synthetic Construct
AQWQSFASAAQ

SEQ ID NO: 8416 - protein, 11 aa, Artificial Sequence
  Synthetic Construct
AQMGGNSSTAQ

SEQ ID NO: 8417 - protein, 11 aa, Artificial Sequence
  Synthetic Construct
AQKTDLAQHAQ

SEQ ID NO: 8418 - protein, 11 aa, Artificial Sequence
  Synthetic Construct
AQVNTTRFSAQ

SEQ ID NO: 8419 - protein, 11 aa, Artificial Sequence
  Synthetic Construct
AQNVHAHQAAQ

SEQ ID NO: 8420 - protein, 11 aa, Artificial Sequence
  Synthetic Construct
AQGAMSIQTAQ

SEQ ID NO: 8421 - protein, 11 aa, Artificial Sequence
  Synthetic Construct
AQARGPTIVAQ

SEQ ID NO: 8422 - protein, 11 aa, Artificial Sequence
  Synthetic Construct
AQTMHSKSDAQ

SEQ ID NO: 8423 - protein, 11 aa, Artificial Sequence
  Synthetic Construct
AQTVTQTTQAQ

SEQ ID NO: 8424 - protein, 11 aa, Artificial Sequence
  Synthetic Construct
AQGNTNSLTAQ

SEQ ID NO: 8425 - protein, 11 aa, Artificial Sequence
  Synthetic Construct
AQRVIASVNAQ

SEQ ID NO: 8426 - protein, 11 aa, Artificial Sequence
  Synthetic Construct
AQPSSGNSEAQ

SEQ ID NO: 8427 - protein, 11 aa, Artificial Sequence
  Synthetic Construct
AQQPHGFTAAQ

SEQ ID NO: 8428 - protein, 11 aa, Artificial Sequence
  Synthetic Construct
AQTTGTNMRAQ

SEQ ID NO: 8429 - protein, 11 aa, Artificial Sequence
  Synthetic Construct
AQFTRLEDRAQ

SEQ ID NO: 8430 - protein, 11 aa, Artificial Sequence
  Synthetic Construct
AQDRSPAHTAQ

SEQ ID NO: 8431 - protein, 11 aa, Artificial Sequence
  Synthetic Construct
AQHVHNTVPAQ

SEQ ID NO: 8432 - protein, 11 aa, Artificial Sequence
  Synthetic Construct
AQMNTTGTKAQ

SEQ ID NO: 8433 - protein, 11 aa, Artificial Sequence
  Synthetic Construct
AQFATQTIAAQ

SEQ ID NO: 8434 - protein, 11 aa, Artificial Sequence
  Synthetic Construct
AQVSGNIPVAQ

SEQ ID NO: 8435 - protein, 11 aa, Artificial Sequence
  Synthetic Construct
AQDGRNIAPAQ

SEQ ID NO: 8436 - protein, 11 aa, Artificial Sequence
  Synthetic Construct
AQMLPTVNRAQ

SEQ ID NO: 8437 - protein, 11 aa, Artificial Sequence
  Synthetic Construct
AQPTTNVLGAQ

SEQ ID NO: 8438 - protein, 11 aa, Artificial Sequence
  Synthetic Construct
AQREMHGTLAQ

SEQ ID NO: 8439 - protein, 11 aa, Artificial Sequence
  Synthetic Construct
AQSPYSTRPAQ

SEQ ID NO: 8440 - protein, 11 aa, Artificial Sequence
  Synthetic Construct
AQYNMNTEMAQ

SEQ ID NO: 8441 - protein, 11 aa, Artificial Sequence
  Synthetic Construct
AQGARMGHSAQ

SEQ ID NO: 8442 - protein, 11 aa, Artificial Sequence
  Synthetic Construct
AQFSPGYVPAQ

SEQ ID NO: 8443 - protein, 11 aa, Artificial Sequence
  Synthetic Construct
AQQQHIPPSAQ

SEQ ID NO: 8444 - protein, 11 aa, Artificial Sequence
  Synthetic Construct
AQLSTSLSPAQ

SEQ ID NO: 8445 - protein, 11 aa, Artificial Sequence
  Synthetic Construct
AQVNGIKEYAQ

SEQ ID NO: 8446 - protein, 11 aa, Artificial Sequence
  Synthetic Construct
AQGVRTEPMAQ

SEQ ID NO: 8447 - protein, 11 aa, Artificial Sequence
  Synthetic Construct
AQRNNDSLTAQ

SEQ ID NO: 8448 - protein, 11 aa, Artificial Sequence
  Synthetic Construct
AQFNASPKLAQ

SEQ ID NO: 8449 - protein, 11 aa, Artificial Sequence
  Synthetic Construct
AQGLTTSTTAQ

SEQ ID NO: 8450 - protein, 11 aa, Artificial Sequence
  Synthetic Construct
AQMIRGTSSAQ

SEQ ID NO: 8451 - protein, 11 aa, Artificial Sequence
  Synthetic Construct
AQTKLVATVAQ

SEQ ID NO: 8452 - protein, 11 aa, Artificial Sequence
  Synthetic Construct
AQVSRQFEPAQ

SEQ ID NO: 8453 - protein, 11 aa, Artificial Sequence
  Synthetic Construct
AQNGDSLRPAQ

SEQ ID NO: 8454 - protein, 11 aa, Artificial Sequence
  Synthetic Construct
AQTQNLSSHAQ

SEQ ID NO: 8455 - protein, 11 aa, Artificial Sequence
  Synthetic Construct
AQTVTGSLVAQ

SEQ ID NO: 8456 - protein, 11 aa, Artificial Sequence
  Synthetic Construct
AQGRGPEAQAQ

SEQ ID NO: 8457 - protein, 11 aa, Artificial Sequence
  Synthetic Construct
AQPRNVGLEAQ

SEQ ID NO: 8458 - protein, 11 aa, Artificial Sequence
  Synthetic Construct
AQFNSSIPTAQ

SEQ ID NO: 8459 - protein, 11 aa, Artificial Sequence
  Synthetic Construct
AQGNQQHSSAQ

SEQ ID NO: 8460 - protein, 11 aa, Artificial Sequence
  Synthetic Construct
AQPITNGSFAQ

SEQ ID NO: 8461 - protein, 11 aa, Artificial Sequence
  Synthetic Construct
AQVQRTPLTAQ

SEQ ID NO: 8462 - protein, 11 aa, Artificial Sequence
  Synthetic Construct
AQTPYAGRAAQ

SEQ ID NO: 8463 - protein, 11 aa, Artificial Sequence
  Synthetic Construct
AQLALSNRTAQ

SEQ ID NO: 8464 - protein, 11 aa, Artificial Sequence
  Synthetic Construct
AQGQMATGLAQ

SEQ ID NO: 8465 - protein, 11 aa, Artificial Sequence
  Synthetic Construct
AQSNPATTTAQ

SEQ ID NO: 8466 - protein, 11 aa, Artificial Sequence
  Synthetic Construct
AQGRTTSDSAQ

SEQ ID NO: 8467 - protein, 11 aa, Artificial Sequence
  Synthetic Construct
AQSRLTSLGAQ

SEQ ID NO: 8468 - protein, 11 aa, Artificial Sequence
  Synthetic Construct
AQHLSTPDLAQ

SEQ ID NO: 8469 - protein, 11 aa, Artificial Sequence
  Synthetic Construct
AQMPHAPTSAQ

SEQ ID NO: 8470 - protein, 11 aa, Artificial Sequence
  Synthetic Construct
AQVAGMLTHAQ

SEQ ID NO: 8471 - protein, 11 aa, Artificial Sequence
  Synthetic Construct
AQVASQKLNAQ

SEQ ID NO: 8472 - protein, 11 aa, Artificial Sequence
  Synthetic Construct
AQTQSMTSRAQ

SEQ ID NO: 8473 - protein, 11 aa, Artificial Sequence
  Synthetic Construct
AQPISTMSLAQ

SEQ ID NO: 8474 - protein, 11 aa, Artificial Sequence
  Synthetic Construct
AQAQLNSAGAQ

SEQ ID NO: 8475 - protein, 11 aa, Artificial Sequence
  Synthetic Construct
AQHLPKYEHAQ

SEQ ID NO: 8476 - protein, 11 aa, Artificial Sequence
  Synthetic Construct
AQGVQAVVGAQ

SEQ ID NO: 8477 - protein, 11 aa, Artificial Sequence
  Synthetic Construct
AQGDTQYARAQ

SEQ ID NO: 8478 - protein, 11 aa, Artificial Sequence
  Synthetic Construct
AQASPLVMSAQ

SEQ ID NO: 8479 - protein, 11 aa, Artificial Sequence
  Synthetic Construct
AQSNAGMSKAQ

SEQ ID NO: 8480 - protein, 11 aa, Artificial Sequence
  Synthetic Construct
AQRSVSAVPAQ

SEQ ID NO: 8481 - protein, 11 aa, Artificial Sequence
  Synthetic Construct
AQPSYHKSPAQ

SEQ ID NO: 8482 - protein, 11 aa, Artificial Sequence
  Synthetic Construct
AQHQFTSSAAQ

SEQ ID NO: 8483 - protein, 11 aa, Artificial Sequence
  Synthetic Construct
AQNQSPIGAAQ

SEQ ID NO: 8484 - protein, 11 aa, Artificial Sequence
  Synthetic Construct
AQGAAGMSRAQ

SEQ ID NO: 8485 - protein, 11 aa, Artificial Sequence
  Synthetic Construct
AQTVKTYSAAQ

SEQ ID NO: 8486 - protein, 11 aa, Artificial Sequence
  Synthetic Construct
AQLSMTSQMAQ

SEQ ID NO: 8487 - protein, 11 aa, Artificial Sequence
  Synthetic Construct
AQGLSPTFGAQ

SEQ ID NO: 8488 - protein, 11 aa, Artificial Sequence
  Synthetic Construct
AQMDTVMKGAQ

SEQ ID NO: 8489 - protein, 11 aa, Artificial Sequence
  Synthetic Construct
AQRDKISTYAQ

SEQ ID NO: 8490 - protein, 11 aa, Artificial Sequence
  Synthetic Construct
AQDSNSYVRAQ

SEQ ID NO: 8491 - protein, 11 aa, Artificial Sequence
  Synthetic Construct
AQSLKSSPFAQ

SEQ ID NO: 8492 - protein, 11 aa, Artificial Sequence
  Synthetic Construct
AQLDRTAKPAQ

SEQ ID NO: 8493 - protein, 11 aa, Artificial Sequence
  Synthetic Construct
AQPSRAPDPAQ

SEQ ID NO: 8494 - protein, 11 aa, Artificial Sequence
  Synthetic Construct
AQYLNQIRSAQ

SEQ ID NO: 8495 - protein, 11 aa, Artificial Sequence
  Synthetic Construct
AQQNRSVVEAQ

SEQ ID NO: 8496 - protein, 11 aa, Artificial Sequence
  Synthetic Construct
AQQESMVKYAQ

SEQ ID NO: 8497 - protein, 11 aa, Artificial Sequence
  Synthetic Construct
AQKLSQESNAQ

SEQ ID NO: 8498 - protein, 11 aa, Artificial Sequence
  Synthetic Construct
AQRGTMEHDAQ

SEQ ID NO: 8499 - protein, 11 aa, Artificial Sequence
  Synthetic Construct
AQQSGPGIVAQ

SEQ ID NO: 8500 - protein, 11 aa, Artificial Sequence
  Synthetic Construct
AQLNQGDLLAQ

SEQ ID NO: 8501 - protein, 11 aa, Artificial Sequence
  Synthetic Construct
AQAKTIGSTAQ

SEQ ID NO: 8502 - protein, 11 aa, Artificial Sequence
  Synthetic Construct
AQDSGNRTSAQ

SEQ ID NO: 8503 - protein, 11 aa, Artificial Sequence
  Synthetic Construct
AQLSHSTSFAQ

SEQ ID NO: 8504 - protein, 11 aa, Artificial Sequence
  Synthetic Construct
AQGDFSSKQAQ

SEQ ID NO: 8505 - protein, 11 aa, Artificial Sequence
  Synthetic Construct
AQDHSNAYRAQ

SEQ ID NO: 8506 - protein, 11 aa, Artificial Sequence
  Synthetic Construct
AQVPTDRPRAQ

SEQ ID NO: 8507 - protein, 11 aa, Artificial Sequence
  Synthetic Construct
AQSMQLINEAQ

SEQ ID NO: 8508 - protein, 11 aa, Artificial Sequence
  Synthetic Construct
AQYANSVGLAQ

SEQ ID NO: 8509 - protein, 11 aa, Artificial Sequence
  Synthetic Construct
AQVYLASGGAQ

SEQ ID NO: 8510 - protein, 11 aa, Artificial Sequence
  Synthetic Construct
AQLIPVTSVAQ

SEQ ID NO: 8511 - protein, 11 aa, Artificial Sequence
  Synthetic Construct
AQGNMNSRTAQ

SEQ ID NO: 8512 - protein, 11 aa, Artificial Sequence
  Synthetic Construct
AQSHNDRSLAQ

SEQ ID NO: 8513 - protein, 11 aa, Artificial Sequence
  Synthetic Construct
AQHRIPTAGAQ

SEQ ID NO: 8514 - protein, 11 aa, Artificial Sequence
  Synthetic Construct
AQMGKDYTHAQ

SEQ ID NO: 8515 - protein, 11 aa, Artificial Sequence
  Synthetic Construct
AQSHASTPIAQ

SEQ ID NO: 8516 - protein, 11 aa, Artificial Sequence
  Synthetic Construct
AQLNSQTRSAQ

SEQ ID NO: 8517 - protein, 11 aa, Artificial Sequence
  Synthetic Construct
AQRTLSDSVAQ

SEQ ID NO: 8518 - protein, 11 aa, Artificial Sequence
  Synthetic Construct
AQLTTAKTFAQ

SEQ ID NO: 8519 - protein, 11 aa, Artificial Sequence
  Synthetic Construct
AQRIVGSTSAQ

SEQ ID NO: 8520 - protein, 11 aa, Artificial Sequence
  Synthetic Construct
AQTKTLALHAQ

SEQ ID NO: 8521 - protein, 11 aa, Artificial Sequence
  Synthetic Construct
AQWEVPARNAQ

SEQ ID NO: 8522 - protein, 11 aa, Artificial Sequence
  Synthetic Construct
AQISNPAIAAQ

SEQ ID NO: 8523 - protein, 11 aa, Artificial Sequence
  Synthetic Construct
AQLGASQTSAQ

SEQ ID NO: 8524 - protein, 11 aa, Artificial Sequence
  Synthetic Construct
AQLSTHNSVAQ

SEQ ID NO: 8525 - protein, 11 aa, Artificial Sequence
  Synthetic Construct
AQRHTDIDTAQ

SEQ ID NO: 8526 - protein, 11 aa, Artificial Sequence
  Synthetic Construct
AQGRPVIAAAQ

SEQ ID NO: 8527 - protein, 11 aa, Artificial Sequence
  Synthetic Construct
AQANLRDGVAQ

SEQ ID NO: 8528 - protein, 11 aa, Artificial Sequence
  Synthetic Construct
AQVQSPSITAQ

SEQ ID NO: 8529 - protein, 11 aa, Artificial Sequence
  Synthetic Construct
AQFTSGSHLAQ

SEQ ID NO: 8530 - protein, 11 aa, Artificial Sequence
  Synthetic Construct
AQPLQQSGHAQ

SEQ ID NO: 8531 - protein, 11 aa, Artificial Sequence
  Synthetic Construct
AQARVATTLAQ

SEQ ID NO: 8532 - protein, 11 aa, Artificial Sequence
  Synthetic Construct
AQPGRQNDAAQ

SEQ ID NO: 8533 - protein, 11 aa, Artificial Sequence
  Synthetic Construct
AQKYSSTAIAQ

SEQ ID NO: 8534 - protein, 11 aa, Artificial Sequence
  Synthetic Construct
AQHSTHYIAAQ

SEQ ID NO: 8535 - protein, 11 aa, Artificial Sequence
  Synthetic Construct
AQQPLNALPAQ

SEQ ID NO: 8536 - protein, 11 aa, Artificial Sequence
  Synthetic Construct
AQKTQETGNAQ

SEQ ID NO: 8537 - protein, 11 aa, Artificial Sequence
  Synthetic Construct
AQSELSRHAAQ

SEQ ID NO: 8538 - protein, 11 aa, Artificial Sequence
  Synthetic Construct
AQGPKTISTAQ

SEQ ID NO: 8539 - protein, 11 aa, Artificial Sequence
  Synthetic Construct
AQSHSIVNPAQ

SEQ ID NO: 8540 - protein, 11 aa, Artificial Sequence
  Synthetic Construct
AQHSNTVSSAQ

SEQ ID NO: 8541 - protein, 11 aa, Artificial Sequence
  Synthetic Construct
AQVAGLTVQAQ

SEQ ID NO: 8542 - protein, 11 aa, Artificial Sequence
  Synthetic Construct
AQANPGLANAQ

SEQ ID NO: 8543 - protein, 11 aa, Artificial Sequence
  Synthetic Construct
AQASVQMTLAQ

SEQ ID NO: 8544 - protein, 11 aa, Artificial Sequence
  Synthetic Construct
AQLVTAQGPAQ

SEQ ID NO: 8545 - protein, 11 aa, Artificial Sequence
  Synthetic Construct
AQTTRYTSPAQ

SEQ ID NO: 8546 - protein, 11 aa, Artificial Sequence
  Synthetic Construct
AQMDTDKPRAQ

SEQ ID NO: 8547 - protein, 11 aa, Artificial Sequence
  Synthetic Construct
AQGTSVQDRAQ

SEQ ID NO: 8548 - protein, 11 aa, Artificial Sequence
  Synthetic Construct
AQRASPQQYAQ

SEQ ID NO: 8549 - protein, 11 aa, Artificial Sequence
  Synthetic Construct
AQVSSEHRIAQ

SEQ ID NO: 8550 - protein, 11 aa, Artificial Sequence
  Synthetic Construct
AQSNMKIQPAQ

SEQ ID NO: 8551 - protein, 11 aa, Artificial Sequence
  Synthetic Construct
AQNLRIEPMAQ

SEQ ID NO: 8552 - protein, 11 aa, Artificial Sequence
  Synthetic Construct
AQPTESLRVAQ

SEQ ID NO: 8553 - protein, 11 aa, Artificial Sequence
  Synthetic Construct
AQTNRGLALAQ

SEQ ID NO: 8554 - protein, 11 aa, Artificial Sequence
  Synthetic Construct
AQHEKTAYIAQ

SEQ ID NO: 8555 - protein, 11 aa, Artificial Sequence
  Synthetic Construct
AQNVISKNLAQ

SEQ ID NO: 8556 - protein, 11 aa, Artificial Sequence
  Synthetic Construct
AQGTAGFSSAQ

SEQ ID NO: 8557 - protein, 11 aa, Artificial Sequence
  Synthetic Construct
AQIAQMGVKAQ

SEQ ID NO: 8558 - protein, 11 aa, Artificial Sequence
  Synthetic Construct
AQTSKDVKDAQ

SEQ ID NO: 8559 - protein, 11 aa, Artificial Sequence
  Synthetic Construct
AQIIGARDIAQ

SEQ ID NO: 8560 - protein, 11 aa, Artificial Sequence
  Synthetic Construct
AQLRDTGLGAQ

SEQ ID NO: 8561 - protein, 11 aa, Artificial Sequence
  Synthetic Construct
AQLSNSLGQAQ

SEQ ID NO: 8562 - protein, 11 aa, Artificial Sequence
  Synthetic Construct
AQNVLNSRGAQ

SEQ ID NO: 8563 - protein, 11 aa, Artificial Sequence
  Synthetic Construct
AQFRGSGSPAQ

SEQ ID NO: 8564 - protein, 11 aa, Artificial Sequence
  Synthetic Construct
AQNPELPRQAQ

SEQ ID NO: 8565 - protein, 11 aa, Artificial Sequence
  Synthetic Construct
AQTSSSFKEAQ

SEQ ID NO: 8566 - protein, 11 aa, Artificial Sequence
  Synthetic Construct
AQNREYMTHAQ

SEQ ID NO: 8567 - protein, 11 aa, Artificial Sequence
  Synthetic Construct
AQTPGVAHPAQ

SEQ ID NO: 8568 - protein, 11 aa, Artificial Sequence
  Synthetic Construct
AQTQSSEGPAQ

SEQ ID NO: 8569 - protein, 11 aa, Artificial Sequence
  Synthetic Construct
AQRGEPIVSAQ

SEQ ID NO: 8570 - protein, 11 aa, Artificial Sequence
  Synthetic Construct
AQSLTSLNSAQ

SEQ ID NO: 8571 - protein, 11 aa, Artificial Sequence
  Synthetic Construct
AQTVLHTRQAQ

SEQ ID NO: 8572 - protein, 11 aa, Artificial Sequence
  Synthetic Construct
AQLSKSGADAQ

SEQ ID NO: 8573 - protein, 11 aa, Artificial Sequence
  Synthetic Construct
AQANGNQSLAQ

SEQ ID NO: 8574 - protein, 11 aa, Artificial Sequence
  Synthetic Construct
AQFVTSSSGAQ

SEQ ID NO: 8575 - protein, 11 aa, Artificial Sequence
  Synthetic Construct
AQGANNHTRAQ

SEQ ID NO: 8576 - protein, 11 aa, Artificial Sequence
  Synthetic Construct
AQHASDVNNAQ

SEQ ID NO: 8577 - protein, 11 aa, Artificial Sequence
  Synthetic Construct
AQGHHTSDPAQ

SEQ ID NO: 8578 - protein, 11 aa, Artificial Sequence
  Synthetic Construct
AQDKNPGVHAQ

SEQ ID NO: 8579 - protein, 11 aa, Artificial Sequence
  Synthetic Construct
AQSRNSHIEAQ

SEQ ID NO: 8580 - protein, 11 aa, Artificial Sequence
  Synthetic Construct
AQQASSDHVAQ

SEQ ID NO: 8581 - protein, 11 aa, Artificial Sequence
  Synthetic Construct
AQLRDTPYNAQ

SEQ ID NO: 8582 - protein, 11 aa, Artificial Sequence
  Synthetic Construct
AQSLAATRDAQ

SEQ ID NO: 8583 - protein, 11 aa, Artificial Sequence
  Synthetic Construct
AQGHVNNAVAQ

SEQ ID NO: 8584 - protein, 11 aa, Artificial Sequence
  Synthetic Construct
AQIGGLTTRAQ

SEQ ID NO: 8585 - protein, 11 aa, Artificial Sequence
  Synthetic Construct
AQSKERNGQAQ

SEQ ID NO: 8586 - protein, 11 aa, Artificial Sequence
  Synthetic Construct
AQLNSGSSAAQ

SEQ ID NO: 8587 - protein, 11 aa, Artificial Sequence
  Synthetic Construct
AQTMSTTYEAQ

SEQ ID NO: 8588 - protein, 11 aa, Artificial Sequence
  Synthetic Construct
AQGADNRISAQ

SEQ ID NO: 8589 - protein, 11 aa, Artificial Sequence
  Synthetic Construct
AQTQNNGDVAQ

SEQ ID NO: 8590 - protein, 11 aa, Artificial Sequence
  Synthetic Construct
AQNGPSVLSAQ

SEQ ID NO: 8591 - protein, 11 aa, Artificial Sequence
  Synthetic Construct
AQTALRDVGAQ

SEQ ID NO: 8592 - protein, 11 aa, Artificial Sequence
  Synthetic Construct
AQRTMGTTMAQ

SEQ ID NO: 8593 - protein, 11 aa, Artificial Sequence
  Synthetic Construct
AQTRGTTVEAQ

SEQ ID NO: 8594 - protein, 11 aa, Artificial Sequence
  Synthetic Construct
AQTVSRVQVAQ

SEQ ID NO: 8595 - protein, 11 aa, Artificial Sequence
  Synthetic Construct
AQRLDTSADAQ

SEQ ID NO: 8596 - protein, 11 aa, Artificial Sequence
  Synthetic Construct
AQLMTKGLVAQ

SEQ ID NO: 8597 - protein, 11 aa, Artificial Sequence
  Synthetic Construct
AQPMRMQTAAQ

SEQ ID NO: 8598 - protein, 11 aa, Artificial Sequence
  Synthetic Construct
AQVVLGSTSAQ

SEQ ID NO: 8599 - protein, 11 aa, Artificial Sequence
  Synthetic Construct
AQSNNGNGHAQ

SEQ ID NO: 8600 - protein, 11 aa, Artificial Sequence
  Synthetic Construct
AQRGPDLLNAQ

SEQ ID NO: 8601 - protein, 11 aa, Artificial Sequence
  Synthetic Construct
AQGFNSMKPAQ

SEQ ID NO: 8602 - protein, 11 aa, Artificial Sequence
  Synthetic Construct
AQLNSNPMNAQ

SEQ ID NO: 8603 - protein, 11 aa, Artificial Sequence
  Synthetic Construct
AQLSNRVQSAQ

SEQ ID NO: 8604 - protein, 11 aa, Artificial Sequence
  Synthetic Construct
AQSRMEGTVAQ

SEQ ID NO: 8605 - protein, 11 aa, Artificial Sequence
  Synthetic Construct
AQSEQYVRVAQ

SEQ ID NO: 8606 - protein, 11 aa, Artificial Sequence
  Synthetic Construct
AQSNLANQPAQ

SEQ ID NO: 8607 - protein, 11 aa, Artificial Sequence
  Synthetic Construct
AQVSMQRPTAQ

SEQ ID NO: 8608 - protein, 11 aa, Artificial Sequence
  Synthetic Construct
AQFHGQGMSAQ

SEQ ID NO: 8609 - protein, 11 aa, Artificial Sequence
  Synthetic Construct
AQTGAINAPAQ

SEQ ID NO: 8610 - protein, 11 aa, Artificial Sequence
  Synthetic Construct
AQTLFKNGPAQ

SEQ ID NO: 8611 - protein, 11 aa, Artificial Sequence
  Synthetic Construct
AQVVPISTNAQ

SEQ ID NO: 8612 - protein, 11 aa, Artificial Sequence
  Synthetic Construct
AQAKGTALVAQ

SEQ ID NO: 8613 - protein, 11 aa, Artificial Sequence
  Synthetic Construct
AQRDTVQVYAQ

SEQ ID NO: 8614 - protein, 11 aa, Artificial Sequence
  Synthetic Construct
AQLGTKATHAQ

SEQ ID NO: 8615 - protein, 11 aa, Artificial Sequence
  Synthetic Construct
AQDNVRVTAAQ

SEQ ID NO: 8616 - protein, 11 aa, Artificial Sequence
  Synthetic Construct
AQTRPGSHTAQ

SEQ ID NO: 8617 - protein, 11 aa, Artificial Sequence
  Synthetic Construct
AQAQLAPRAAQ

SEQ ID NO: 8618 - protein, 11 aa, Artificial Sequence
  Synthetic Construct
AQSTMRTSLAQ

SEQ ID NO: 8619 - protein, 11 aa, Artificial Sequence
  Synthetic Construct
AQMNQTSAKAQ

SEQ ID NO: 8620 - protein, 11 aa, Artificial Sequence
  Synthetic Construct
AQSRSSPTIAQ

SEQ ID NO: 8621 - protein, 11 aa, Artificial Sequence
  Synthetic Construct
AQSALNQYPAQ

SEQ ID NO: 8622 - protein, 11 aa, Artificial Sequence
  Synthetic Construct
AQISTTTRNAQ

SEQ ID NO: 8623 - protein, 11 aa, Artificial Sequence
  Synthetic Construct
AQSRDTPSGAQ

SEQ ID NO: 8624 - protein, 11 aa, Artificial Sequence
  Synthetic Construct
AQNFNKQGLAQ

SEQ ID NO: 8625 - protein, 11 aa, Artificial Sequence
  Synthetic Construct
AQPSNTSSVAQ

SEQ ID NO: 8626 - protein, 11 aa, Artificial Sequence
  Synthetic Construct
AQTVSTNARAQ

SEQ ID NO: 8627 - protein, 11 aa, Artificial Sequence
  Synthetic Construct
AQNMSQTVAAQ

SEQ ID NO: 8628 - protein, 11 aa, Artificial Sequence
  Synthetic Construct
AQIGKSSTPAQ

SEQ ID NO: 8629 - protein, 11 aa, Artificial Sequence
  Synthetic Construct
AQRETETGRAQ

SEQ ID NO: 8630 - protein, 11 aa, Artificial Sequence
  Synthetic Construct
AQPYTPLTGAQ

SEQ ID NO: 8631 - protein, 11 aa, Artificial Sequence
  Synthetic Construct
AQAEYNTGVAQ

SEQ ID NO: 8632 - protein, 11 aa, Artificial Sequence
  Synthetic Construct
AQGRNAETRAQ

SEQ ID NO: 8633 - protein, 11 aa, Artificial Sequence
  Synthetic Construct
AQTFNHTTDAQ

SEQ ID NO: 8634 - protein, 11 aa, Artificial Sequence
  Synthetic Construct
AQTHLSTLGAQ

SEQ ID NO: 8635 - protein, 11 aa, Artificial Sequence
  Synthetic Construct
AQLKGISQHAQ

SEQ ID NO: 8636 - protein, 11 aa, Artificial Sequence
  Synthetic Construct
AQYSSGMTTAQ

SEQ ID NO: 8637 - protein, 11 aa, Artificial Sequence
  Synthetic Construct
AQTAITMTSAQ

SEQ ID NO: 8638 - protein, 11 aa, Artificial Sequence
  Synthetic Construct
AQRGNELNTAQ

SEQ ID NO: 8639 - protein, 11 aa, Artificial Sequence
  Synthetic Construct
AQVVSSQMAAQ

SEQ ID NO: 8640 - protein, 11 aa, Artificial Sequence
  Synthetic Construct
AQHQHENMVAQ

SEQ ID NO: 8641 - protein, 11 aa, Artificial Sequence
  Synthetic Construct
AQSFGGVPKAQ

SEQ ID NO: 8642 - protein, 11 aa, Artificial Sequence
  Synthetic Construct
AQLMRDSKSAQ

SEQ ID NO: 8643 - protein, 11 aa, Artificial Sequence
  Synthetic Construct
AQMRTNLSMAQ

SEQ ID NO: 8644 - protein, 11 aa, Artificial Sequence
  Synthetic Construct
AQPNNPVVPAQ

SEQ ID NO: 8645 - protein, 11 aa, Artificial Sequence
  Synthetic Construct
AQRVSQSMGAQ

SEQ ID NO: 8646 - protein, 11 aa, Artificial Sequence
  Synthetic Construct
AQAEGPQKTAQ

SEQ ID NO: 8647 - protein, 11 aa, Artificial Sequence
  Synthetic Construct
AQLNSVVHTAQ

SEQ ID NO: 8648 - protein, 11 aa, Artificial Sequence
  Synthetic Construct
AQLLTLNSAAQ

SEQ ID NO: 8649 - protein, 11 aa, Artificial Sequence
  Synthetic Construct
AQTLAPRRDAQ

SEQ ID NO: 8650 - protein, 11 aa, Artificial Sequence
  Synthetic Construct
AQRVANPATAQ

SEQ ID NO: 8651 - protein, 11 aa, Artificial Sequence
  Synthetic Construct
AQLPDPRLQAQ

SEQ ID NO: 8652 - protein, 11 aa, Artificial Sequence
  Synthetic Construct
AQKMDVGEAAQ

SEQ ID NO: 8653 - protein, 11 aa, Artificial Sequence
  Synthetic Construct
AQGPSPMVMAQ

SEQ ID NO: 8654 - protein, 11 aa, Artificial Sequence
  Synthetic Construct
AQGTNKATAAQ

SEQ ID NO: 8655 - protein, 11 aa, Artificial Sequence
  Synthetic Construct
AQLSAHGTTAQ

SEQ ID NO: 8656 - protein, 11 aa, Artificial Sequence
  Synthetic Construct
AQTSRYNSAAQ

SEQ ID NO: 8657 - protein, 11 aa, Artificial Sequence
  Synthetic Construct
AQGPNSSFKAQ

SEQ ID NO: 8658 - protein, 11 aa, Artificial Sequence
  Synthetic Construct
AQSVGRAPIAQ

SEQ ID NO: 8659 - protein, 11 aa, Artificial Sequence
  Synthetic Construct
AQFQGEKTWAQ

SEQ ID NO: 8660 - protein, 11 aa, Artificial Sequence
  Synthetic Construct
AQTSSARTIAQ

SEQ ID NO: 8661 - protein, 11 aa, Artificial Sequence
  Synthetic Construct
AQAERTGTAAQ

SEQ ID NO: 8662 - protein, 11 aa, Artificial Sequence
  Synthetic Construct
AQLNLGTPKAQ

SEQ ID NO: 8663 - protein, 11 aa, Artificial Sequence
  Synthetic Construct
AQAAPVGSRAQ

SEQ ID NO: 8664 - protein, 11 aa, Artificial Sequence
  Synthetic Construct
AQMRQANHPAQ

SEQ ID NO: 8665 - protein, 11 aa, Artificial Sequence
  Synthetic Construct
AQEQQRDVLAQ

SEQ ID NO: 8666 - protein, 11 aa, Artificial Sequence
  Synthetic Construct
AQPKSDELTAQ

SEQ ID NO: 8667 - protein, 11 aa, Artificial Sequence
  Synthetic Construct
AQNARVQETAQ

SEQ ID NO: 8668 - protein, 11 aa, Artificial Sequence
  Synthetic Construct
AQTTVATQSAQ

SEQ ID NO: 8669 - protein, 11 aa, Artificial Sequence
  Synthetic Construct
AQTEVSHRPAQ

SEQ ID NO: 8670 - protein, 11 aa, Artificial Sequence
  Synthetic Construct
AQSSTVKNVAQ

SEQ ID NO: 8671 - protein, 11 aa, Artificial Sequence
  Synthetic Construct
AQIDSHLNRAQ

SEQ ID NO: 8672 - protein, 11 aa, Artificial Sequence
  Synthetic Construct
AQGSTQLSLAQ

SEQ ID NO: 8673 - protein, 11 aa, Artificial Sequence
  Synthetic Construct
AQDGSPATKAQ

SEQ ID NO: 8674 - protein, 11 aa, Artificial Sequence
  Synthetic Construct
AQQTGNSQAAQ

SEQ ID NO: 8675 - protein, 11 aa, Artificial Sequence
  Synthetic Construct
AQRQDVNVSAQ

SEQ ID NO: 8676 - protein, 11 aa, Artificial Sequence
  Synthetic Construct
AQLDYGVKSAQ

SEQ ID NO: 8677 - protein, 11 aa, Artificial Sequence
  Synthetic Construct
AQGSRPEAPAQ

SEQ ID NO: 8678 - protein, 11 aa, Artificial Sequence
  Synthetic Construct
AQWSNMTAAAQ

SEQ ID NO: 8679 - protein, 11 aa, Artificial Sequence
  Synthetic Construct
AQTNTTRISAQ

SEQ ID NO: 8680 - protein, 11 aa, Artificial Sequence
  Synthetic Construct
AQPYAERQAAQ

SEQ ID NO: 8681 - protein, 11 aa, Artificial Sequence
  Synthetic Construct
AQTSSATVLAQ

SEQ ID NO: 8682 - protein, 11 aa, Artificial Sequence
  Synthetic Construct
AQAQTDFRQAQ

SEQ ID NO: 8683 - protein, 11 aa, Artificial Sequence
  Synthetic Construct
AQNSGNEHSAQ

SEQ ID NO: 8684 - protein, 11 aa, Artificial Sequence
  Synthetic Construct
AQKPLINATAQ

SEQ ID NO: 8685 - protein, 11 aa, Artificial Sequence
  Synthetic Construct
AQMGSSSAFAQ

SEQ ID NO: 8686 - protein, 11 aa, Artificial Sequence
  Synthetic Construct
AQIGNKTSLAQ

SEQ ID NO: 8687 - protein, 11 aa, Artificial Sequence
  Synthetic Construct
AQAANTAPKAQ

SEQ ID NO: 8688 - protein, 11 aa, Artificial Sequence
  Synthetic Construct
AQLVDQRATAQ

SEQ ID NO: 8689 - protein, 11 aa, Artificial Sequence
  Synthetic Construct
AQQVKLGSTAQ

SEQ ID NO: 8690 - protein, 11 aa, Artificial Sequence
  Synthetic Construct
AQLTSNTHVAQ

SEQ ID NO: 8691 - protein, 11 aa, Artificial Sequence
  Synthetic Construct
AQVYSAINKAQ

SEQ ID NO: 8692 - protein, 11 aa, Artificial Sequence
  Synthetic Construct
AQRANGSDLAQ

SEQ ID NO: 8693 - protein, 11 aa, Artificial Sequence
  Synthetic Construct
AQNLKSQTEAQ

SEQ ID NO: 8694 - protein, 11 aa, Artificial Sequence
  Synthetic Construct
AQSYGNEIRAQ

SEQ ID NO: 8695 - protein, 11 aa, Artificial Sequence
  Synthetic Construct
AQLTRGAIGAQ

SEQ ID NO: 8696 - protein, 11 aa, Artificial Sequence
  Synthetic Construct
AQPIRTVDTAQ

SEQ ID NO: 8697 - protein, 11 aa, Artificial Sequence
  Synthetic Construct
AQRSMPDGSAQ

SEQ ID NO: 8698 - protein, 11 aa, Artificial Sequence
  Synthetic Construct
AQTAHTGPLAQ

SEQ ID NO: 8699 - protein, 11 aa, Artificial Sequence
  Synthetic Construct
AQSQGSPLSAQ

SEQ ID NO: 8700 - protein, 11 aa, Artificial Sequence
  Synthetic Construct
AQLQAIAHSAQ

SEQ ID NO: 8701 - protein, 11 aa, Artificial Sequence
  Synthetic Construct
AQGNSLSTSAQ

SEQ ID NO: 8702 - protein, 11 aa, Artificial Sequence
  Synthetic Construct
AQLTHREAEAQ

SEQ ID NO: 8703 - protein, 11 aa, Artificial Sequence
  Synthetic Construct
AQTLHLAKEAQ

SEQ ID NO: 8704 - protein, 11 aa, Artificial Sequence
  Synthetic Construct
AQNISSSGKAQ

SEQ ID NO: 8705 - protein, 11 aa, Artificial Sequence
  Synthetic Construct
AQGRHMVMEAQ

SEQ ID NO: 8706 - protein, 11 aa, Artificial Sequence
  Synthetic Construct
AQGERFGGPAQ

SEQ ID NO: 8707 - protein, 11 aa, Artificial Sequence
  Synthetic Construct
AQYSGSSTKAQ

SEQ ID NO: 8708 - protein, 11 aa, Artificial Sequence
  Synthetic Construct
AQKESVSANAQ

SEQ ID NO: 8709 - protein, 11 aa, Artificial Sequence
  Synthetic Construct
AQITSDGKPAQ

SEQ ID NO: 8710 - protein, 11 aa, Artificial Sequence
  Synthetic Construct
AQGHDARVVAQ

SEQ ID NO: 8711 - protein, 11 aa, Artificial Sequence
  Synthetic Construct
AQTSSNGVRAQ

SEQ ID NO: 8712 - protein, 11 aa, Artificial Sequence
  Synthetic Construct
AQNHQNRSLAQ

SEQ ID NO: 8713 - protein, 11 aa, Artificial Sequence
  Synthetic Construct
AQRVPEQNVAQ

SEQ ID NO: 8714 - protein, 11 aa, Artificial Sequence
  Synthetic Construct
AQSAQLRSSAQ

SEQ ID NO: 8715 - protein, 11 aa, Artificial Sequence
  Synthetic Construct
AQHAKSETYAQ

SEQ ID NO: 8716 - protein, 11 aa, Artificial Sequence
  Synthetic Construct
AQLLTQVETAQ

SEQ ID NO: 8717 - protein, 11 aa, Artificial Sequence
  Synthetic Construct
AQTKTADTYAQ

SEQ ID NO: 8718 - protein, 11 aa, Artificial Sequence
  Synthetic Construct
AQVMPATLSAQ

SEQ ID NO: 8719 - protein, 11 aa, Artificial Sequence
  Synthetic Construct
AQYQANNLIAQ

SEQ ID NO: 8720 - protein, 11 aa, Artificial Sequence
  Synthetic Construct
AQVRVPDSSAQ

SEQ ID NO: 8721 - protein, 11 aa, Artificial Sequence
  Synthetic Construct
AQHQTGSGFAQ

SEQ ID NO: 8722 - protein, 11 aa, Artificial Sequence
  Synthetic Construct
AQSATLSGYAQ

SEQ ID NO: 8723 - protein, 11 aa, Artificial Sequence
  Synthetic Construct
AQNGSATYSAQ

SEQ ID NO: 8724 - protein, 11 aa, Artificial Sequence
  Synthetic Construct
AQSTRPTLTAQ

SEQ ID NO: 8725 - protein, 11 aa, Artificial Sequence
  Synthetic Construct
AQRPADVSQAQ

SEQ ID NO: 8726 - protein, 11 aa, Artificial Sequence
  Synthetic Construct
AQSHLSSTGAQ

SEQ ID NO: 8727 - protein, 11 aa, Artificial Sequence
  Synthetic Construct
AQANQSYDRAQ

SEQ ID NO: 8728 - protein, 11 aa, Artificial Sequence
  Synthetic Construct
AQSSGDRTAAQ

SEQ ID NO: 8729 - protein, 11 aa, Artificial Sequence
  Synthetic Construct
AQGSVPGLNAQ

SEQ ID NO: 8730 - protein, 11 aa, Artificial Sequence
  Synthetic Construct
AQLVTIHSAAQ

SEQ ID NO: 8731 - protein, 11 aa, Artificial Sequence
  Synthetic Construct
AQPQHETTLAQ

SEQ ID NO: 8732 - protein, 11 aa, Artificial Sequence
  Synthetic Construct
AQPTKSAQYAQ

SEQ ID NO: 8733 - protein, 11 aa, Artificial Sequence
  Synthetic Construct
AQKKDPVLGAQ

SEQ ID NO: 8734 - protein, 11 aa, Artificial Sequence
  Synthetic Construct
AQFRVGPSAAQ

SEQ ID NO: 8735 - protein, 11 aa, Artificial Sequence
  Synthetic Construct
AQTSSGHAVAQ

SEQ ID NO: 8736 - protein, 11 aa, Artificial Sequence
  Synthetic Construct
AQRVGEARMAQ

SEQ ID NO: 8737 - protein, 11 aa, Artificial Sequence
  Synthetic Construct
AQRVTSPSKAQ

SEQ ID NO: 8738 - protein, 11 aa, Artificial Sequence
  Synthetic Construct
AQDRMPSTIAQ

SEQ ID NO: 8739 - protein, 11 aa, Artificial Sequence
  Synthetic Construct
AQQGDTSKHAQ

SEQ ID NO: 8740 - protein, 11 aa, Artificial Sequence
  Synthetic Construct
AQSTSSNRAAQ

SEQ ID NO: 8741 - protein, 11 aa, Artificial Sequence
  Synthetic Construct
AQKVPTGYTAQ

SEQ ID NO: 8742 - protein, 11 aa, Artificial Sequence
  Synthetic Construct
AQFKGQRNDAQ

SEQ ID NO: 8743 - protein, 11 aa, Artificial Sequence
  Synthetic Construct
AQGNHLGNEAQ

SEQ ID NO: 8744 - protein, 11 aa, Artificial Sequence
  Synthetic Construct
AQASKSFELAQ

SEQ ID NO: 8745 - protein, 11 aa, Artificial Sequence
  Synthetic Construct
AQTVRDTTRAQ

SEQ ID NO: 8746 - protein, 11 aa, Artificial Sequence
  Synthetic Construct
AQKVSPNTLAQ

SEQ ID NO: 8747 - protein, 11 aa, Artificial Sequence
  Synthetic Construct
AQGRTPESYAQ

SEQ ID NO: 8748 - protein, 11 aa, Artificial Sequence
  Synthetic Construct
AQQVSGVRTAQ

SEQ ID NO: 8749 - protein, 11 aa, Artificial Sequence
  Synthetic Construct
AQYTGISTSAQ

SEQ ID NO: 8750 - protein, 11 aa, Artificial Sequence
  Synthetic Construct
AQQTAEPHKAQ

SEQ ID NO: 8751 - protein, 11 aa, Artificial Sequence
  Synthetic Construct
AQLGPVGSPAQ

SEQ ID NO: 8752 - protein, 11 aa, Artificial Sequence
  Synthetic Construct
AQARDDSTDAQ

SEQ ID NO: 8753 - protein, 11 aa, Artificial Sequence
  Synthetic Construct
AQNFKHSEVAQ

SEQ ID NO: 8754 - protein, 11 aa, Artificial Sequence
  Synthetic Construct
AQITTPLQAAQ

SEQ ID NO: 8755 - protein, 11 aa, Artificial Sequence
  Synthetic Construct
AQPMSSRERAQ

SEQ ID NO: 8756 - protein, 11 aa, Artificial Sequence
  Synthetic Construct
AQVENGKGLAQ

SEQ ID NO: 8757 - protein, 11 aa, Artificial Sequence
  Synthetic Construct
AQTSNSGLAAQ

SEQ ID NO: 8758 - protein, 11 aa, Artificial Sequence
  Synthetic Construct
AQGNSLANPAQ

SEQ ID NO: 8759 - protein, 11 aa, Artificial Sequence
  Synthetic Construct
AQASNEAHAAQ

SEQ ID NO: 8760 - protein, 11 aa, Artificial Sequence
  Synthetic Construct
AQGLAGSTPAQ

SEQ ID NO: 8761 - protein, 11 aa, Artificial Sequence
  Synthetic Construct
AQVPAPGRYAQ

SEQ ID NO: 8762 - protein, 11 aa, Artificial Sequence
  Synthetic Construct
AQASDRLIAAQ

SEQ ID NO: 8763 - protein, 11 aa, Artificial Sequence
  Synthetic Construct
AQISTWQTQAQ

SEQ ID NO: 8764 - protein, 11 aa, Artificial Sequence
  Synthetic Construct
AQITSGATVAQ

SEQ ID NO: 8765 - protein, 11 aa, Artificial Sequence
  Synthetic Construct
AQLAKASNVAQ

SEQ ID NO: 8766 - protein, 11 aa, Artificial Sequence
  Synthetic Construct
AQPQGTFGSAQ

SEQ ID NO: 8767 - protein, 11 aa, Artificial Sequence
  Synthetic Construct
AQIVRPPNSAQ

SEQ ID NO: 8768 - protein, 11 aa, Artificial Sequence
  Synthetic Construct
AQTSHLTSAAQ

SEQ ID NO: 8769 - protein, 11 aa, Artificial Sequence
  Synthetic Construct
AQLHPETMRAQ

SEQ ID NO: 8770 - protein, 11 aa, Artificial Sequence
  Synthetic Construct
AQVLHDTRYAQ

SEQ ID NO: 8771 - protein, 11 aa, Artificial Sequence
  Synthetic Construct
AQVSNPPRGAQ

SEQ ID NO: 8772 - protein, 11 aa, Artificial Sequence
  Synthetic Construct
AQEPLMTRPAQ

SEQ ID NO: 8773 - protein, 11 aa, Artificial Sequence
  Synthetic Construct
AQDRVSSSHAQ

SEQ ID NO: 8774 - protein, 11 aa, Artificial Sequence
  Synthetic Construct
AQTKTGHSSAQ

SEQ ID NO: 8775 - protein, 11 aa, Artificial Sequence
  Synthetic Construct
AQSSYSPVTAQ

SEQ ID NO: 8776 - protein, 11 aa, Artificial Sequence
  Synthetic Construct
AQKPNLQNNAQ

SEQ ID NO: 8777 - protein, 11 aa, Artificial Sequence
  Synthetic Construct
AQLKSPPGIAQ

SEQ ID NO: 8778 - protein, 11 aa, Artificial Sequence
  Synthetic Construct
AQGMQLGMPAQ

SEQ ID NO: 8779 - protein, 11 aa, Artificial Sequence
  Synthetic Construct
AQHQANLTLAQ

SEQ ID NO: 8780 - protein, 11 aa, Artificial Sequence
  Synthetic Construct
AQTGHPTTAAQ

SEQ ID NO: 8781 - protein, 11 aa, Artificial Sequence
  Synthetic Construct
AQFIGSHLGAQ

SEQ ID NO: 8782 - protein, 11 aa, Artificial Sequence
  Synthetic Construct
AQRNESNGPAQ

SEQ ID NO: 8783 - protein, 11 aa, Artificial Sequence
  Synthetic Construct
AQKIETNGNAQ

SEQ ID NO: 8784 - protein, 11 aa, Artificial Sequence
  Synthetic Construct
AQYLQNGVVAQ

SEQ ID NO: 8785 - protein, 11 aa, Artificial Sequence
  Synthetic Construct
AQRPGMLGTAQ

SEQ ID NO: 8786 - protein, 11 aa, Artificial Sequence
  Synthetic Construct
AQLTQIGTAAQ

SEQ ID NO: 8787 - protein, 11 aa, Artificial Sequence
  Synthetic Construct
AQNEDVQRAAQ

SEQ ID NO: 8788 - protein, 11 aa, Artificial Sequence
  Synthetic Construct
AQHLADQSRAQ

SEQ ID NO: 8789 - protein, 11 aa, Artificial Sequence
  Synthetic Construct
AQLGNDTVRAQ

SEQ ID NO: 8790 - protein, 11 aa, Artificial Sequence
  Synthetic Construct
AQNNHHVPPAQ

SEQ ID NO: 8791 - protein, 11 aa, Artificial Sequence
  Synthetic Construct
AQDKAGTLSAQ

SEQ ID NO: 8792 - protein, 11 aa, Artificial Sequence
  Synthetic Construct
AQRTKNESMAQ

SEQ ID NO: 8793 - protein, 11 aa, Artificial Sequence
  Synthetic Construct
AQFNVVRGDAQ

SEQ ID NO: 8794 - protein, 11 aa, Artificial Sequence
  Synthetic Construct
AQIVRGMNQAQ

SEQ ID NO: 8795 - protein, 11 aa, Artificial Sequence
  Synthetic Construct
AQQHTPTLNAQ

SEQ ID NO: 8796 - protein, 11 aa, Artificial Sequence
  Synthetic Construct
AQSLGKEPLAQ

SEQ ID NO: 8797 - protein, 11 aa, Artificial Sequence
  Synthetic Construct
AQSSGHGLNAQ

SEQ ID NO: 8798 - protein, 11 aa, Artificial Sequence
  Synthetic Construct
AQRINSDSTAQ

SEQ ID NO: 8799 - protein, 11 aa, Artificial Sequence
  Synthetic Construct
AQNPHNHPVAQ

SEQ ID NO: 8800 - protein, 11 aa, Artificial Sequence
  Synthetic Construct
AQSHKPSTVAQ

SEQ ID NO: 8801 - protein, 11 aa, Artificial Sequence
  Synthetic Construct
AQSSMSTTYAQ

SEQ ID NO: 8802 - protein, 11 aa, Artificial Sequence
  Synthetic Construct
AQGAAASNPAQ

SEQ ID NO: 8803 - protein, 11 aa, Artificial Sequence
  Synthetic Construct
AQMNQREQKAQ

SEQ ID NO: 8804 - protein, 11 aa, Artificial Sequence
  Synthetic Construct
AQSYPSNPRAQ

SEQ ID NO: 8805 - protein, 11 aa, Artificial Sequence
  Synthetic Construct
AQLRDFVTDAQ

SEQ ID NO: 8806 - protein, 11 aa, Artificial Sequence
  Synthetic Construct
AQNNTVMRSAQ

SEQ ID NO: 8807 - protein, 11 aa, Artificial Sequence
  Synthetic Construct
AQLSPRKYIAQ

SEQ ID NO: 8808 - protein, 11 aa, Artificial Sequence
  Synthetic Construct
AQHIRPPSPAQ

SEQ ID NO: 8809 - protein, 11 aa, Artificial Sequence
  Synthetic Construct
AQPYVSTTAAQ

SEQ ID NO: 8810 - protein, 11 aa, Artificial Sequence
  Synthetic Construct
AQVNHGSPTAQ

SEQ ID NO: 8811 - protein, 11 aa, Artificial Sequence
  Synthetic Construct
AQSGYLNGAAQ

SEQ ID NO: 8812 - protein, 11 aa, Artificial Sequence
  Synthetic Construct
AQSRERTSDAQ

SEQ ID NO: 8813 - protein, 11 aa, Artificial Sequence
  Synthetic Construct
AQTHSVTRSAQ

SEQ ID NO: 8814 - protein, 11 aa, Artificial Sequence
  Synthetic Construct
AQLVANKNAAQ

SEQ ID NO: 8815 - protein, 11 aa, Artificial Sequence
  Synthetic Construct
AQNFTDRATAQ

SEQ ID NO: 8816 - protein, 11 aa, Artificial Sequence
  Synthetic Construct
AQYRTSTLAAQ

SEQ ID NO: 8817 - protein, 11 aa, Artificial Sequence
  Synthetic Construct
AQHVMNKQAAQ

SEQ ID NO: 8818 - protein, 11 aa, Artificial Sequence
  Synthetic Construct
AQATNNPASAQ

SEQ ID NO: 8819 - protein, 11 aa, Artificial Sequence
  Synthetic Construct
AQTIMKAQTAQ

SEQ ID NO: 8820 - protein, 11 aa, Artificial Sequence
  Synthetic Construct
AQGMSTMTPAQ

SEQ ID NO: 8821 - protein, 11 aa, Artificial Sequence
  Synthetic Construct
AQGTPIYKQAQ

SEQ ID NO: 8822 - protein, 11 aa, Artificial Sequence
  Synthetic Construct
AQNGTLEKAAQ

SEQ ID NO: 8823 - protein, 11 aa, Artificial Sequence
  Synthetic Construct
AQSNERTIPAQ

SEQ ID NO: 8824 - protein, 11 aa, Artificial Sequence
  Synthetic Construct
AQIPVSIQAAQ

SEQ ID NO: 8825 - protein, 11 aa, Artificial Sequence
  Synthetic Construct
AQNLQREGPAQ

SEQ ID NO: 8826 - protein, 11 aa, Artificial Sequence
  Synthetic Construct
AQGEGGKSNAQ

SEQ ID NO: 8827 - protein, 11 aa, Artificial Sequence
  Synthetic Construct
AQLQGNGRNAQ

SEQ ID NO: 8828 - protein, 11 aa, Artificial Sequence
  Synthetic Construct
AQLVSSTSEAQ

SEQ ID NO: 8829 - protein, 11 aa, Artificial Sequence
  Synthetic Construct
AQSLAGNTTAQ

SEQ ID NO: 8830 - protein, 11 aa, Artificial Sequence
  Synthetic Construct
AQLTVGNNVAQ

SEQ ID NO: 8831 - protein, 11 aa, Artificial Sequence
  Synthetic Construct
AQSILTRDSAQ

SEQ ID NO: 8832 - protein, 11 aa, Artificial Sequence
  Synthetic Construct
AQVLVDSRAAQ

SEQ ID NO: 8833 - protein, 11 aa, Artificial Sequence
  Synthetic Construct
AQGVASTTTAQ

SEQ ID NO: 8834 - protein, 11 aa, Artificial Sequence
  Synthetic Construct
AQHGANLSVAQ

SEQ ID NO: 8835 - protein, 11 aa, Artificial Sequence
  Synthetic Construct
AQSFNQPSVAQ

SEQ ID NO: 8836 - protein, 11 aa, Artificial Sequence
  Synthetic Construct
AQLNQNQRVAQ

SEQ ID NO: 8837 - protein, 11 aa, Artificial Sequence
  Synthetic Construct
AQRIDSQDTAQ

SEQ ID NO: 8838 - protein, 11 aa, Artificial Sequence
  Synthetic Construct
AQTVPGRPSAQ

SEQ ID NO: 8839 - protein, 11 aa, Artificial Sequence
  Synthetic Construct
AQREPNNTSAQ

SEQ ID NO: 8840 - protein, 11 aa, Artificial Sequence
  Synthetic Construct
AQERMTMHAAQ

SEQ ID NO: 8841 - protein, 11 aa, Artificial Sequence
  Synthetic Construct
AQIAIQNDRAQ

SEQ ID NO: 8842 - protein, 11 aa, Artificial Sequence
  Synthetic Construct
AQLGAQSISAQ

SEQ ID NO: 8843 - protein, 11 aa, Artificial Sequence
  Synthetic Construct
AQAGDKTYVAQ

SEQ ID NO: 8844 - protein, 11 aa, Artificial Sequence
  Synthetic Construct
AQMNRTAYTAQ

SEQ ID NO: 8845 - protein, 11 aa, Artificial Sequence
  Synthetic Construct
AQALPGGLMAQ

SEQ ID NO: 8846 - protein, 11 aa, Artificial Sequence
  Synthetic Construct
AQLKNHDTTAQ

SEQ ID NO: 8847 - protein, 11 aa, Artificial Sequence
  Synthetic Construct
AQPLNYALEAQ

SEQ ID NO: 8848 - protein, 11 aa, Artificial Sequence
  Synthetic Construct
AQSKQMHNDAQ

SEQ ID NO: 8849 - protein, 11 aa, Artificial Sequence
  Synthetic Construct
AQTAHTTPFAQ

SEQ ID NO: 8850 - protein, 11 aa, Artificial Sequence
  Synthetic Construct
AQLKTGDSQAQ

SEQ ID NO: 8851 - protein, 11 aa, Artificial Sequence
  Synthetic Construct
AQYSTTAEYAQ

SEQ ID NO: 8852 - protein, 11 aa, Artificial Sequence
  Synthetic Construct
AQPLDRTGEAQ

SEQ ID NO: 8853 - protein, 11 aa, Artificial Sequence
  Synthetic Construct
AQGPGEVKIAQ

SEQ ID NO: 8854 - protein, 11 aa, Artificial Sequence
  Synthetic Construct
AQLRNLDLNAQ

SEQ ID NO: 8855 - protein, 11 aa, Artificial Sequence
  Synthetic Construct
AQLGSTLTKAQ

SEQ ID NO: 8856 - protein, 11 aa, Artificial Sequence
  Synthetic Construct
AQLRPVSEHAQ

SEQ ID NO: 8857 - protein, 11 aa, Artificial Sequence
  Synthetic Construct
AQSRSLTEMAQ

SEQ ID NO: 8858 - protein, 11 aa, Artificial Sequence
  Synthetic Construct
AQNGLSTTMAQ

SEQ ID NO: 8859 - protein, 11 aa, Artificial Sequence
  Synthetic Construct
AQHDKTYAMAQ

SEQ ID NO: 8860 - protein, 11 aa, Artificial Sequence
  Synthetic Construct
AQVPSDKMRAQ

SEQ ID NO: 8861 - protein, 11 aa, Artificial Sequence
  Synthetic Construct
AQGAHNLLTAQ

SEQ ID NO: 8862 - protein, 11 aa, Artificial Sequence
  Synthetic Construct
AQSTSTMVMAQ

SEQ ID NO: 8863 - protein, 11 aa, Artificial Sequence
  Synthetic Construct
AQNMAHESKAQ

SEQ ID NO: 8864 - protein, 11 aa, Artificial Sequence
  Synthetic Construct
AQYLGVGATAQ

SEQ ID NO: 8865 - protein, 11 aa, Artificial Sequence
  Synthetic Construct
AQASEYNQHAQ

SEQ ID NO: 8866 - protein, 11 aa, Artificial Sequence
  Synthetic Construct
AQRAEGDKIAQ

SEQ ID NO: 8867 - protein, 11 aa, Artificial Sequence
  Synthetic Construct
AQSSGSSFHAQ

SEQ ID NO: 8868 - protein, 11 aa, Artificial Sequence
  Synthetic Construct
AQWGKEYTGAQ

SEQ ID NO: 8869 - protein, 11 aa, Artificial Sequence
  Synthetic Construct
AQPASGAMPAQ

SEQ ID NO: 8870 - protein, 11 aa, Artificial Sequence
  Synthetic Construct
AQRGAVVVAAQ

SEQ ID NO: 8871 - protein, 11 aa, Artificial Sequence
  Synthetic Construct
AQVMMQNHAAQ

SEQ ID NO: 8872 - protein, 11 aa, Artificial Sequence
  Synthetic Construct
AQQDRLQSRAQ

SEQ ID NO: 8873 - protein, 11 aa, Artificial Sequence
  Synthetic Construct
AQGHAAVSVAQ

SEQ ID NO: 8874 - protein, 11 aa, Artificial Sequence
  Synthetic Construct
AQDKTDSTPAQ

SEQ ID NO: 8875 - protein, 11 aa, Artificial Sequence
  Synthetic Construct
AQVPPTSFTAQ

SEQ ID NO: 8876 - protein, 11 aa, Artificial Sequence
  Synthetic Construct
AQVGPNAQHAQ

SEQ ID NO: 8877 - protein, 11 aa, Artificial Sequence
  Synthetic Construct
AQHHGRADTAQ

SEQ ID NO: 8878 - protein, 11 aa, Artificial Sequence
  Synthetic Construct
AQHVNMGPAAQ

SEQ ID NO: 8879 - protein, 11 aa, Artificial Sequence
  Synthetic Construct
AQHATKETSAQ

SEQ ID NO: 8880 - protein, 11 aa, Artificial Sequence
  Synthetic Construct
AQLATGVSNAQ

SEQ ID NO: 8881 - protein, 11 aa, Artificial Sequence
  Synthetic Construct
AQSLGSYPTAQ

SEQ ID NO: 8882 - protein, 11 aa, Artificial Sequence
  Synthetic Construct
AQGSKAYVGAQ

SEQ ID NO: 8883 - protein, 11 aa, Artificial Sequence
  Synthetic Construct
AQQDRMSVNAQ

SEQ ID NO: 8884 - protein, 11 aa, Artificial Sequence
  Synthetic Construct
AQWSDSLRDAQ

SEQ ID NO: 8885 - protein, 11 aa, Artificial Sequence
  Synthetic Construct
AQTKVPMTQAQ

SEQ ID NO: 8886 - protein, 11 aa, Artificial Sequence
  Synthetic Construct
AQSPLSDRLAQ

SEQ ID NO: 8887 - protein, 11 aa, Artificial Sequence
  Synthetic Construct
AQLYGSSVVAQ

SEQ ID NO: 8888 - protein, 11 aa, Artificial Sequence
  Synthetic Construct
AQPTQTVSSAQ

SEQ ID NO: 8889 - protein, 11 aa, Artificial Sequence
  Synthetic Construct
AQLNKLLGAAQ

SEQ ID NO: 8890 - protein, 11 aa, Artificial Sequence
  Synthetic Construct
AQHSNQEPRAQ

SEQ ID NO: 8891 - protein, 11 aa, Artificial Sequence
  Synthetic Construct
AQNGASIHSAQ

SEQ ID NO: 8892 - protein, 11 aa, Artificial Sequence
  Synthetic Construct
AQLSQQRLQAQ

SEQ ID NO: 8893 - protein, 11 aa, Artificial Sequence
  Synthetic Construct
AQLPHGTMNAQ

SEQ ID NO: 8894 - protein, 11 aa, Artificial Sequence
  Synthetic Construct
AQSSPDAKYAQ

SEQ ID NO: 8895 - protein, 11 aa, Artificial Sequence
  Synthetic Construct
AQFHTPAGNAQ

SEQ ID NO: 8896 - protein, 11 aa, Artificial Sequence
  Synthetic Construct
AQRTTANSLAQ

SEQ ID NO: 8897 - protein, 11 aa, Artificial Sequence
  Synthetic Construct
AQLDKTIPQAQ

SEQ ID NO: 8898 - protein, 11 aa, Artificial Sequence
  Synthetic Construct
AQWQGNRQAAQ

SEQ ID NO: 8899 - protein, 11 aa, Artificial Sequence
  Synthetic Construct
AQGYGTITPAQ

SEQ ID NO: 8900 - protein, 11 aa, Artificial Sequence
  Synthetic Construct
AQMREQNKAAQ

SEQ ID NO: 8901 - protein, 11 aa, Artificial Sequence
  Synthetic Construct
AQNLAGLTGAQ

SEQ ID NO: 8902 - protein, 11 aa, Artificial Sequence
  Synthetic Construct
AQWFKAGSAAQ

SEQ ID NO: 8903 - protein, 11 aa, Artificial Sequence
  Synthetic Construct
AQINVAPYKAQ

SEQ ID NO: 8904 - protein, 11 aa, Artificial Sequence
  Synthetic Construct
AQGVHSNGQAQ

SEQ ID NO: 8905 - protein, 11 aa, Artificial Sequence
  Synthetic Construct
AQMSASTNTAQ

SEQ ID NO: 8906 - protein, 11 aa, Artificial Sequence
  Synthetic Construct
AQGSHNAQGAQ

SEQ ID NO: 8907 - protein, 11 aa, Artificial Sequence
  Synthetic Construct
AQISAVPKNAQ

SEQ ID NO: 8908 - protein, 11 aa, Artificial Sequence
  Synthetic Construct
AQAGGGMQNAQ

SEQ ID NO: 8909 - protein, 11 aa, Artificial Sequence
  Synthetic Construct
AQLLNTTSTAQ

SEQ ID NO: 8910 - protein, 11 aa, Artificial Sequence
  Synthetic Construct
AQTNTVSASAQ

SEQ ID NO: 8911 - protein, 11 aa, Artificial Sequence
  Synthetic Construct
AQQLSPIAMAQ

SEQ ID NO: 8912 - protein, 11 aa, Artificial Sequence
  Synthetic Construct
AQAPRGVNLAQ

SEQ ID NO: 8913 - protein, 11 aa, Artificial Sequence
  Synthetic Construct
AQLTRTSVDAQ

SEQ ID NO: 8914 - protein, 11 aa, Artificial Sequence
  Synthetic Construct
AQLGQKAPTAQ

SEQ ID NO: 8915 - protein, 11 aa, Artificial Sequence
  Synthetic Construct
AQKNAPPLTAQ

SEQ ID NO: 8916 - protein, 11 aa, Artificial Sequence
  Synthetic Construct
AQVRNAVHAAQ

SEQ ID NO: 8917 - protein, 11 aa, Artificial Sequence
  Synthetic Construct
AQIRHMDAPAQ

SEQ ID NO: 8918 - protein, 11 aa, Artificial Sequence
  Synthetic Construct
AQGAPLVATAQ

SEQ ID NO: 8919 - protein, 11 aa, Artificial Sequence
  Synthetic Construct
AQSDHNARGAQ

SEQ ID NO: 8920 - protein, 11 aa, Artificial Sequence
  Synthetic Construct
AQISDTLHYAQ

SEQ ID NO: 8921 - protein, 11 aa, Artificial Sequence
  Synthetic Construct
AQNNRGSISAQ

SEQ ID NO: 8922 - protein, 11 aa, Artificial Sequence
  Synthetic Construct
AQQRERDGVAQ

SEQ ID NO: 8923 - protein, 11 aa, Artificial Sequence
  Synthetic Construct
AQSKQDVRAAQ

SEQ ID NO: 8924 - protein, 11 aa, Artificial Sequence
  Synthetic Construct
AQNSGRLNVAQ

SEQ ID NO: 8925 - protein, 11 aa, Artificial Sequence
  Synthetic Construct
AQGPSVESNAQ

SEQ ID NO: 8926 - protein, 11 aa, Artificial Sequence
  Synthetic Construct
AQLLSSSPSAQ

SEQ ID NO: 8927 - protein, 11 aa, Artificial Sequence
  Synthetic Construct
AQKVLVSGSAQ

SEQ ID NO: 8928 - protein, 11 aa, Artificial Sequence
  Synthetic Construct
AQDVRNTIAAQ

SEQ ID NO: 8929 - protein, 11 aa, Artificial Sequence
  Synthetic Construct
AQHKLVTKDAQ

SEQ ID NO: 8930 - protein, 11 aa, Artificial Sequence
  Synthetic Construct
AQPYVSGVPAQ

SEQ ID NO: 8931 - protein, 11 aa, Artificial Sequence
  Synthetic Construct
AQTTKASFTAQ

SEQ ID NO: 8932 - protein, 11 aa, Artificial Sequence
  Synthetic Construct
AQTPHGPDAAQ

SEQ ID NO: 8933 - protein, 11 aa, Artificial Sequence
  Synthetic Construct
AQDYRQTDHAQ

SEQ ID NO: 8934 - protein, 11 aa, Artificial Sequence
  Synthetic Construct
AQHSPKPDHAQ

SEQ ID NO: 8935 - protein, 11 aa, Artificial Sequence
  Synthetic Construct
AQAYGQVPPAQ

SEQ ID NO: 8936 - protein, 11 aa, Artificial Sequence
  Synthetic Construct
AQSNQGLAGAQ

SEQ ID NO: 8937 - protein, 11 aa, Artificial Sequence
  Synthetic Construct
AQINSPIGNAQ

SEQ ID NO: 8938 - protein, 11 aa, Artificial Sequence
  Synthetic Construct
AQQNQIMSGAQ

SEQ ID NO: 8939 - protein, 11 aa, Artificial Sequence
  Synthetic Construct
AQVYQGNQNAQ

SEQ ID NO: 8940 - protein, 11 aa, Artificial Sequence
  Synthetic Construct
AQGSNSQHTAQ

SEQ ID NO: 8941 - protein, 11 aa, Artificial Sequence
  Synthetic Construct
AQKQEPSDRAQ

SEQ ID NO: 8942 - protein, 11 aa, Artificial Sequence
  Synthetic Construct
AQHRSSPAAAQ

SEQ ID NO: 8943 - protein, 11 aa, Artificial Sequence
  Synthetic Construct
AQNEGNSMKAQ

SEQ ID NO: 8944 - protein, 11 aa, Artificial Sequence
  Synthetic Construct
AQRPDKGPMAQ

SEQ ID NO: 8945 - protein, 11 aa, Artificial Sequence
  Synthetic Construct
AQAIVSHPLAQ

SEQ ID NO: 8946 - protein, 11 aa, Artificial Sequence
  Synthetic Construct
AQTQGERPVAQ

SEQ ID NO: 8947 - protein, 11 aa, Artificial Sequence
  Synthetic Construct
AQYVNSAPKAQ

SEQ ID NO: 8948 - protein, 11 aa, Artificial Sequence
  Synthetic Construct
AQPSGTSIVAQ

SEQ ID NO: 8949 - protein, 11 aa, Artificial Sequence
  Synthetic Construct
AQSVGANRSAQ

SEQ ID NO: 8950 - protein, 11 aa, Artificial Sequence
  Synthetic Construct
AQSAHFNHSAQ

SEQ ID NO: 8951 - protein, 11 aa, Artificial Sequence
  Synthetic Construct
AQKVNSAHLAQ

SEQ ID NO: 8952 - protein, 11 aa, Artificial Sequence
  Synthetic Construct
AQGFGNMGAAQ

SEQ ID NO: 8953 - protein, 11 aa, Artificial Sequence
  Synthetic Construct
AQNLKPETDAQ

SEQ ID NO: 8954 - protein, 11 aa, Artificial Sequence
  Synthetic Construct
AQPNSNTAFAQ

SEQ ID NO: 8955 - protein, 11 aa, Artificial Sequence
  Synthetic Construct
AQHDTLRTPAQ

SEQ ID NO: 8956 - protein, 11 aa, Artificial Sequence
  Synthetic Construct
AQRFPQAPPAQ

SEQ ID NO: 8957 - protein, 11 aa, Artificial Sequence
  Synthetic Construct
AQSSGNKSDAQ

SEQ ID NO: 8958 - protein, 11 aa, Artificial Sequence
  Synthetic Construct
AQMSKMADRAQ

SEQ ID NO: 8959 - protein, 11 aa, Artificial Sequence
  Synthetic Construct
AQEHRETSIAQ

SEQ ID NO: 8960 - protein, 11 aa, Artificial Sequence
  Synthetic Construct
AQSTEYPVPAQ

SEQ ID NO: 8961 - protein, 11 aa, Artificial Sequence
  Synthetic Construct
AQDKSMNPSAQ

SEQ ID NO: 8962 - protein, 11 aa, Artificial Sequence
  Synthetic Construct
AQEYHNNLKAQ

SEQ ID NO: 8963 - protein, 11 aa, Artificial Sequence
  Synthetic Construct
AQIFTNTGHAQ

SEQ ID NO: 8964 - protein, 11 aa, Artificial Sequence
  Synthetic Construct
AQKSNSPLAAQ

SEQ ID NO: 8965 - protein, 11 aa, Artificial Sequence
  Synthetic Construct
AQYSSGYNAAQ

SEQ ID NO: 8966 - protein, 11 aa, Artificial Sequence
  Synthetic Construct
AQGSKTQGDAQ

SEQ ID NO: 8967 - protein, 11 aa, Artificial Sequence
  Synthetic Construct
AQIVSGSSQAQ

SEQ ID NO: 8968 - protein, 11 aa, Artificial Sequence
  Synthetic Construct
AQSLINSTYAQ

SEQ ID NO: 8969 - protein, 11 aa, Artificial Sequence
  Synthetic Construct
AQNMKIQHVAQ

SEQ ID NO: 8970 - protein, 11 aa, Artificial Sequence
  Synthetic Construct
AQDSTKLGHAQ

SEQ ID NO: 8971 - protein, 11 aa, Artificial Sequence
  Synthetic Construct
AQQSHGTSSAQ

SEQ ID NO: 8972 - protein, 11 aa, Artificial Sequence
  Synthetic Construct
AQKDNNRSAAQ

SEQ ID NO: 8973 - protein, 11 aa, Artificial Sequence
  Synthetic Construct
AQFQPSYAAAQ

SEQ ID NO: 8974 - protein, 11 aa, Artificial Sequence
  Synthetic Construct
AQPTVQMKAAQ

SEQ ID NO: 8975 - protein, 11 aa, Artificial Sequence
  Synthetic Construct
AQSPTSSTFAQ

SEQ ID NO: 8976 - protein, 11 aa, Artificial Sequence
  Synthetic Construct
AQGRDANVPAQ

SEQ ID NO: 8977 - protein, 11 aa, Artificial Sequence
  Synthetic Construct
AQTLMSTSPAQ

SEQ ID NO: 8978 - protein, 11 aa, Artificial Sequence
  Synthetic Construct
AQLHGATTTAQ

SEQ ID NO: 8979 - protein, 11 aa, Artificial Sequence
  Synthetic Construct
AQRTNEVMRAQ

SEQ ID NO: 8980 - protein, 11 aa, Artificial Sequence
  Synthetic Construct
AQDNLRVTAAQ

SEQ ID NO: 8981 - protein, 11 aa, Artificial Sequence
  Synthetic Construct
AQRQAGDQLAQ

SEQ ID NO: 8982 - protein, 11 aa, Artificial Sequence
  Synthetic Construct
AQVGQHLTHAQ

SEQ ID NO: 8983 - protein, 11 aa, Artificial Sequence
  Synthetic Construct
AQLSAASGIAQ

SEQ ID NO: 8984 - protein, 11 aa, Artificial Sequence
  Synthetic Construct
AQSSHNGFIAQ

SEQ ID NO: 8985 - protein, 11 aa, Artificial Sequence
  Synthetic Construct
AQNATRQYSAQ

SEQ ID NO: 8986 - protein, 11 aa, Artificial Sequence
  Synthetic Construct
AQVSRQSLGAQ

SEQ ID NO: 8987 - protein, 11 aa, Artificial Sequence
  Synthetic Construct
AQDVVKPHGAQ

SEQ ID NO: 8988 - protein, 11 aa, Artificial Sequence
  Synthetic Construct
AQGIGGISSAQ

SEQ ID NO: 8989 - protein, 11 aa, Artificial Sequence
  Synthetic Construct
AQTNNSLREAQ

SEQ ID NO: 8990 - protein, 11 aa, Artificial Sequence
  Synthetic Construct
AQTRTASALAQ

SEQ ID NO: 8991 - protein, 11 aa, Artificial Sequence
  Synthetic Construct
AQTTTAPSPAQ

SEQ ID NO: 8992 - protein, 11 aa, Artificial Sequence
  Synthetic Construct
AQNASMSSIAQ

SEQ ID NO: 8993 - protein, 11 aa, Artificial Sequence
  Synthetic Construct
AQTQPHRGLAQ

SEQ ID NO: 8994 - protein, 11 aa, Artificial Sequence
  Synthetic Construct
AQRLDHHSSAQ

SEQ ID NO: 8995 - protein, 11 aa, Artificial Sequence
  Synthetic Construct
AQENTTRIAAQ

SEQ ID NO: 8996 - protein, 11 aa, Artificial Sequence
  Synthetic Construct
AQSLRGNEAAQ

SEQ ID NO: 8997 - protein, 11 aa, Artificial Sequence
  Synthetic Construct
AQPNVPSHSAQ

SEQ ID NO: 8998 - protein, 11 aa, Artificial Sequence
  Synthetic Construct
AQGMPLMKMAQ

SEQ ID NO: 8999 - protein, 11 aa, Artificial Sequence
  Synthetic Construct
AQQKTERTVAQ

SEQ ID NO: 9000 - protein, 11 aa, Artificial Sequence
  Synthetic Construct
AQNHTNHSSAQ

SEQ ID NO: 9001 - protein, 11 aa, Artificial Sequence
  Synthetic Construct
AQGLGNRSAAQ

SEQ ID NO: 9002 - protein, 11 aa, Artificial Sequence
  Synthetic Construct
AQDLDKRGLAQ

SEQ ID NO: 9003 - protein, 11 aa, Artificial Sequence
  Synthetic Construct
AQLTNAQPDAQ

SEQ ID NO: 9004 - protein, 11 aa, Artificial Sequence
  Synthetic Construct
AQTKPDYLVAQ

SEQ ID NO: 9005 - protein, 11 aa, Artificial Sequence
  Synthetic Construct
AQKLQLHEVAQ

SEQ ID NO: 9006 - protein, 11 aa, Artificial Sequence
  Synthetic Construct
AQTSVTISSAQ

SEQ ID NO: 9007 - protein, 11 aa, Artificial Sequence
  Synthetic Construct
AQNSSNRAEAQ

SEQ ID NO: 9008 - protein, 11 aa, Artificial Sequence
  Synthetic Construct
AQLEHGTRIAQ

SEQ ID NO: 9009 - protein, 11 aa, Artificial Sequence
  Synthetic Construct
AQTLQMREHAQ

SEQ ID NO: 9010 - protein, 11 aa, Artificial Sequence
  Synthetic Construct
AQGSPTAQTAQ

SEQ ID NO: 9011 - protein, 11 aa, Artificial Sequence
  Synthetic Construct
AQNKGQTLTAQ

SEQ ID NO: 9012 - protein, 11 aa, Artificial Sequence
  Synthetic Construct
AQSVGHRDMAQ

SEQ ID NO: 9013 - protein, 11 aa, Artificial Sequence
  Synthetic Construct
AQRDKSSMHAQ

SEQ ID NO: 9014 - protein, 11 aa, Artificial Sequence
  Synthetic Construct
AQVSVINNTAQ

SEQ ID NO: 9015 - protein, 11 aa, Artificial Sequence
  Synthetic Construct
AQLPNSAFSAQ

SEQ ID NO: 9016 - protein, 11 aa, Artificial Sequence
  Synthetic Construct
AQRTVSTDDAQ

SEQ ID NO: 9017 - protein, 11 aa, Artificial Sequence
  Synthetic Construct
AQLMDRMASAQ

SEQ ID NO: 9018 - protein, 11 aa, Artificial Sequence
  Synthetic Construct
AQPSGFNTLAQ

SEQ ID NO: 9019 - protein, 11 aa, Artificial Sequence
  Synthetic Construct
AQKSAQPMSAQ

SEQ ID NO: 9020 - protein, 11 aa, Artificial Sequence
  Synthetic Construct
AQTGLSVQKAQ

SEQ ID NO: 9021 - protein, 11 aa, Artificial Sequence
  Synthetic Construct
AQHGFPAGPAQ

SEQ ID NO: 9022 - protein, 11 aa, Artificial Sequence
  Synthetic Construct
AQSYEAVGIAQ

SEQ ID NO: 9023 - protein, 11 aa, Artificial Sequence
  Synthetic Construct
AQTAKGVLSAQ

SEQ ID NO: 9024 - protein, 11 aa, Artificial Sequence
  Synthetic Construct
AQGASTHNAAQ

SEQ ID NO: 9025 - protein, 11 aa, Artificial Sequence
  Synthetic Construct
AQIIKEIPAAQ

SEQ ID NO: 9026 - protein, 11 aa, Artificial Sequence
  Synthetic Construct
AQNHVISNGAQ

SEQ ID NO: 9027 - protein, 11 aa, Artificial Sequence
  Synthetic Construct
AQYTNMAGVAQ

SEQ ID NO: 9028 - protein, 11 aa, Artificial Sequence
  Synthetic Construct
AQFNRIGAGAQ

SEQ ID NO: 9029 - protein, 11 aa, Artificial Sequence
  Synthetic Construct
AQWSTMMKSAQ

SEQ ID NO: 9030 - protein, 11 aa, Artificial Sequence
  Synthetic Construct
AQTAPANHVAQ

SEQ ID NO: 9031 - protein, 11 aa, Artificial Sequence
  Synthetic Construct
AQMHGGSELAQ

SEQ ID NO: 9032 - protein, 11 aa, Artificial Sequence
  Synthetic Construct
AQMSRMGVAAQ

SEQ ID NO: 9033 - protein, 11 aa, Artificial Sequence
  Synthetic Construct
AQTRISEVLAQ

SEQ ID NO: 9034 - protein, 11 aa, Artificial Sequence
  Synthetic Construct
AQSGPGLRTAQ

SEQ ID NO: 9035 - protein, 11 aa, Artificial Sequence
  Synthetic Construct
AQDKRHHAEAQ

SEQ ID NO: 9036 - protein, 11 aa, Artificial Sequence
  Synthetic Construct
AQLTQNDRPAQ

SEQ ID NO: 9037 - protein, 11 aa, Artificial Sequence
  Synthetic Construct
AQSVTTSHVAQ

SEQ ID NO: 9038 - protein, 11 aa, Artificial Sequence
  Synthetic Construct
AQMLTGGTNAQ

SEQ ID NO: 9039 - protein, 11 aa, Artificial Sequence
  Synthetic Construct
AQDNVANAGAQ

SEQ ID NO: 9040 - protein, 11 aa, Artificial Sequence
  Synthetic Construct
AQMTTNSIAAQ

SEQ ID NO: 9041 - protein, 11 aa, Artificial Sequence
  Synthetic Construct
AQMRTQSLSAQ

SEQ ID NO: 9042 - protein, 11 aa, Artificial Sequence
  Synthetic Construct
AQYGSFTGQAQ

SEQ ID NO: 9043 - protein, 11 aa, Artificial Sequence
  Synthetic Construct
AQGPMLLKAAQ

SEQ ID NO: 9044 - protein, 11 aa, Artificial Sequence
  Synthetic Construct
AQMTQKAPVAQ

SEQ ID NO: 9045 - protein, 11 aa, Artificial Sequence
  Synthetic Construct
AQSANATKLAQ

SEQ ID NO: 9046 - protein, 11 aa, Artificial Sequence
  Synthetic Construct
AQFNGSLAMAQ

SEQ ID NO: 9047 - protein, 11 aa, Artificial Sequence
  Synthetic Construct
AQIVNAKLTAQ

SEQ ID NO: 9048 - protein, 11 aa, Artificial Sequence
  Synthetic Construct
AQMFSGLQAAQ

SEQ ID NO: 9049 - protein, 11 aa, Artificial Sequence
  Synthetic Construct
AQVDYRVNGAQ

SEQ ID NO: 9050 - protein, 11 aa, Artificial Sequence
  Synthetic Construct
AQLASAGNGAQ

SEQ ID NO: 9051 - protein, 11 aa, Artificial Sequence
  Synthetic Construct
AQRDLHSKDAQ

SEQ ID NO: 9052 - protein, 11 aa, Artificial Sequence
  Synthetic Construct
AQSHVSRTAAQ

SEQ ID NO: 9053 - protein, 11 aa, Artificial Sequence
  Synthetic Construct
AQTPVQSLSAQ

SEQ ID NO: 9054 - protein, 11 aa, Artificial Sequence
  Synthetic Construct
AQYLNGSELAQ

SEQ ID NO: 9055 - protein, 11 aa, Artificial Sequence
  Synthetic Construct
AQPALKTHEAQ

SEQ ID NO: 9056 - protein, 11 aa, Artificial Sequence
  Synthetic Construct
AQNKSLTSDAQ

SEQ ID NO: 9057 - protein, 11 aa, Artificial Sequence
  Synthetic Construct
AQYNATKSSAQ

SEQ ID NO: 9058 - protein, 11 aa, Artificial Sequence
  Synthetic Construct
AQMRDKSHDAQ

SEQ ID NO: 9059 - protein, 11 aa, Artificial Sequence
  Synthetic Construct
AQHRTEGQNAQ

SEQ ID NO: 9060 - protein, 11 aa, Artificial Sequence
  Synthetic Construct
AQLHKPDEFAQ

SEQ ID NO: 9061 - protein, 11 aa, Artificial Sequence
  Synthetic Construct
AQIAARPPSAQ

SEQ ID NO: 9062 - protein, 11 aa, Artificial Sequence
  Synthetic Construct
AQTPTHYSHAQ

SEQ ID NO: 9063 - protein, 11 aa, Artificial Sequence
  Synthetic Construct
AQSTFSADRAQ

SEQ ID NO: 9064 - protein, 11 aa, Artificial Sequence
  Synthetic Construct
AQQSVQVTAAQ

SEQ ID NO: 9065 - protein, 11 aa, Artificial Sequence
  Synthetic Construct
AQLDSSRNRAQ

SEQ ID NO: 9066 - protein, 11 aa, Artificial Sequence
  Synthetic Construct
AQRQPQSTVAQ

SEQ ID NO: 9067 - protein, 11 aa, Artificial Sequence
  Synthetic Construct
AQRVDDGVRAQ

SEQ ID NO: 9068 - protein, 11 aa, Artificial Sequence
  Synthetic Construct
AQKITNTYSAQ

SEQ ID NO: 9069 - protein, 11 aa, Artificial Sequence
  Synthetic Construct
AQPGKATPPAQ

SEQ ID NO: 9070 - protein, 11 aa, Artificial Sequence
  Synthetic Construct
AQFSTHTPPAQ

SEQ ID NO: 9071 - protein, 11 aa, Artificial Sequence
  Synthetic Construct
AQLAPNMRLAQ

SEQ ID NO: 9072 - protein, 11 aa, Artificial Sequence
  Synthetic Construct
AQNLPRTNVAQ

SEQ ID NO: 9073 - protein, 11 aa, Artificial Sequence
  Synthetic Construct
AQETSNVNRAQ

SEQ ID NO: 9074 - protein, 11 aa, Artificial Sequence
  Synthetic Construct
AQGSTDHRLAQ

SEQ ID NO: 9075 - protein, 11 aa, Artificial Sequence
  Synthetic Construct
AQVNTAMPAAQ

SEQ ID NO: 9076 - protein, 11 aa, Artificial Sequence
  Synthetic Construct
AQMVARDQNAQ

SEQ ID NO: 9077 - protein, 11 aa, Artificial Sequence
  Synthetic Construct
AQKNNPVLHAQ

SEQ ID NO: 9078 - protein, 11 aa, Artificial Sequence
  Synthetic Construct
AQDSTTVRLAQ

SEQ ID NO: 9079 - protein, 11 aa, Artificial Sequence
  Synthetic Construct
AQKLNVMNDAQ

SEQ ID NO: 9080 - protein, 11 aa, Artificial Sequence
  Synthetic Construct
AQSLRDKNAAQ

SEQ ID NO: 9081 - protein, 11 aa, Artificial Sequence
  Synthetic Construct
AQGVGNSLSAQ

SEQ ID NO: 9082 - protein, 11 aa, Artificial Sequence
  Synthetic Construct
AQFSKTNFNAQ

SEQ ID NO: 9083 - protein, 11 aa, Artificial Sequence
  Synthetic Construct
AQANRPSLPAQ

SEQ ID NO: 9084 - protein, 11 aa, Artificial Sequence
  Synthetic Construct
AQDSQTNRVAQ

SEQ ID NO: 9085 - protein, 11 aa, Artificial Sequence
  Synthetic Construct
AQISTSSPVAQ

SEQ ID NO: 9086 - protein, 11 aa, Artificial Sequence
  Synthetic Construct
AQILKITEGAQ

SEQ ID NO: 9087 - protein, 11 aa, Artificial Sequence
  Synthetic Construct
AQFRPASEIAQ

SEQ ID NO: 9088 - protein, 11 aa, Artificial Sequence
  Synthetic Construct
AQKKDSEPLAQ

SEQ ID NO: 9089 - protein, 11 aa, Artificial Sequence
  Synthetic Construct
AQNARPLTAAQ

SEQ ID NO: 9090 - protein, 11 aa, Artificial Sequence
  Synthetic Construct
AQKAARMETAQ

SEQ ID NO: 9091 - protein, 11 aa, Artificial Sequence
  Synthetic Construct
AQHANVSSRAQ

SEQ ID NO: 9092 - protein, 11 aa, Artificial Sequence
  Synthetic Construct
AQTSTTQTSAQ

SEQ ID NO: 9093 - protein, 11 aa, Artificial Sequence
  Synthetic Construct
AQSALSLSPAQ

SEQ ID NO: 9094 - protein, 11 aa, Artificial Sequence
  Synthetic Construct
AQANVQIQSAQ

SEQ ID NO: 9095 - protein, 11 aa, Artificial Sequence
  Synthetic Construct
AQTPSSNSLAQ

SEQ ID NO: 9096 - protein, 11 aa, Artificial Sequence
  Synthetic Construct
AQTMTGPGHAQ

SEQ ID NO: 9097 - protein, 11 aa, Artificial Sequence
  Synthetic Construct
AQITAQITNAQ

SEQ ID NO: 9098 - protein, 11 aa, Artificial Sequence
  Synthetic Construct
AQLPNPSSRAQ

SEQ ID NO: 9099 - protein, 11 aa, Artificial Sequence
  Synthetic Construct
AQKMGTMTPAQ

SEQ ID NO: 9100 - protein, 11 aa, Artificial Sequence
  Synthetic Construct
AQYTNGRINAQ

SEQ ID NO: 9101 - protein, 11 aa, Artificial Sequence
  Synthetic Construct
AQDGSNVVKAQ

SEQ ID NO: 9102 - protein, 11 aa, Artificial Sequence
  Synthetic Construct
AQLPLSIPAAQ

SEQ ID NO: 9103 - protein, 11 aa, Artificial Sequence
  Synthetic Construct
AQESRLSSSAQ

SEQ ID NO: 9104 - protein, 11 aa, Artificial Sequence
  Synthetic Construct
AQMSPSRGNAQ

SEQ ID NO: 9105 - protein, 11 aa, Artificial Sequence
  Synthetic Construct
AQSVHAAKQAQ

SEQ ID NO: 9106 - protein, 11 aa, Artificial Sequence
  Synthetic Construct
AQAFSSGTSAQ

SEQ ID NO: 9107 - protein, 11 aa, Artificial Sequence
  Synthetic Construct
AQTGWSPSPAQ

SEQ ID NO: 9108 - protein, 11 aa, Artificial Sequence
  Synthetic Construct
AQASHSASGAQ

SEQ ID NO: 9109 - protein, 11 aa, Artificial Sequence
  Synthetic Construct
AQVTPRSPLAQ

SEQ ID NO: 9110 - protein, 11 aa, Artificial Sequence
  Synthetic Construct
AQTERDTSRAQ

SEQ ID NO: 9111 - protein, 11 aa, Artificial Sequence
  Synthetic Construct
AQYTLTGTTAQ

SEQ ID NO: 9112 - protein, 11 aa, Artificial Sequence
  Synthetic Construct
AQDLRVSRDAQ

SEQ ID NO: 9113 - protein, 11 aa, Artificial Sequence
  Synthetic Construct
AQLIASHTAAQ

SEQ ID NO: 9114 - protein, 11 aa, Artificial Sequence
  Synthetic Construct
AQQRSENSHAQ

SEQ ID NO: 9115 - protein, 11 aa, Artificial Sequence
  Synthetic Construct
AQSASNQTYAQ

SEQ ID NO: 9116 - protein, 11 aa, Artificial Sequence
  Synthetic Construct
AQLEKVLQPAQ

SEQ ID NO: 9117 - protein, 11 aa, Artificial Sequence
  Synthetic Construct
AQNSGPLVIAQ

SEQ ID NO: 9118 - protein, 11 aa, Artificial Sequence
  Synthetic Construct
AQGTIHSPVAQ

SEQ ID NO: 9119 - protein, 11 aa, Artificial Sequence
  Synthetic Construct
AQNKNGEVLAQ

SEQ ID NO: 9120 - protein, 11 aa, Artificial Sequence
  Synthetic Construct
AQPMNERERAQ

SEQ ID NO: 9121 - protein, 11 aa, Artificial Sequence
  Synthetic Construct
AQGSNNLHPAQ

SEQ ID NO: 9122 - protein, 11 aa, Artificial Sequence
  Synthetic Construct
AQMSLHAKSAQ

SEQ ID NO: 9123 - protein, 11 aa, Artificial Sequence
  Synthetic Construct
AQQEKALARAQ

SEQ ID NO: 9124 - protein, 11 aa, Artificial Sequence
  Synthetic Construct
AQDRSTHAKAQ

SEQ ID NO: 9125 - protein, 11 aa, Artificial Sequence
  Synthetic Construct
AQIVRGDTSAQ

SEQ ID NO: 9126 - protein, 11 aa, Artificial Sequence
  Synthetic Construct
AQSSGGMNEAQ

SEQ ID NO: 9127 - protein, 11 aa, Artificial Sequence
  Synthetic Construct
AQKLHAVEAAQ

SEQ ID NO: 9128 - protein, 11 aa, Artificial Sequence
  Synthetic Construct
AQMFAEGTVAQ

SEQ ID NO: 9129 - protein, 11 aa, Artificial Sequence
  Synthetic Construct
AQTLGRVPQAQ

SEQ ID NO: 9130 - protein, 11 aa, Artificial Sequence
  Synthetic Construct
AQLLGNKDKAQ

SEQ ID NO: 9131 - protein, 11 aa, Artificial Sequence
  Synthetic Construct
AQRVNTSTDAQ

SEQ ID NO: 9132 - protein, 11 aa, Artificial Sequence
  Synthetic Construct
AQPQGVSPAAQ

SEQ ID NO: 9133 - protein, 11 aa, Artificial Sequence
  Synthetic Construct
AQGAVLSKAAQ

SEQ ID NO: 9134 - protein, 11 aa, Artificial Sequence
  Synthetic Construct
AQLGHAATSAQ

SEQ ID NO: 9135 - protein, 11 aa, Artificial Sequence
  Synthetic Construct
AQSGFSSTAAQ

SEQ ID NO: 9136 - protein, 11 aa, Artificial Sequence
  Synthetic Construct
AQLVNQPQSAQ

SEQ ID NO: 9137 - protein, 11 aa, Artificial Sequence
  Synthetic Construct
AQGRAEVGIAQ

SEQ ID NO: 9138 - protein, 11 aa, Artificial Sequence
  Synthetic Construct
AQVLATKNSAQ

SEQ ID NO: 9139 - protein, 11 aa, Artificial Sequence
  Synthetic Construct
AQQAHAFADAQ

SEQ ID NO: 9140 - protein, 11 aa, Artificial Sequence
  Synthetic Construct
AQNLDTVKTAQ

SEQ ID NO: 9141 - protein, 11 aa, Artificial Sequence
  Synthetic Construct
AQRPQTLPNAQ

SEQ ID NO: 9142 - protein, 11 aa, Artificial Sequence
  Synthetic Construct
AQNPRNSPTAQ

SEQ ID NO: 9143 - protein, 11 aa, Artificial Sequence
  Synthetic Construct
AQHVQMDADAQ

SEQ ID NO: 9144 - protein, 11 aa, Artificial Sequence
  Synthetic Construct
AQTYRTEPVAQ

SEQ ID NO: 9145 - protein, 11 aa, Artificial Sequence
  Synthetic Construct
AQPGLVNMSAQ

SEQ ID NO: 9146 - protein, 11 aa, Artificial Sequence
  Synthetic Construct
AQSLSQGPAAQ

SEQ ID NO: 9147 - protein, 11 aa, Artificial Sequence
  Synthetic Construct
AQLGASGYTAQ

SEQ ID NO: 9148 - protein, 11 aa, Artificial Sequence
  Synthetic Construct
AQSAVTTMPAQ

SEQ ID NO: 9149 - protein, 11 aa, Artificial Sequence
  Synthetic Construct
AQKVNAELLAQ

SEQ ID NO: 9150 - protein, 11 aa, Artificial Sequence
  Synthetic Construct
AQPFTPKLSAQ

SEQ ID NO: 9151 - protein, 11 aa, Artificial Sequence
  Synthetic Construct
AQMRSTNASAQ

SEQ ID NO: 9152 - protein, 11 aa, Artificial Sequence
  Synthetic Construct
AQVMYARGDAQ

SEQ ID NO: 9153 - protein, 11 aa, Artificial Sequence
  Synthetic Construct
AQRVGSTMQAQ

SEQ ID NO: 9154 - protein, 11 aa, Artificial Sequence
  Synthetic Construct
AQLTVAVETAQ

SEQ ID NO: 9155 - protein, 11 aa, Artificial Sequence
  Synthetic Construct
AQWTNSGSSAQ

SEQ ID NO: 9156 - protein, 11 aa, Artificial Sequence
  Synthetic Construct
AQHAMRGTGAQ

SEQ ID NO: 9157 - protein, 11 aa, Artificial Sequence
  Synthetic Construct
AQHQDVRGSAQ

SEQ ID NO: 9158 - protein, 11 aa, Artificial Sequence
  Synthetic Construct
AQSFQREIPAQ

SEQ ID NO: 9159 - protein, 11 aa, Artificial Sequence
  Synthetic Construct
AQLQRAALNAQ

SEQ ID NO: 9160 - protein, 11 aa, Artificial Sequence
  Synthetic Construct
AQSDATIRPAQ

SEQ ID NO: 9161 - protein, 11 aa, Artificial Sequence
  Synthetic Construct
AQQMSTGRVAQ

SEQ ID NO: 9162 - protein, 11 aa, Artificial Sequence
  Synthetic Construct
AQRSTQAIPAQ

SEQ ID NO: 9163 - protein, 11 aa, Artificial Sequence
  Synthetic Construct
AQQIRDANAAQ

SEQ ID NO: 9164 - protein, 11 aa, Artificial Sequence
  Synthetic Construct
AQLHTSNAYAQ

SEQ ID NO: 9165 - protein, 11 aa, Artificial Sequence
  Synthetic Construct
AQSSGLGTPAQ

SEQ ID NO: 9166 - protein, 11 aa, Artificial Sequence
  Synthetic Construct
AQDHKPVRDAQ

SEQ ID NO: 9167 - protein, 11 aa, Artificial Sequence
  Synthetic Construct
AQMKLVSVGAQ

SEQ ID NO: 9168 - protein, 11 aa, Artificial Sequence
  Synthetic Construct
AQGEQSLKAAQ

SEQ ID NO: 9169 - protein, 11 aa, Artificial Sequence
  Synthetic Construct
AQMTSGTNGAQ

SEQ ID NO: 9170 - protein, 11 aa, Artificial Sequence
  Synthetic Construct
AQHAAKGVVAQ

SEQ ID NO: 9171 - protein, 11 aa, Artificial Sequence
  Synthetic Construct
AQSSRQNEPAQ

SEQ ID NO: 9172 - protein, 11 aa, Artificial Sequence
  Synthetic Construct
AQALINRPNAQ

SEQ ID NO: 9173 - protein, 11 aa, Artificial Sequence
  Synthetic Construct
AQLRSSMASAQ

SEQ ID NO: 9174 - protein, 11 aa, Artificial Sequence
  Synthetic Construct
AQNNEYSKLAQ

SEQ ID NO: 9175 - protein, 11 aa, Artificial Sequence
  Synthetic Construct
AQTGRLNGEAQ

SEQ ID NO: 9176 - protein, 11 aa, Artificial Sequence
  Synthetic Construct
AQTNSHAVRAQ

SEQ ID NO: 9177 - protein, 11 aa, Artificial Sequence
  Synthetic Construct
AQIVTNHSHAQ

SEQ ID NO: 9178 - protein, 11 aa, Artificial Sequence
  Synthetic Construct
AQALTRDITAQ

SEQ ID NO: 9179 - protein, 11 aa, Artificial Sequence
  Synthetic Construct
AQGIANQGVAQ

SEQ ID NO: 9180 - protein, 11 aa, Artificial Sequence
  Synthetic Construct
AQNTVRSQQAQ

SEQ ID NO: 9181 - protein, 11 aa, Artificial Sequence
  Synthetic Construct
AQMENSNKAAQ

SEQ ID NO: 9182 - protein, 11 aa, Artificial Sequence
  Synthetic Construct
AQGTVRVQAAQ

SEQ ID NO: 9183 - protein, 11 aa, Artificial Sequence
  Synthetic Construct
AQTTSHLIDAQ

SEQ ID NO: 9184 - protein, 11 aa, Artificial Sequence
  Synthetic Construct
AQGTQAHQGAQ

SEQ ID NO: 9185 - protein, 11 aa, Artificial Sequence
  Synthetic Construct
AQKMSASSVAQ

SEQ ID NO: 9186 - protein, 11 aa, Artificial Sequence
  Synthetic Construct
AQSLKVNPGAQ

SEQ ID NO: 9187 - protein, 11 aa, Artificial Sequence
  Synthetic Construct
AQSTGTSTLAQ

SEQ ID NO: 9188 - protein, 11 aa, Artificial Sequence
  Synthetic Construct
AQVLTNREQAQ

SEQ ID NO: 9189 - protein, 11 aa, Artificial Sequence
  Synthetic Construct
AQLDVSRTLAQ

SEQ ID NO: 9190 - protein, 11 aa, Artificial Sequence
  Synthetic Construct
AQSFGTESRAQ

SEQ ID NO: 9191 - protein, 11 aa, Artificial Sequence
  Synthetic Construct
AQQLAKGNYAQ

SEQ ID NO: 9192 - protein, 11 aa, Artificial Sequence
  Synthetic Construct
AQAKNDPRAAQ

SEQ ID NO: 9193 - protein, 11 aa, Artificial Sequence
  Synthetic Construct
AQLTQVGGTAQ

SEQ ID NO: 9194 - protein, 11 aa, Artificial Sequence
  Synthetic Construct
AQKQNTTSLAQ

SEQ ID NO: 9195 - protein, 11 aa, Artificial Sequence
  Synthetic Construct
AQLSTRAEDAQ

SEQ ID NO: 9196 - protein, 11 aa, Artificial Sequence
  Synthetic Construct
AQTVPNIPMAQ

SEQ ID NO: 9197 - protein, 11 aa, Artificial Sequence
  Synthetic Construct
AQNSLSKLSAQ

SEQ ID NO: 9198 - protein, 11 aa, Artificial Sequence
  Synthetic Construct
AQMNEHQMKAQ

SEQ ID NO: 9199 - protein, 11 aa, Artificial Sequence
  Synthetic Construct
AQDVKGHQSAQ

SEQ ID NO: 9200 - protein, 11 aa, Artificial Sequence
  Synthetic Construct
AQDVSLQKDAQ

SEQ ID NO: 9201 - protein, 11 aa, Artificial Sequence
  Synthetic Construct
AQTRPSGTYAQ

SEQ ID NO: 9202 - protein, 11 aa, Artificial Sequence
  Synthetic Construct
AQVKGPDSLAQ

SEQ ID NO: 9203 - protein, 11 aa, Artificial Sequence
  Synthetic Construct
AQNHSSYELAQ

SEQ ID NO: 9204 - protein, 11 aa, Artificial Sequence
  Synthetic Construct
AQTVRTPLIAQ

SEQ ID NO: 9205 - protein, 11 aa, Artificial Sequence
  Synthetic Construct
AQASIDSQHAQ

SEQ ID NO: 9206 - protein, 11 aa, Artificial Sequence
  Synthetic Construct
AQDQKNSGHAQ

SEQ ID NO: 9207 - protein, 11 aa, Artificial Sequence
  Synthetic Construct
AQLDTNNKAAQ

SEQ ID NO: 9208 - protein, 11 aa, Artificial Sequence
  Synthetic Construct
AQASAHAQVAQ

SEQ ID NO: 9209 - protein, 11 aa, Artificial Sequence
  Synthetic Construct
AQDSGKHNDAQ

SEQ ID NO: 9210 - protein, 11 aa, Artificial Sequence
  Synthetic Construct
AQLNRNSGMAQ

SEQ ID NO: 9211 - protein, 11 aa, Artificial Sequence
  Synthetic Construct
AQPTMLPDKAQ

SEQ ID NO: 9212 - protein, 11 aa, Artificial Sequence
  Synthetic Construct
AQSTQVSNYAQ

SEQ ID NO: 9213 - protein, 11 aa, Artificial Sequence
  Synthetic Construct
AQSNQTLMSAQ

SEQ ID NO: 9214 - protein, 11 aa, Artificial Sequence
  Synthetic Construct
AQRNPGSTSAQ

SEQ ID NO: 9215 - protein, 11 aa, Artificial Sequence
  Synthetic Construct
AQRMAQGYSAQ

SEQ ID NO: 9216 - protein, 11 aa, Artificial Sequence
  Synthetic Construct
AQQVMRQSSAQ

SEQ ID NO: 9217 - protein, 11 aa, Artificial Sequence
  Synthetic Construct
AQKNTTVSDAQ

SEQ ID NO: 9218 - protein, 11 aa, Artificial Sequence
  Synthetic Construct
AQTGKTARDAQ

SEQ ID NO: 9219 - protein, 11 aa, Artificial Sequence
  Synthetic Construct
AQILRTLTEAQ

SEQ ID NO: 9220 - protein, 11 aa, Artificial Sequence
  Synthetic Construct
AQRLDNAGMAQ

SEQ ID NO: 9221 - protein, 11 aa, Artificial Sequence
  Synthetic Construct
AQSGTGRQQAQ

SEQ ID NO: 9222 - protein, 11 aa, Artificial Sequence
  Synthetic Construct
AQLGKDTFSAQ

SEQ ID NO: 9223 - protein, 11 aa, Artificial Sequence
  Synthetic Construct
AQRYDGSVAAQ

SEQ ID NO: 9224 - protein, 11 aa, Artificial Sequence
  Synthetic Construct
AQAHYPASTAQ

SEQ ID NO: 9225 - protein, 11 aa, Artificial Sequence
  Synthetic Construct
AQKSNGSPLAQ

SEQ ID NO: 9226 - protein, 11 aa, Artificial Sequence
  Synthetic Construct
AQRDLVLTKAQ

SEQ ID NO: 9227 - protein, 11 aa, Artificial Sequence
  Synthetic Construct
AQTSNPGNMAQ

SEQ ID NO: 9228 - protein, 11 aa, Artificial Sequence
  Synthetic Construct
AQLPRPSNTAQ

SEQ ID NO: 9229 - protein, 11 aa, Artificial Sequence
  Synthetic Construct
AQTGGGSFSAQ

SEQ ID NO: 9230 - protein, 11 aa, Artificial Sequence
  Synthetic Construct
AQYPNKELSAQ

SEQ ID NO: 9231 - protein, 11 aa, Artificial Sequence
  Synthetic Construct
AQTMVHQESAQ

SEQ ID NO: 9232 - protein, 11 aa, Artificial Sequence
  Synthetic Construct
AQVNSNNSMAQ

SEQ ID NO: 9233 - protein, 11 aa, Artificial Sequence
  Synthetic Construct
AQNGVHVTPAQ

SEQ ID NO: 9234 - protein, 11 aa, Artificial Sequence
  Synthetic Construct
AQAKYLNSNAQ

SEQ ID NO: 9235 - protein, 11 aa, Artificial Sequence
  Synthetic Construct
AQGMTKNGGAQ

SEQ ID NO: 9236 - protein, 11 aa, Artificial Sequence
  Synthetic Construct
AQRARDEGMAQ

SEQ ID NO: 9237 - protein, 11 aa, Artificial Sequence
  Synthetic Construct
AQVPSPGATAQ

SEQ ID NO: 9238 - protein, 11 aa, Artificial Sequence
  Synthetic Construct
AQKTQLGQMAQ

SEQ ID NO: 9239 - protein, 11 aa, Artificial Sequence
  Synthetic Construct
AQSTSTIQPAQ

SEQ ID NO: 9240 - protein, 11 aa, Artificial Sequence
  Synthetic Construct
AQRKENASYAQ

SEQ ID NO: 9241 - protein, 11 aa, Artificial Sequence
  Synthetic Construct
AQLTNHGNVAQ

SEQ ID NO: 9242 - protein, 11 aa, Artificial Sequence
  Synthetic Construct
AQLDNVHSHAQ

SEQ ID NO: 9243 - protein, 11 aa, Artificial Sequence
  Synthetic Construct
AQPTMAVTPAQ

SEQ ID NO: 9244 - protein, 11 aa, Artificial Sequence
  Synthetic Construct
AQKPERTEAAQ

SEQ ID NO: 9245 - protein, 11 aa, Artificial Sequence
  Synthetic Construct
AQTGDRKSGAQ

SEQ ID NO: 9246 - protein, 11 aa, Artificial Sequence
  Synthetic Construct
AQAKHTSFPAQ

SEQ ID NO: 9247 - protein, 11 aa, Artificial Sequence
  Synthetic Construct
AQGLVASLGAQ

SEQ ID NO: 9248 - protein, 11 aa, Artificial Sequence
  Synthetic Construct
AQSVPRSELAQ

SEQ ID NO: 9249 - protein, 11 aa, Artificial Sequence
  Synthetic Construct
AQAERIGMGAQ

SEQ ID NO: 9250 - protein, 11 aa, Artificial Sequence
  Synthetic Construct
AQSLVRQSDAQ

SEQ ID NO: 9251 - protein, 11 aa, Artificial Sequence
  Synthetic Construct
AQHVKANPIAQ

SEQ ID NO: 9252 - protein, 11 aa, Artificial Sequence
  Synthetic Construct
AQVVDTLKNAQ

SEQ ID NO: 9253 - protein, 11 aa, Artificial Sequence
  Synthetic Construct
AQQIPYNSSAQ

SEQ ID NO: 9254 - protein, 11 aa, Artificial Sequence
  Synthetic Construct
AQADHSMHVAQ

SEQ ID NO: 9255 - protein, 11 aa, Artificial Sequence
  Synthetic Construct
AQNHVTAQAAQ

SEQ ID NO: 9256 - protein, 11 aa, Artificial Sequence
  Synthetic Construct
AQTNFTKSGAQ

SEQ ID NO: 9257 - protein, 11 aa, Artificial Sequence
  Synthetic Construct
AQYGHSMTNAQ

SEQ ID NO: 9258 - protein, 11 aa, Artificial Sequence
  Synthetic Construct
AQMRPDLKTAQ

SEQ ID NO: 9259 - protein, 11 aa, Artificial Sequence
  Synthetic Construct
AQGPGTSFKAQ

SEQ ID NO: 9260 - protein, 11 aa, Artificial Sequence
  Synthetic Construct
AQSSTTPGLAQ

SEQ ID NO: 9261 - protein, 11 aa, Artificial Sequence
  Synthetic Construct
AQSVKANPTAQ

SEQ ID NO: 9262 - protein, 11 aa, Artificial Sequence
  Synthetic Construct
AQTPTVFTPAQ

SEQ ID NO: 9263 - protein, 11 aa, Artificial Sequence
  Synthetic Construct
AQMLPSPGSAQ

SEQ ID NO: 9264 - protein, 11 aa, Artificial Sequence
  Synthetic Construct
AQNFDYAKPAQ

SEQ ID NO: 9265 - protein, 11 aa, Artificial Sequence
  Synthetic Construct
AQTLNTSPMAQ

SEQ ID NO: 9266 - protein, 11 aa, Artificial Sequence
  Synthetic Construct
AQTNSPKSTAQ

SEQ ID NO: 9267 - protein, 11 aa, Artificial Sequence
  Synthetic Construct
AQVTPGRYSAQ

SEQ ID NO: 9268 - protein, 11 aa, Artificial Sequence
  Synthetic Construct
AQTRVSNLDAQ

SEQ ID NO: 9269 - protein, 11 aa, Artificial Sequence
  Synthetic Construct
AQSHGPDRTAQ

SEQ ID NO: 9270 - protein, 11 aa, Artificial Sequence
  Synthetic Construct
AQNIHTATTAQ

SEQ ID NO: 9271 - protein, 11 aa, Artificial Sequence
  Synthetic Construct
AQLLPQTTLAQ

SEQ ID NO: 9272 - protein, 11 aa, Artificial Sequence
  Synthetic Construct
AQRTNDTSAAQ

SEQ ID NO: 9273 - protein, 11 aa, Artificial Sequence
  Synthetic Construct
AQERNGSHEAQ

SEQ ID NO: 9274 - protein, 11 aa, Artificial Sequence
  Synthetic Construct
AQNTREAFIAQ

SEQ ID NO: 9275 - protein, 11 aa, Artificial Sequence
  Synthetic Construct
AQVGQYASPAQ

SEQ ID NO: 9276 - protein, 11 aa, Artificial Sequence
  Synthetic Construct
AQVAETGRTAQ

SEQ ID NO: 9277 - protein, 11 aa, Artificial Sequence
  Synthetic Construct
AQMSAGSNSAQ

SEQ ID NO: 9278 - protein, 11 aa, Artificial Sequence
  Synthetic Construct
AQLSPKNAQAQ

SEQ ID NO: 9279 - protein, 11 aa, Artificial Sequence
  Synthetic Construct
AQSGTSQLPAQ

SEQ ID NO: 9280 - protein, 11 aa, Artificial Sequence
  Synthetic Construct
AQRLQDKPQAQ

SEQ ID NO: 9281 - protein, 11 aa, Artificial Sequence
  Synthetic Construct
AQNVPRSSVAQ

SEQ ID NO: 9282 - protein, 11 aa, Artificial Sequence
  Synthetic Construct
AQALGSPRPAQ

SEQ ID NO: 9283 - protein, 11 aa, Artificial Sequence
  Synthetic Construct
AQAKEPMSAAQ

SEQ ID NO: 9284 - protein, 11 aa, Artificial Sequence
  Synthetic Construct
AQAVSGAAHAQ

SEQ ID NO: 9285 - protein, 11 aa, Artificial Sequence
  Synthetic Construct
AQYNNKSAAAQ

SEQ ID NO: 9286 - protein, 11 aa, Artificial Sequence
  Synthetic Construct
AQQVSVRNLAQ

SEQ ID NO: 9287 - protein, 11 aa, Artificial Sequence
  Synthetic Construct
AQKGTHPPAAQ

SEQ ID NO: 9288 - protein, 11 aa, Artificial Sequence
  Synthetic Construct
AQQYPNSKVAQ

SEQ ID NO: 9289 - protein, 11 aa, Artificial Sequence
  Synthetic Construct
AQHNASNSGAQ

SEQ ID NO: 9290 - protein, 11 aa, Artificial Sequence
  Synthetic Construct
AQELNPKFIAQ

SEQ ID NO: 9291 - protein, 11 aa, Artificial Sequence
  Synthetic Construct
AQSRETPGTAQ

SEQ ID NO: 9292 - protein, 11 aa, Artificial Sequence
  Synthetic Construct
AQNFKPQNEAQ

SEQ ID NO: 9293 - protein, 11 aa, Artificial Sequence
  Synthetic Construct
AQAMTSGSAAQ

SEQ ID NO: 9294 - protein, 11 aa, Artificial Sequence
  Synthetic Construct
AQKDPRSTLAQ

SEQ ID NO: 9295 - protein, 11 aa, Artificial Sequence
  Synthetic Construct
AQDRGTRTVAQ

SEQ ID NO: 9296 - protein, 11 aa, Artificial Sequence
  Synthetic Construct
AQSLARNNVAQ

SEQ ID NO: 9297 - protein, 11 aa, Artificial Sequence
  Synthetic Construct
AQAIRFNEPAQ

SEQ ID NO: 9298 - protein, 11 aa, Artificial Sequence
  Synthetic Construct
AQQHHIATPAQ

SEQ ID NO: 9299 - protein, 11 aa, Artificial Sequence
  Synthetic Construct
AQQILREPVAQ

SEQ ID NO: 9300 - protein, 11 aa, Artificial Sequence
  Synthetic Construct
AQTVVNKLSAQ

SEQ ID NO: 9301 - protein, 11 aa, Artificial Sequence
  Synthetic Construct
AQRDNTTKFAQ

SEQ ID NO: 9302 - protein, 11 aa, Artificial Sequence
  Synthetic Construct
AQSLLSTLGAQ

SEQ ID NO: 9303 - protein, 11 aa, Artificial Sequence
  Synthetic Construct
AQGQVPVTRAQ

SEQ ID NO: 9304 - protein, 11 aa, Artificial Sequence
  Synthetic Construct
AQIQNSLMPAQ

SEQ ID NO: 9305 - protein, 11 aa, Artificial Sequence
  Synthetic Construct
AQQHNTQNTAQ

SEQ ID NO: 9306 - protein, 11 aa, Artificial Sequence
  Synthetic Construct
AQVGPTMTHAQ

SEQ ID NO: 9307 - protein, 11 aa, Artificial Sequence
  Synthetic Construct
AQTNVTMARAQ

SEQ ID NO: 9308 - protein, 11 aa, Artificial Sequence
  Synthetic Construct
AQSAHFTGTAQ

SEQ ID NO: 9309 - protein, 11 aa, Artificial Sequence
  Synthetic Construct
AQRYSVNDKAQ

SEQ ID NO: 9310 - protein, 11 aa, Artificial Sequence
  Synthetic Construct
AQVYKSADPAQ

SEQ ID NO: 9311 - protein, 11 aa, Artificial Sequence
  Synthetic Construct
AQVHTALPMAQ

SEQ ID NO: 9312 - protein, 11 aa, Artificial Sequence
  Synthetic Construct
AQTISSAGIAQ

SEQ ID NO: 9313 - protein, 11 aa, Artificial Sequence
  Synthetic Construct
AQRLPSTQAAQ

SEQ ID NO: 9314 - protein, 11 aa, Artificial Sequence
  Synthetic Construct
AQSQERAMSAQ

SEQ ID NO: 9315 - protein, 11 aa, Artificial Sequence
  Synthetic Construct
AQMNQLANPAQ

SEQ ID NO: 9316 - protein, 11 aa, Artificial Sequence
  Synthetic Construct
AQFGATSGQAQ

SEQ ID NO: 9317 - protein, 11 aa, Artificial Sequence
  Synthetic Construct
AQTLLRSPAAQ

SEQ ID NO: 9318 - protein, 11 aa, Artificial Sequence
  Synthetic Construct
AQLRSNVSNAQ

SEQ ID NO: 9319 - protein, 11 aa, Artificial Sequence
  Synthetic Construct
AQIANSQAAAQ

SEQ ID NO: 9320 - protein, 11 aa, Artificial Sequence
  Synthetic Construct
AQSNRIVPVAQ

SEQ ID NO: 9321 - protein, 11 aa, Artificial Sequence
  Synthetic Construct
AQSPNPSNAAQ

SEQ ID NO: 9322 - protein, 11 aa, Artificial Sequence
  Synthetic Construct
AQKWDSANEAQ

SEQ ID NO: 9323 - protein, 11 aa, Artificial Sequence
  Synthetic Construct
AQASRQGEAAQ

SEQ ID NO: 9324 - protein, 11 aa, Artificial Sequence
  Synthetic Construct
AQVPGNSPHAQ

SEQ ID NO: 9325 - protein, 11 aa, Artificial Sequence
  Synthetic Construct
AQSATTNSVAQ

SEQ ID NO: 9326 - protein, 11 aa, Artificial Sequence
  Synthetic Construct
AQHIGARQVAQ

SEQ ID NO: 9327 - protein, 11 aa, Artificial Sequence
  Synthetic Construct
AQLTDRSPMAQ

SEQ ID NO: 9328 - protein, 11 aa, Artificial Sequence
  Synthetic Construct
AQNPTQAVLAQ

SEQ ID NO: 9329 - protein, 11 aa, Artificial Sequence
  Synthetic Construct
AQTKNETGTAQ

SEQ ID NO: 9330 - protein, 11 aa, Artificial Sequence
  Synthetic Construct
AQLTATLTSAQ

SEQ ID NO: 9331 - protein, 11 aa, Artificial Sequence
  Synthetic Construct
AQYKASYAAAQ

SEQ ID NO: 9332 - protein, 11 aa, Artificial Sequence
  Synthetic Construct
AQTLPDKVSAQ

SEQ ID NO: 9333 - protein, 11 aa, Artificial Sequence
  Synthetic Construct
AQNNHIPLAAQ

SEQ ID NO: 9334 - protein, 11 aa, Artificial Sequence
  Synthetic Construct
AQSNLTSNPAQ

SEQ ID NO: 9335 - protein, 11 aa, Artificial Sequence
  Synthetic Construct
AQQQNDRNAAQ

SEQ ID NO: 9336 - protein, 11 aa, Artificial Sequence
  Synthetic Construct
AQMLSTNRSAQ

SEQ ID NO: 9337 - protein, 11 aa, Artificial Sequence
  Synthetic Construct
AQITSATLSAQ

SEQ ID NO: 9338 - protein, 11 aa, Artificial Sequence
  Synthetic Construct
AQVDAMQRPAQ

SEQ ID NO: 9339 - protein, 11 aa, Artificial Sequence
  Synthetic Construct
AQREANYASAQ

SEQ ID NO: 9340 - protein, 11 aa, Artificial Sequence
  Synthetic Construct
AQRSNNADLAQ

SEQ ID NO: 9341 - protein, 11 aa, Artificial Sequence
  Synthetic Construct
AQGLDKMGSAQ

SEQ ID NO: 9342 - protein, 11 aa, Artificial Sequence
  Synthetic Construct
AQFTTSHAPAQ

SEQ ID NO: 9343 - protein, 11 aa, Artificial Sequence
  Synthetic Construct
AQDKSVKFAAQ

SEQ ID NO: 9344 - protein, 11 aa, Artificial Sequence
  Synthetic Construct
AQHAKKELQAQ

SEQ ID NO: 9345 - protein, 11 aa, Artificial Sequence
  Synthetic Construct
AQVESKGASAQ

SEQ ID NO: 9346 - protein, 11 aa, Artificial Sequence
  Synthetic Construct
AQKTAPSMGAQ

SEQ ID NO: 9347 - protein, 11 aa, Artificial Sequence
  Synthetic Construct
AQGLRTDNRAQ

SEQ ID NO: 9348 - protein, 11 aa, Artificial Sequence
  Synthetic Construct
AQRIAGNNPAQ

SEQ ID NO: 9349 - protein, 11 aa, Artificial Sequence
  Synthetic Construct
AQKDPHQVVAQ

SEQ ID NO: 9350 - protein, 11 aa, Artificial Sequence
  Synthetic Construct
AQEQTPHNSAQ

SEQ ID NO: 9351 - protein, 11 aa, Artificial Sequence
  Synthetic Construct
AQGLDKGNWAQ

SEQ ID NO: 9352 - protein, 11 aa, Artificial Sequence
  Synthetic Construct
AQPSNGNYSAQ

SEQ ID NO: 9353 - protein, 11 aa, Artificial Sequence
  Synthetic Construct
AQGRPGIGSAQ

SEQ ID NO: 9354 - protein, 11 aa, Artificial Sequence
  Synthetic Construct
AQRTSPGVSAQ

SEQ ID NO: 9355 - protein, 11 aa, Artificial Sequence
  Synthetic Construct
AQVNASLISAQ

SEQ ID NO: 9356 - protein, 11 aa, Artificial Sequence
  Synthetic Construct
AQKTSTNLQAQ

SEQ ID NO: 9357 - protein, 11 aa, Artificial Sequence
  Synthetic Construct
AQMDMKQNMAQ

SEQ ID NO: 9358 - protein, 11 aa, Artificial Sequence
  Synthetic Construct
AQDLNGINVAQ

SEQ ID NO: 9359 - protein, 11 aa, Artificial Sequence
  Synthetic Construct
AQRTPPSFEAQ

SEQ ID NO: 9360 - protein, 11 aa, Artificial Sequence
  Synthetic Construct
AQDFHDRKGAQ

SEQ ID NO: 9361 - protein, 11 aa, Artificial Sequence
  Synthetic Construct
AQLHTQTQTAQ

SEQ ID NO: 9362 - protein, 11 aa, Artificial Sequence
  Synthetic Construct
AQLGASNNAAQ

SEQ ID NO: 9363 - protein, 11 aa, Artificial Sequence
  Synthetic Construct
AQIASVPRDAQ

SEQ ID NO: 9364 - protein, 11 aa, Artificial Sequence
  Synthetic Construct
AQKAKDVGDAQ

SEQ ID NO: 9365 - protein, 11 aa, Artificial Sequence
  Synthetic Construct
AQSAFAAKQAQ

SEQ ID NO: 9366 - protein, 11 aa, Artificial Sequence
  Synthetic Construct
AQVYQGQHLAQ

SEQ ID NO: 9367 - protein, 11 aa, Artificial Sequence
  Synthetic Construct
AQYLPAASSAQ

SEQ ID NO: 9368 - protein, 11 aa, Artificial Sequence
  Synthetic Construct
AQSPSTVISAQ

SEQ ID NO: 9369 - protein, 11 aa, Artificial Sequence
  Synthetic Construct
AQGTNKPPDAQ

SEQ ID NO: 9370 - protein, 11 aa, Artificial Sequence
  Synthetic Construct
AQESTGAIRAQ

SEQ ID NO: 9371 - protein, 11 aa, Artificial Sequence
  Synthetic Construct
AQLMNTTIAAQ

SEQ ID NO: 9372 - protein, 11 aa, Artificial Sequence
  Synthetic Construct
AQMAGVAQPAQ

SEQ ID NO: 9373 - protein, 11 aa, Artificial Sequence
  Synthetic Construct
AQRPELKREAQ

SEQ ID NO: 9374 - protein, 11 aa, Artificial Sequence
  Synthetic Construct
AQKAQDTPTAQ

SEQ ID NO: 9375 - protein, 11 aa, Artificial Sequence
  Synthetic Construct
AQSTNHSTSAQ

SEQ ID NO: 9376 - protein, 11 aa, Artificial Sequence
  Synthetic Construct
AQFPRTTTDAQ

SEQ ID NO: 9377 - protein, 11 aa, Artificial Sequence
  Synthetic Construct
AQSRAHNLDAQ

SEQ ID NO: 9378 - protein, 11 aa, Artificial Sequence
  Synthetic Construct
AQRTIQEGIAQ

SEQ ID NO: 9379 - protein, 11 aa, Artificial Sequence
  Synthetic Construct
AQGGKSFAQAQ

SEQ ID NO: 9380 - protein, 11 aa, Artificial Sequence
  Synthetic Construct
AQGRPSSTQAQ

SEQ ID NO: 9381 - protein, 11 aa, Artificial Sequence
  Synthetic Construct
AQNPLNTSTAQ

SEQ ID NO: 9382 - protein, 11 aa, Artificial Sequence
  Synthetic Construct
AQENLSNGRAQ

SEQ ID NO: 9383 - protein, 11 aa, Artificial Sequence
  Synthetic Construct
AQENTIRMSAQ

SEQ ID NO: 9384 - protein, 11 aa, Artificial Sequence
  Synthetic Construct
AQPPRSMPMAQ

SEQ ID NO: 9385 - protein, 11 aa, Artificial Sequence
  Synthetic Construct
AQLLSSNLPAQ

SEQ ID NO: 9386 - protein, 11 aa, Artificial Sequence
  Synthetic Construct
AQRVQSLNEAQ

SEQ ID NO: 9387 - protein, 11 aa, Artificial Sequence
  Synthetic Construct
AQPRRAQDDAQ

SEQ ID NO: 9388 - protein, 11 aa, Artificial Sequence
  Synthetic Construct
AQQGNVNVGAQ

SEQ ID NO: 9389 - protein, 11 aa, Artificial Sequence
  Synthetic Construct
AQSGETLRGAQ

SEQ ID NO: 9390 - protein, 11 aa, Artificial Sequence
  Synthetic Construct
AQHVSHNTDAQ

SEQ ID NO: 9391 - protein, 11 aa, Artificial Sequence
  Synthetic Construct
AQFGGGSLVAQ

SEQ ID NO: 9392 - protein, 11 aa, Artificial Sequence
  Synthetic Construct
AQPSLRSEGAQ

SEQ ID NO: 9393 - protein, 11 aa, Artificial Sequence
  Synthetic Construct
AQVRSENGVAQ

SEQ ID NO: 9394 - protein, 11 aa, Artificial Sequence
  Synthetic Construct
AQTLKVTGDAQ

SEQ ID NO: 9395 - protein, 11 aa, Artificial Sequence
  Synthetic Construct
AQVPKVYLDAQ

SEQ ID NO: 9396 - protein, 11 aa, Artificial Sequence
  Synthetic Construct
AQTSMRNTEAQ

SEQ ID NO: 9397 - protein, 11 aa, Artificial Sequence
  Synthetic Construct
AQGYSHGSMAQ

SEQ ID NO: 9398 - protein, 11 aa, Artificial Sequence
  Synthetic Construct
AQATFPEKQAQ

SEQ ID NO: 9399 - protein, 11 aa, Artificial Sequence
  Synthetic Construct
AQTGPTHGTAQ

SEQ ID NO: 9400 - protein, 11 aa, Artificial Sequence
  Synthetic Construct
AQTNDRHAPAQ

SEQ ID NO: 9401 - protein, 11 aa, Artificial Sequence
  Synthetic Construct
AQRHLASVDAQ

SEQ ID NO: 9402 - protein, 11 aa, Artificial Sequence
  Synthetic Construct
AQNMIQPSNAQ

SEQ ID NO: 9403 - protein, 11 aa, Artificial Sequence
  Synthetic Construct
AQNLSGSPAAQ

SEQ ID NO: 9404 - protein, 11 aa, Artificial Sequence
  Synthetic Construct
AQQTVGPLPAQ

SEQ ID NO: 9405 - protein, 11 aa, Artificial Sequence
  Synthetic Construct
AQVGHLSRDAQ

SEQ ID NO: 9406 - protein, 11 aa, Artificial Sequence
  Synthetic Construct
AQQNFNAGHAQ

SEQ ID NO: 9407 - protein, 11 aa, Artificial Sequence
  Synthetic Construct
AQLTGAARVAQ

SEQ ID NO: 9408 - protein, 11 aa, Artificial Sequence
  Synthetic Construct
AQGTRPTATAQ

SEQ ID NO: 9409 - protein, 11 aa, Artificial Sequence
  Synthetic Construct
AQMPLSVAPAQ

SEQ ID NO: 9410 - protein, 11 aa, Artificial Sequence
  Synthetic Construct
AQDRVQQFSAQ

SEQ ID NO: 9411 - protein, 11 aa, Artificial Sequence
  Synthetic Construct
AQNNDTSTKAQ

SEQ ID NO: 9412 - protein, 11 aa, Artificial Sequence
  Synthetic Construct
AQPSKNTHIAQ

SEQ ID NO: 9413 - protein, 11 aa, Artificial Sequence
  Synthetic Construct
AQPFKADVTAQ

SEQ ID NO: 9414 - protein, 11 aa, Artificial Sequence
  Synthetic Construct
AQPKTPTYVAQ

SEQ ID NO: 9415 - protein, 11 aa, Artificial Sequence
  Synthetic Construct
AQLTNMTTPAQ

SEQ ID NO: 9416 - protein, 11 aa, Artificial Sequence
  Synthetic Construct
AQGSKVHLSAQ

SEQ ID NO: 9417 - protein, 11 aa, Artificial Sequence
  Synthetic Construct
AQSIPGYNNAQ

SEQ ID NO: 9418 - protein, 11 aa, Artificial Sequence
  Synthetic Construct
AQMKTAESYAQ

SEQ ID NO: 9419 - protein, 11 aa, Artificial Sequence
  Synthetic Construct
AQNGDRLLNAQ

SEQ ID NO: 9420 - protein, 11 aa, Artificial Sequence
  Synthetic Construct
AQGTTHTSLAQ

SEQ ID NO: 9421 - protein, 11 aa, Artificial Sequence
  Synthetic Construct
AQLGPSTQSAQ

SEQ ID NO: 9422 - protein, 11 aa, Artificial Sequence
  Synthetic Construct
AQMNALTDKAQ

SEQ ID NO: 9423 - protein, 11 aa, Artificial Sequence
  Synthetic Construct
AQSSKEISLAQ

SEQ ID NO: 9424 - protein, 11 aa, Artificial Sequence
  Synthetic Construct
AQLDNGTTRAQ

SEQ ID NO: 9425 - protein, 11 aa, Artificial Sequence
  Synthetic Construct
AQRVNFNSDAQ

SEQ ID NO: 9426 - protein, 11 aa, Artificial Sequence
  Synthetic Construct
AQNMQAISNAQ

SEQ ID NO: 9427 - protein, 11 aa, Artificial Sequence
  Synthetic Construct
AQNTNPRSIAQ

SEQ ID NO: 9428 - protein, 11 aa, Artificial Sequence
  Synthetic Construct
AQKINSNSPAQ

SEQ ID NO: 9429 - protein, 11 aa, Artificial Sequence
  Synthetic Construct
AQVPLGKASAQ

SEQ ID NO: 9430 - protein, 11 aa, Artificial Sequence
  Synthetic Construct
AQRLNHNSPAQ

SEQ ID NO: 9431 - protein, 11 aa, Artificial Sequence
  Synthetic Construct
AQQLNTVLPAQ

SEQ ID NO: 9432 - protein, 11 aa, Artificial Sequence
  Synthetic Construct
AQDSFGKSLAQ

SEQ ID NO: 9433 - protein, 11 aa, Artificial Sequence
  Synthetic Construct
AQKPPKLVDAQ

SEQ ID NO: 9434 - protein, 11 aa, Artificial Sequence
  Synthetic Construct
AQQITVGKPAQ

SEQ ID NO: 9435 - protein, 11 aa, Artificial Sequence
  Synthetic Construct
AQQHPHGQQAQ

SEQ ID NO: 9436 - protein, 11 aa, Artificial Sequence
  Synthetic Construct
AQTSTNMAAAQ

SEQ ID NO: 9437 - protein, 11 aa, Artificial Sequence
  Synthetic Construct
AQQGGLAVVAQ

SEQ ID NO: 9438 - protein, 11 aa, Artificial Sequence
  Synthetic Construct
AQGRGSLPFAQ

SEQ ID NO: 9439 - protein, 11 aa, Artificial Sequence
  Synthetic Construct
AQSGKPASEAQ

SEQ ID NO: 9440 - protein, 11 aa, Artificial Sequence
  Synthetic Construct
AQRSVSVNSAQ

SEQ ID NO: 9441 - protein, 11 aa, Artificial Sequence
  Synthetic Construct
AQDRGGVVAAQ

SEQ ID NO: 9442 - protein, 11 aa, Artificial Sequence
  Synthetic Construct
AQGRETGFSAQ

SEQ ID NO: 9443 - protein, 11 aa, Artificial Sequence
  Synthetic Construct
AQQIVPSNPAQ

SEQ ID NO: 9444 - protein, 11 aa, Artificial Sequence
  Synthetic Construct
AQTTLGHSYSQ

SEQ ID NO: 9445 - protein, 11 aa, Artificial Sequence
  Synthetic Construct
AQSREFQLAAQ

SEQ ID NO: 9446 - protein, 11 aa, Artificial Sequence
  Synthetic Construct
AQGRDHNIGAQ

SEQ ID NO: 9447 - protein, 11 aa, Artificial Sequence
  Synthetic Construct
AQSNNSRPNAQ

SEQ ID NO: 9448 - protein, 11 aa, Artificial Sequence
  Synthetic Construct
AQKNQSSDLAQ

SEQ ID NO: 9449 - protein, 11 aa, Artificial Sequence
  Synthetic Construct
AQPNDRAHGAQ

SEQ ID NO: 9450 - protein, 11 aa, Artificial Sequence
  Synthetic Construct
AQALTRTQSAQ

SEQ ID NO: 9451 - protein, 11 aa, Artificial Sequence
  Synthetic Construct
AQMRPPSDKAQ

SEQ ID NO: 9452 - protein, 11 aa, Artificial Sequence
  Synthetic Construct
AQTNSTTKSAQ

SEQ ID NO: 9453 - protein, 11 aa, Artificial Sequence
  Synthetic Construct
AQGRHGMTAAQ

SEQ ID NO: 9454 - protein, 11 aa, Artificial Sequence
  Synthetic Construct
AQVSHISPAAQ

SEQ ID NO: 9455 - protein, 11 aa, Artificial Sequence
  Synthetic Construct
AQKVTSNSSAQ

SEQ ID NO: 9456 - protein, 11 aa, Artificial Sequence
  Synthetic Construct
AQMYGPGASAQ

SEQ ID NO: 9457 - protein, 11 aa, Artificial Sequence
  Synthetic Construct
AQVLRSNTPAQ

SEQ ID NO: 9458 - protein, 11 aa, Artificial Sequence
  Synthetic Construct
AQNSSSSNKAQ

SEQ ID NO: 9459 - protein, 11 aa, Artificial Sequence
  Synthetic Construct
AQSTEKSTSAQ

SEQ ID NO: 9460 - protein, 11 aa, Artificial Sequence
  Synthetic Construct
AQNTNGNKGAQ

SEQ ID NO: 9461 - protein, 11 aa, Artificial Sequence
  Synthetic Construct
AQITTNLGAAQ

SEQ ID NO: 9462 - protein, 11 aa, Artificial Sequence
  Synthetic Construct
AQIQKPQSSAQ

SEQ ID NO: 9463 - protein, 11 aa, Artificial Sequence
  Synthetic Construct
AQVRDAAYTAQ

SEQ ID NO: 9464 - protein, 11 aa, Artificial Sequence
  Synthetic Construct
AQARSSTGAAQ

SEQ ID NO: 9465 - protein, 11 aa, Artificial Sequence
  Synthetic Construct
AQTSVHNKVAQ

SEQ ID NO: 9466 - protein, 11 aa, Artificial Sequence
  Synthetic Construct
AQTISTHGTAQ

SEQ ID NO: 9467 - protein, 11 aa, Artificial Sequence
  Synthetic Construct
AQTVTNINFAQ

SEQ ID NO: 9468 - protein, 11 aa, Artificial Sequence
  Synthetic Construct
AQSINSNHIAQ

SEQ ID NO: 9469 - protein, 11 aa, Artificial Sequence
  Synthetic Construct
AQQKAGYSNAQ

SEQ ID NO: 9470 - protein, 11 aa, Artificial Sequence
  Synthetic Construct
AQARDTVRTAQ

SEQ ID NO: 9471 - protein, 11 aa, Artificial Sequence
  Synthetic Construct
AQYKDQTKVAQ

SEQ ID NO: 9472 - protein, 11 aa, Artificial Sequence
  Synthetic Construct
AQNIGLNPMAQ

SEQ ID NO: 9473 - protein, 11 aa, Artificial Sequence
  Synthetic Construct
AQGSTNMIYAQ

SEQ ID NO: 9474 - protein, 11 aa, Artificial Sequence
  Synthetic Construct
AQIDAKGLKAQ

SEQ ID NO: 9475 - protein, 11 aa, Artificial Sequence
  Synthetic Construct
AQVVSHNLTAQ

SEQ ID NO: 9476 - protein, 11 aa, Artificial Sequence
  Synthetic Construct
AQTVSLKTAAQ

SEQ ID NO: 9477 - protein, 11 aa, Artificial Sequence
  Synthetic Construct
AQYSGSNYHAQ

SEQ ID NO: 9478 - protein, 11 aa, Artificial Sequence
  Synthetic Construct
AQPSDATMGAQ

SEQ ID NO: 9479 - protein, 11 aa, Artificial Sequence
  Synthetic Construct
AQWGETTNGAQ

SEQ ID NO: 9480 - protein, 11 aa, Artificial Sequence
  Synthetic Construct
AQNYHKTMPAQ

SEQ ID NO: 9481 - protein, 11 aa, Artificial Sequence
  Synthetic Construct
AQARHELPVAQ

SEQ ID NO: 9482 - protein, 11 aa, Artificial Sequence
  Synthetic Construct
AQHNLTRNLAQ

SEQ ID NO: 9483 - protein, 11 aa, Artificial Sequence
  Synthetic Construct
AQGPQIGTVAQ

SEQ ID NO: 9484 - protein, 11 aa, Artificial Sequence
  Synthetic Construct
AQMRADSNVAQ

SEQ ID NO: 9485 - protein, 11 aa, Artificial Sequence
  Synthetic Construct
AQVANGPTTAQ

SEQ ID NO: 9486 - protein, 11 aa, Artificial Sequence
  Synthetic Construct
AQTKNLNTYAQ

SEQ ID NO: 9487 - protein, 11 aa, Artificial Sequence
  Synthetic Construct
AQDRLGARSAQ

SEQ ID NO: 9488 - protein, 11 aa, Artificial Sequence
  Synthetic Construct
AQNIGSGQKAQ

SEQ ID NO: 9489 - protein, 11 aa, Artificial Sequence
  Synthetic Construct
AQGREMTNPAQ

SEQ ID NO: 9490 - protein, 11 aa, Artificial Sequence
  Synthetic Construct
AQIMAAAHSAQ

SEQ ID NO: 9491 - protein, 11 aa, Artificial Sequence
  Synthetic Construct
AQSDQRIHPAQ

SEQ ID NO: 9492 - protein, 11 aa, Artificial Sequence
  Synthetic Construct
AQVSGQTNMAQ

SEQ ID NO: 9493 - protein, 11 aa, Artificial Sequence
  Synthetic Construct
AQYSLGSEPAQ

SEQ ID NO: 9494 - protein, 11 aa, Artificial Sequence
  Synthetic Construct
AQSTLKALTAQ

SEQ ID NO: 9495 - protein, 11 aa, Artificial Sequence
  Synthetic Construct
AQSALIPSPAQ

SEQ ID NO: 9496 - protein, 11 aa, Artificial Sequence
  Synthetic Construct
AQTSQAGNQAQ

SEQ ID NO: 9497 - protein, 11 aa, Artificial Sequence
  Synthetic Construct
AQKHASLPIAQ

SEQ ID NO: 9498 - protein, 11 aa, Artificial Sequence
  Synthetic Construct
AQLDQLTKNAQ

SEQ ID NO: 9499 - protein, 11 aa, Artificial Sequence
  Synthetic Construct
AQMARSTDRAQ

SEQ ID NO: 9500 - protein, 11 aa, Artificial Sequence
  Synthetic Construct
AQSYNHIEKAQ

SEQ ID NO: 9501 - protein, 11 aa, Artificial Sequence
  Synthetic Construct
AQVNHIQPMAQ

SEQ ID NO: 9502 - protein, 11 aa, Artificial Sequence
  Synthetic Construct
AQSRAEPKLAQ

SEQ ID NO: 9503 - protein, 11 aa, Artificial Sequence
  Synthetic Construct
AQASHIGNSAQ

SEQ ID NO: 9504 - protein, 11 aa, Artificial Sequence
  Synthetic Construct
AQHQGFASAAQ

SEQ ID NO: 9505 - protein, 11 aa, Artificial Sequence
  Synthetic Construct
AQEGKSIMPAQ

SEQ ID NO: 9506 - protein, 11 aa, Artificial Sequence
  Synthetic Construct
AQLTGMHSTAQ

SEQ ID NO: 9507 - protein, 11 aa, Artificial Sequence
  Synthetic Construct
AQSNPSTIHAQ

SEQ ID NO: 9508 - protein, 11 aa, Artificial Sequence
  Synthetic Construct
AQSRDQPTSAQ

SEQ ID NO: 9509 - protein, 11 aa, Artificial Sequence
  Synthetic Construct
AQKTAEPYTAQ

SEQ ID NO: 9510 - protein, 11 aa, Artificial Sequence
  Synthetic Construct
AQIGSNPDKAQ

SEQ ID NO: 9511 - protein, 11 aa, Artificial Sequence
  Synthetic Construct
AQLASTFSPAQ

SEQ ID NO: 9512 - protein, 11 aa, Artificial Sequence
  Synthetic Construct
AQLVRLNTSAQ

SEQ ID NO: 9513 - protein, 11 aa, Artificial Sequence
  Synthetic Construct
AQFQDLRAQAQ

SEQ ID NO: 9514 - protein, 11 aa, Artificial Sequence
  Synthetic Construct
AQISHSPQTAQ

SEQ ID NO: 9515 - protein, 11 aa, Artificial Sequence
  Synthetic Construct
AQFQDGQREAQ

SEQ ID NO: 9516 - protein, 11 aa, Artificial Sequence
  Synthetic Construct
AQDTREAFRAQ

SEQ ID NO: 9517 - protein, 11 aa, Artificial Sequence
  Synthetic Construct
AQLVADARPAQ

SEQ ID NO: 9518 - protein, 11 aa, Artificial Sequence
  Synthetic Construct
AQSFSSGAGAQ

SEQ ID NO: 9519 - protein, 11 aa, Artificial Sequence
  Synthetic Construct
AQDVLTGKSAQ

SEQ ID NO: 9520 - protein, 11 aa, Artificial Sequence
  Synthetic Construct
AQKMVLNNAAQ

SEQ ID NO: 9521 - protein, 11 aa, Artificial Sequence
  Synthetic Construct
AQRKIDTMSAQ

SEQ ID NO: 9522 - protein, 11 aa, Artificial Sequence
  Synthetic Construct
AQMSQVITGAQ

SEQ ID NO: 9523 - protein, 11 aa, Artificial Sequence
  Synthetic Construct
AQTYDTRNTAQ

SEQ ID NO: 9524 - protein, 11 aa, Artificial Sequence
  Synthetic Construct
AQYRDGSGSAQ

SEQ ID NO: 9525 - protein, 11 aa, Artificial Sequence
  Synthetic Construct
AQGNISPAGAQ

SEQ ID NO: 9526 - protein, 11 aa, Artificial Sequence
  Synthetic Construct
AQKAGLGLSAQ

SEQ ID NO: 9527 - protein, 11 aa, Artificial Sequence
  Synthetic Construct
AQRHVEKDTAQ

SEQ ID NO: 9528 - protein, 11 aa, Artificial Sequence
  Synthetic Construct
AQKEVRANAAQ

SEQ ID NO: 9529 - protein, 11 aa, Artificial Sequence
  Synthetic Construct
AQESKPLPAAQ

SEQ ID NO: 9530 - protein, 11 aa, Artificial Sequence
  Synthetic Construct
AQTLSHNSMAQ

SEQ ID NO: 9531 - protein, 11 aa, Artificial Sequence
  Synthetic Construct
AQVGSYTVSAQ

SEQ ID NO: 9532 - protein, 11 aa, Artificial Sequence
  Synthetic Construct
AQQSATSLTAQ

SEQ ID NO: 9533 - protein, 11 aa, Artificial Sequence
  Synthetic Construct
AQHANGLRDAQ

SEQ ID NO: 9534 - protein, 11 aa, Artificial Sequence
  Synthetic Construct
AQRMSHDSPAQ

SEQ ID NO: 9535 - protein, 11 aa, Artificial Sequence
  Synthetic Construct
AQKHSGLESAQ

SEQ ID NO: 9536 - protein, 11 aa, Artificial Sequence
  Synthetic Construct
AQKLSTAIEAQ

SEQ ID NO: 9537 - protein, 11 aa, Artificial Sequence
  Synthetic Construct
AQNSKQLLLAQ

SEQ ID NO: 9538 - protein, 11 aa, Artificial Sequence
  Synthetic Construct
AQSLHNNRVAQ

SEQ ID NO: 9539 - protein, 11 aa, Artificial Sequence
  Synthetic Construct
AQSADRSITAQ

SEQ ID NO: 9540 - protein, 11 aa, Artificial Sequence
  Synthetic Construct
AQPTGRPQEAQ

SEQ ID NO: 9541 - protein, 11 aa, Artificial Sequence
  Synthetic Construct
AQKTVQEPLAQ

SEQ ID NO: 9542 - protein, 11 aa, Artificial Sequence
  Synthetic Construct
AQSTKALSNAQ

SEQ ID NO: 9543 - protein, 11 aa, Artificial Sequence
  Synthetic Construct
AQSNQSTRSAQ

SEQ ID NO: 9544 - protein, 11 aa, Artificial Sequence
  Synthetic Construct
AQGVEGSSRAQ

SEQ ID NO: 9545 - protein, 11 aa, Artificial Sequence
  Synthetic Construct
AQLHQGPSSAQ

SEQ ID NO: 9546 - protein, 11 aa, Artificial Sequence
  Synthetic Construct
AQVDSRNVVAQ

SEQ ID NO: 9547 - protein, 11 aa, Artificial Sequence
  Synthetic Construct
AQLGKQTALAQ

SEQ ID NO: 9548 - protein, 11 aa, Artificial Sequence
  Synthetic Construct
AQSGNRTNMAQ

SEQ ID NO: 9549 - protein, 11 aa, Artificial Sequence
  Synthetic Construct
AQVKGYASTAQ

SEQ ID NO: 9550 - protein, 11 aa, Artificial Sequence
  Synthetic Construct
AQASVSSSSAQ

SEQ ID NO: 9551 - protein, 11 aa, Artificial Sequence
  Synthetic Construct
AQLQLKSGMAQ

SEQ ID NO: 9552 - protein, 11 aa, Artificial Sequence
  Synthetic Construct
AQDMRASGSAQ

SEQ ID NO: 9553 - protein, 11 aa, Artificial Sequence
  Synthetic Construct
AQLTATLPYAQ

SEQ ID NO: 9554 - protein, 11 aa, Artificial Sequence
  Synthetic Construct
AQSNAPNSYAQ

SEQ ID NO: 9555 - protein, 11 aa, Artificial Sequence
  Synthetic Construct
AQKVESSRAAQ

SEQ ID NO: 9556 - protein, 11 aa, Artificial Sequence
  Synthetic Construct
AQWSNSTTVAQ

SEQ ID NO: 9557 - protein, 11 aa, Artificial Sequence
  Synthetic Construct
AQSLIHTRPAQ

SEQ ID NO: 9558 - protein, 11 aa, Artificial Sequence
  Synthetic Construct
AQTLSSPHNAQ

SEQ ID NO: 9559 - protein, 11 aa, Artificial Sequence
  Synthetic Construct
AQVPRFNGNAQ

SEQ ID NO: 9560 - protein, 11 aa, Artificial Sequence
  Synthetic Construct
AQFNHSGSGAQ

SEQ ID NO: 9561 - protein, 11 aa, Artificial Sequence
  Synthetic Construct
AQWVDTNSKAQ

SEQ ID NO: 9562 - protein, 11 aa, Artificial Sequence
  Synthetic Construct
AQHSDGSRLAQ

SEQ ID NO: 9563 - protein, 11 aa, Artificial Sequence
  Synthetic Construct
AQRQAVQTSAQ

SEQ ID NO: 9564 - protein, 11 aa, Artificial Sequence
  Synthetic Construct
AQMHSGIPTAQ

SEQ ID NO: 9565 - protein, 11 aa, Artificial Sequence
  Synthetic Construct
AQVKDQGRSAQ

SEQ ID NO: 9566 - protein, 11 aa, Artificial Sequence
  Synthetic Construct
AQRPTLSNQAQ

SEQ ID NO: 9567 - protein, 11 aa, Artificial Sequence
  Synthetic Construct
AQVSKSAALAQ

SEQ ID NO: 9568 - protein, 11 aa, Artificial Sequence
  Synthetic Construct
AQKDSHLSSAQ

SEQ ID NO: 9569 - protein, 11 aa, Artificial Sequence
  Synthetic Construct
AQVGVRMTGAQ

SEQ ID NO: 9570 - protein, 11 aa, Artificial Sequence
  Synthetic Construct
AQADRLLNSAQ

SEQ ID NO: 9571 - protein, 11 aa, Artificial Sequence
  Synthetic Construct
AQGSELRTGAQ

SEQ ID NO: 9572 - protein, 11 aa, Artificial Sequence
  Synthetic Construct
AQMKLSTSSAQ

SEQ ID NO: 9573 - protein, 11 aa, Artificial Sequence
  Synthetic Construct
AQQAYNIVPAQ

SEQ ID NO: 9574 - protein, 11 aa, Artificial Sequence
  Synthetic Construct
AQVGGNIRTAQ

SEQ ID NO: 9575 - protein, 11 aa, Artificial Sequence
  Synthetic Construct
AQSYQQTLGAQ

SEQ ID NO: 9576 - protein, 11 aa, Artificial Sequence
  Synthetic Construct
AQMRPTPTDAQ

SEQ ID NO: 9577 - protein, 11 aa, Artificial Sequence
  Synthetic Construct
AQRKANDLNAQ

SEQ ID NO: 9578 - protein, 11 aa, Artificial Sequence
  Synthetic Construct
AQISGTASTAQ

SEQ ID NO: 9579 - protein, 11 aa, Artificial Sequence
  Synthetic Construct
AQYVQLNNAAQ

SEQ ID NO: 9580 - protein, 11 aa, Artificial Sequence
  Synthetic Construct
AQTEKGWGPAQ

SEQ ID NO: 9581 - protein, 11 aa, Artificial Sequence
  Synthetic Construct
AQSPQRHNSAQ

SEQ ID NO: 9582 - protein, 11 aa, Artificial Sequence
  Synthetic Construct
AQYTHMTERAQ

SEQ ID NO: 9583 - protein, 11 aa, Artificial Sequence
  Synthetic Construct
AQDRSMQQAAQ

SEQ ID NO: 9584 - protein, 11 aa, Artificial Sequence
  Synthetic Construct
AQDTMNAMRAQ

SEQ ID NO: 9585 - protein, 11 aa, Artificial Sequence
  Synthetic Construct
AQLKPGHMVAQ

SEQ ID NO: 9586 - protein, 11 aa, Artificial Sequence
  Synthetic Construct
AQQFNSKDTAQ

SEQ ID NO: 9587 - protein, 11 aa, Artificial Sequence
  Synthetic Construct
AQWTNSRPMAQ

SEQ ID NO: 9588 - protein, 11 aa, Artificial Sequence
  Synthetic Construct
AQLLTTSSEAQ

SEQ ID NO: 9589 - protein, 11 aa, Artificial Sequence
  Synthetic Construct
AQQRASSGSAQ

SEQ ID NO: 9590 - protein, 11 aa, Artificial Sequence
  Synthetic Construct
AQPKESNNMAQ

SEQ ID NO: 9591 - protein, 11 aa, Artificial Sequence
  Synthetic Construct
AQAKHVATEAQ

SEQ ID NO: 9592 - protein, 11 aa, Artificial Sequence
  Synthetic Construct
AQTQSSTYSAQ

SEQ ID NO: 9593 - protein, 11 aa, Artificial Sequence
  Synthetic Construct
AQPRTSTNIAQ

SEQ ID NO: 9594 - protein, 11 aa, Artificial Sequence
  Synthetic Construct
AQRLASNSDAQ

SEQ ID NO: 9595 - protein, 11 aa, Artificial Sequence
  Synthetic Construct
AQGPLQTNAAQ

SEQ ID NO: 9596 - protein, 11 aa, Artificial Sequence
  Synthetic Construct
AQKVSAMSDAQ

SEQ ID NO: 9597 - protein, 11 aa, Artificial Sequence
  Synthetic Construct
AQAGKYVNSAQ

SEQ ID NO: 9598 - protein, 11 aa, Artificial Sequence
  Synthetic Construct
AQPKSGSPSAQ

SEQ ID NO: 9599 - protein, 11 aa, Artificial Sequence
  Synthetic Construct
AQFISNGSSAQ

SEQ ID NO: 9600 - protein, 11 aa, Artificial Sequence
  Synthetic Construct
AQNLNAMHKAQ

SEQ ID NO: 9601 - protein, 11 aa, Artificial Sequence
  Synthetic Construct
AQESHAREGAQ

SEQ ID NO: 9602 - protein, 11 aa, Artificial Sequence
  Synthetic Construct
AQTVVGVRGAQ

SEQ ID NO: 9603 - protein, 11 aa, Artificial Sequence
  Synthetic Construct
AQAKATVPSAQ

SEQ ID NO: 9604 - protein, 11 aa, Artificial Sequence
  Synthetic Construct
AQTKTVNMTAQ

SEQ ID NO: 9605 - protein, 11 aa, Artificial Sequence
  Synthetic Construct
AQQSSLKLTAQ

SEQ ID NO: 9606 - protein, 11 aa, Artificial Sequence
  Synthetic Construct
AQNAQRTGPAQ

SEQ ID NO: 9607 - protein, 11 aa, Artificial Sequence
  Synthetic Construct
AQNRRDATPAQ

SEQ ID NO: 9608 - protein, 11 aa, Artificial Sequence
  Synthetic Construct
AQGNQNTLLAQ

SEQ ID NO: 9609 - protein, 11 aa, Artificial Sequence
  Synthetic Construct
AQTRVSGSAAQ

SEQ ID NO: 9610 - protein, 11 aa, Artificial Sequence
  Synthetic Construct
AQVTTAMMSAQ

SEQ ID NO: 9611 - protein, 11 aa, Artificial Sequence
  Synthetic Construct
AQDRTPIAHAQ

SEQ ID NO: 9612 - protein, 11 aa, Artificial Sequence
  Synthetic Construct
AQLPLNSRPAQ

SEQ ID NO: 9613 - protein, 11 aa, Artificial Sequence
  Synthetic Construct
AQPQASQANAQ

SEQ ID NO: 9614 - protein, 11 aa, Artificial Sequence
  Synthetic Construct
AQTARNVPNAQ

SEQ ID NO: 9615 - protein, 11 aa, Artificial Sequence
  Synthetic Construct
AQLNGILSQAQ

SEQ ID NO: 9616 - protein, 11 aa, Artificial Sequence
  Synthetic Construct
AQLQDKTLNAQ

SEQ ID NO: 9617 - protein, 11 aa, Artificial Sequence
  Synthetic Construct
AQYRGENNPAQ

SEQ ID NO: 9618 - protein, 11 aa, Artificial Sequence
  Synthetic Construct
AQVNKQLNSAQ

SEQ ID NO: 9619 - protein, 11 aa, Artificial Sequence
  Synthetic Construct
AQVLKDDGHAQ

SEQ ID NO: 9620 - protein, 11 aa, Artificial Sequence
  Synthetic Construct
AQTRGEVSLAQ

SEQ ID NO: 9621 - protein, 11 aa, Artificial Sequence
  Synthetic Construct
AQEFQRMHPAQ

SEQ ID NO: 9622 - protein, 11 aa, Artificial Sequence
  Synthetic Construct
AQISPMSTSAQ

SEQ ID NO: 9623 - protein, 11 aa, Artificial Sequence
  Synthetic Construct
AQLGHDHATAQ

SEQ ID NO: 9624 - protein, 11 aa, Artificial Sequence
  Synthetic Construct
AQLSPGPQQAQ

SEQ ID NO: 9625 - protein, 11 aa, Artificial Sequence
  Synthetic Construct
AQKFRGEEPAQ

SEQ ID NO: 9626 - protein, 11 aa, Artificial Sequence
  Synthetic Construct
AQQGSRLASAQ

SEQ ID NO: 9627 - protein, 11 aa, Artificial Sequence
  Synthetic Construct
AQWERSQLSAQ

SEQ ID NO: 9628 - protein, 11 aa, Artificial Sequence
  Synthetic Construct
AQQQKAANGAQ

SEQ ID NO: 9629 - protein, 11 aa, Artificial Sequence
  Synthetic Construct
AQYTLSLSSAQ

SEQ ID NO: 9630 - protein, 11 aa, Artificial Sequence
  Synthetic Construct
AQGLIPNNSAQ

SEQ ID NO: 9631 - protein, 11 aa, Artificial Sequence
  Synthetic Construct
AQSVPVSRTAQ

SEQ ID NO: 9632 - protein, 11 aa, Artificial Sequence
  Synthetic Construct
AQNKQQSQTAQ

SEQ ID NO: 9633 - protein, 11 aa, Artificial Sequence
  Synthetic Construct
AQSKHSVQVAQ

SEQ ID NO: 9634 - protein, 11 aa, Artificial Sequence
  Synthetic Construct
AQNRPSQQGAQ

SEQ ID NO: 9635 - protein, 11 aa, Artificial Sequence
  Synthetic Construct
AQQEYRNTLAQ

SEQ ID NO: 9636 - protein, 11 aa, Artificial Sequence
  Synthetic Construct
AQFERDRMGAQ

SEQ ID NO: 9637 - protein, 11 aa, Artificial Sequence
  Synthetic Construct
AQSTSSNLSAQ

SEQ ID NO: 9638 - protein, 11 aa, Artificial Sequence
  Synthetic Construct
AQRSLEGIVAQ

SEQ ID NO: 9639 - protein, 11 aa, Artificial Sequence
  Synthetic Construct
AQGNSRLDPAQ

SEQ ID NO: 9640 - protein, 11 aa, Artificial Sequence
  Synthetic Construct
AQIDTIGKAAQ

SEQ ID NO: 9641 - protein, 11 aa, Artificial Sequence
  Synthetic Construct
AQLDHTSRAAQ

SEQ ID NO: 9642 - protein, 11 aa, Artificial Sequence
  Synthetic Construct
AQWGQTNSSAQ

SEQ ID NO: 9643 - protein, 11 aa, Artificial Sequence
  Synthetic Construct
AQARGNLSSAQ

SEQ ID NO: 9644 - protein, 11 aa, Artificial Sequence
  Synthetic Construct
AQDNMKLHVAQ

SEQ ID NO: 9645 - protein, 11 aa, Artificial Sequence
  Synthetic Construct
AQEKTQQSYAQ

SEQ ID NO: 9646 - protein, 11 aa, Artificial Sequence
  Synthetic Construct
AQSNGLARNAQ

SEQ ID NO: 9647 - protein, 11 aa, Artificial Sequence
  Synthetic Construct
AQVVSHRPAAQ

SEQ ID NO: 9648 - protein, 11 aa, Artificial Sequence
  Synthetic Construct
AQSLGVSRNAQ

SEQ ID NO: 9649 - protein, 11 aa, Artificial Sequence
  Synthetic Construct
AQDHSHGRDAQ

SEQ ID NO: 9650 - protein, 11 aa, Artificial Sequence
  Synthetic Construct
AQSTHQVANAQ

SEQ ID NO: 9651 - protein, 11 aa, Artificial Sequence
  Synthetic Construct
AQNQSASSRAQ

SEQ ID NO: 9652 - protein, 11 aa, Artificial Sequence
  Synthetic Construct
AQVTVGSHMAQ

SEQ ID NO: 9653 - protein, 11 aa, Artificial Sequence
  Synthetic Construct
AQSSNIAQNAQ

SEQ ID NO: 9654 - protein, 11 aa, Artificial Sequence
  Synthetic Construct
AQLNEMATPAQ

SEQ ID NO: 9655 - protein, 11 aa, Artificial Sequence
  Synthetic Construct
AQSTKIERDAQ

SEQ ID NO: 9656 - protein, 11 aa, Artificial Sequence
  Synthetic Construct
AQNLVDARIAQ

SEQ ID NO: 9657 - protein, 11 aa, Artificial Sequence
  Synthetic Construct
AQYSTGKDAAQ

SEQ ID NO: 9658 - protein, 11 aa, Artificial Sequence
  Synthetic Construct
AQTQGIVTSAQ

SEQ ID NO: 9659 - protein, 11 aa, Artificial Sequence
  Synthetic Construct
AQSFGATSLAQ

SEQ ID NO: 9660 - protein, 11 aa, Artificial Sequence
  Synthetic Construct
AQTAGMSSRAQ

SEQ ID NO: 9661 - protein, 11 aa, Artificial Sequence
  Synthetic Construct
AQRDNSLIPAQ

SEQ ID NO: 9662 - protein, 11 aa, Artificial Sequence
  Synthetic Construct
AQKTNADYGAQ

SEQ ID NO: 9663 - protein, 11 aa, Artificial Sequence
  Synthetic Construct
AQVNPHRTMAQ

SEQ ID NO: 9664 - protein, 11 aa, Artificial Sequence
  Synthetic Construct
AQDIRGRPTAQ

SEQ ID NO: 9665 - protein, 11 aa, Artificial Sequence
  Synthetic Construct
AQREVSSTSAQ

SEQ ID NO: 9666 - protein, 11 aa, Artificial Sequence
  Synthetic Construct
AQVSQGTRVAQ

SEQ ID NO: 9667 - protein, 11 aa, Artificial Sequence
  Synthetic Construct
AQKTPIMHAAQ

SEQ ID NO: 9668 - protein, 11 aa, Artificial Sequence
  Synthetic Construct
AQLESRDTVAQ

SEQ ID NO: 9669 - protein, 11 aa, Artificial Sequence
  Synthetic Construct
AQVLNSSMTAQ

SEQ ID NO: 9670 - protein, 11 aa, Artificial Sequence
  Synthetic Construct
AQFRTVTQAAQ

SEQ ID NO: 9671 - protein, 11 aa, Artificial Sequence
  Synthetic Construct
AQTGAMNMTAQ

SEQ ID NO: 9672 - protein, 11 aa, Artificial Sequence
  Synthetic Construct
AQLKTQNYSAQ

SEQ ID NO: 9673 - protein, 11 aa, Artificial Sequence
  Synthetic Construct
AQQKTMLTAAQ

SEQ ID NO: 9674 - protein, 11 aa, Artificial Sequence
  Synthetic Construct
AQSNIIGSDAQ

SEQ ID NO: 9675 - protein, 11 aa, Artificial Sequence
  Synthetic Construct
AQSVSVSKMAQ

SEQ ID NO: 9676 - protein, 11 aa, Artificial Sequence
  Synthetic Construct
AQAAQVSHAAQ

SEQ ID NO: 9677 - protein, 11 aa, Artificial Sequence
  Synthetic Construct
AQINVVEKAAQ

SEQ ID NO: 9678 - protein, 11 aa, Artificial Sequence
  Synthetic Construct
AQMLRGDLPAQ

SEQ ID NO: 9679 - protein, 11 aa, Artificial Sequence
  Synthetic Construct
AQNLPTMQPAQ

SEQ ID NO: 9680 - protein, 11 aa, Artificial Sequence
  Synthetic Construct
AQFQDKINRAQ

SEQ ID NO: 9681 - protein, 11 aa, Artificial Sequence
  Synthetic Construct
AQSRQTIETAQ

SEQ ID NO: 9682 - protein, 11 aa, Artificial Sequence
  Synthetic Construct
AQLHSKLNGAQ

SEQ ID NO: 9683 - protein, 11 aa, Artificial Sequence
  Synthetic Construct
AQTPSASNMAQ

SEQ ID NO: 9684 - protein, 11 aa, Artificial Sequence
  Synthetic Construct
AQANTAIRTAQ

SEQ ID NO: 9685 - protein, 11 aa, Artificial Sequence
  Synthetic Construct
AQSPYNQNNAQ

SEQ ID NO: 9686 - protein, 11 aa, Artificial Sequence
  Synthetic Construct
AQSGKQQTTAQ

SEQ ID NO: 9687 - protein, 11 aa, Artificial Sequence
  Synthetic Construct
AQNLPVQGSAQ

SEQ ID NO: 9688 - protein, 11 aa, Artificial Sequence
  Synthetic Construct
AQPNLTTERAQ

SEQ ID NO: 9689 - protein, 11 aa, Artificial Sequence
  Synthetic Construct
AQASLVNTAAQ

SEQ ID NO: 9690 - protein, 11 aa, Artificial Sequence
  Synthetic Construct
AQSTAGDTRAQ

SEQ ID NO: 9691 - protein, 11 aa, Artificial Sequence
  Synthetic Construct
AQLRDTRTDAQ

SEQ ID NO: 9692 - protein, 11 aa, Artificial Sequence
  Synthetic Construct
AQLQQAQPQAQ

SEQ ID NO: 9693 - protein, 11 aa, Artificial Sequence
  Synthetic Construct
AQYSPHVTPAQ

SEQ ID NO: 9694 - protein, 11 aa, Artificial Sequence
  Synthetic Construct
AQLQIKTSPAQ

SEQ ID NO: 9695 - protein, 11 aa, Artificial Sequence
  Synthetic Construct
AQRVPPNLQAQ

SEQ ID NO: 9696 - protein, 11 aa, Artificial Sequence
  Synthetic Construct
AQLAEHPKTAQ

SEQ ID NO: 9697 - protein, 11 aa, Artificial Sequence
  Synthetic Construct
AQIAARSPLAQ

SEQ ID NO: 9698 - protein, 11 aa, Artificial Sequence
  Synthetic Construct
AQSGKQHEDAQ

SEQ ID NO: 9699 - protein, 11 aa, Artificial Sequence
  Synthetic Construct
AQIGNLQATAQ

SEQ ID NO: 9700 - protein, 11 aa, Artificial Sequence
  Synthetic Construct
AQPDASQRVAQ

SEQ ID NO: 9701 - protein, 11 aa, Artificial Sequence
  Synthetic Construct
AQAVDRMTPAQ

SEQ ID NO: 9702 - protein, 11 aa, Artificial Sequence
  Synthetic Construct
AQFGREKPAAQ

SEQ ID NO: 9703 - protein, 11 aa, Artificial Sequence
  Synthetic Construct
AQLNNRPQLAQ

SEQ ID NO: 9704 - protein, 11 aa, Artificial Sequence
  Synthetic Construct
AQNFHGRTDAQ

SEQ ID NO: 9705 - protein, 11 aa, Artificial Sequence
  Synthetic Construct
AQGVRLSSTAQ

SEQ ID NO: 9706 - protein, 11 aa, Artificial Sequence
  Synthetic Construct
AQTVNSHRQAQ

SEQ ID NO: 9707 - protein, 11 aa, Artificial Sequence
  Synthetic Construct
AQNSNHTPRAQ

SEQ ID NO: 9708 - protein, 11 aa, Artificial Sequence
  Synthetic Construct
AQANTITVVAQ

SEQ ID NO: 9709 - protein, 11 aa, Artificial Sequence
  Synthetic Construct
AQDVTQSKPAQ

SEQ ID NO: 9710 - protein, 11 aa, Artificial Sequence
  Synthetic Construct
AQGNHARNLAQ

SEQ ID NO: 9711 - protein, 11 aa, Artificial Sequence
  Synthetic Construct
AQQHRDTSMAQ

SEQ ID NO: 9712 - protein, 11 aa, Artificial Sequence
  Synthetic Construct
AQLQGRLTSAQ

SEQ ID NO: 9713 - protein, 11 aa, Artificial Sequence
  Synthetic Construct
AQISMREQSAQ

SEQ ID NO: 9714 - protein, 11 aa, Artificial Sequence
  Synthetic Construct
AQTRNFDHTAQ

SEQ ID NO: 9715 - protein, 11 aa, Artificial Sequence
  Synthetic Construct
AQASHRAQIAQ

SEQ ID NO: 9716 - protein, 11 aa, Artificial Sequence
  Synthetic Construct
AQNQQSPHKAQ

SEQ ID NO: 9717 - protein, 11 aa, Artificial Sequence
  Synthetic Construct
AQRPGESNPAQ

SEQ ID NO: 9718 - protein, 11 aa, Artificial Sequence
  Synthetic Construct
AQARDSSIMAQ

SEQ ID NO: 9719 - protein, 11 aa, Artificial Sequence
  Synthetic Construct
AQTGMSTQVAQ

SEQ ID NO: 9720 - protein, 11 aa, Artificial Sequence
  Synthetic Construct
AQMGVKADIAQ

SEQ ID NO: 9721 - protein, 11 aa, Artificial Sequence
  Synthetic Construct
AQQFKGITQAQ

SEQ ID NO: 9722 - protein, 11 aa, Artificial Sequence
  Synthetic Construct
AQHNNSPTHAQ

SEQ ID NO: 9723 - protein, 11 aa, Artificial Sequence
  Synthetic Construct
AQDSNFTSAAQ

SEQ ID NO: 9724 - protein, 11 aa, Artificial Sequence
  Synthetic Construct
AQAVPHMGTAQ

SEQ ID NO: 9725 - protein, 11 aa, Artificial Sequence
  Synthetic Construct
AQVVSPNLMAQ

SEQ ID NO: 9726 - protein, 11 aa, Artificial Sequence
  Synthetic Construct
AQPFPKTLDAQ

SEQ ID NO: 9727 - protein, 11 aa, Artificial Sequence
  Synthetic Construct
AQQSAGLAEAQ

SEQ ID NO: 9728 - protein, 11 aa, Artificial Sequence
  Synthetic Construct
AQGKAHDLAAQ

SEQ ID NO: 9729 - protein, 11 aa, Artificial Sequence
  Synthetic Construct
AQQRISTNAAQ

SEQ ID NO: 9730 - protein, 11 aa, Artificial Sequence
  Synthetic Construct
AQWLTTGSSAQ

SEQ ID NO: 9731 - protein, 11 aa, Artificial Sequence
  Synthetic Construct
AQYRAQGPLAQ

SEQ ID NO: 9732 - protein, 11 aa, Artificial Sequence
  Synthetic Construct
AQVMKRYDEAQ

SEQ ID NO: 9733 - protein, 11 aa, Artificial Sequence
  Synthetic Construct
AQLEYSQRDAQ

SEQ ID NO: 9734 - protein, 11 aa, Artificial Sequence
  Synthetic Construct
AQLQKVHLGAQ

SEQ ID NO: 9735 - protein, 11 aa, Artificial Sequence
  Synthetic Construct
AQRSHSHPSAQ

SEQ ID NO: 9736 - protein, 11 aa, Artificial Sequence
  Synthetic Construct
AQHTFTSTGAQ

SEQ ID NO: 9737 - protein, 11 aa, Artificial Sequence
  Synthetic Construct
AQSVGSGPGAQ

SEQ ID NO: 9738 - protein, 11 aa, Artificial Sequence
  Synthetic Construct
AQQSFNGSNAQ

SEQ ID NO: 9739 - protein, 11 aa, Artificial Sequence
  Synthetic Construct
AQVTAIRGAAQ

SEQ ID NO: 9740 - protein, 11 aa, Artificial Sequence
  Synthetic Construct
AQLGKTSYSAQ

SEQ ID NO: 9741 - protein, 11 aa, Artificial Sequence
  Synthetic Construct
AQSTMAMASAQ

SEQ ID NO: 9742 - protein, 11 aa, Artificial Sequence
  Synthetic Construct
AQASGRSSAAQ

SEQ ID NO: 9743 - protein, 11 aa, Artificial Sequence
  Synthetic Construct
AQGRTPAVEAQ

SEQ ID NO: 9744 - protein, 11 aa, Artificial Sequence
  Synthetic Construct
AQGRIDVSSAQ

SEQ ID NO: 9745 - protein, 11 aa, Artificial Sequence
  Synthetic Construct
AQTPKVNSSAQ

SEQ ID NO: 9746 - protein, 11 aa, Artificial Sequence
  Synthetic Construct
AQSVRNSTTAQ

SEQ ID NO: 9747 - protein, 11 aa, Artificial Sequence
  Synthetic Construct
AQVNGAQQIAQ

SEQ ID NO: 9748 - protein, 11 aa, Artificial Sequence
  Synthetic Construct
AQNRAESFRAQ

SEQ ID NO: 9749 - protein, 11 aa, Artificial Sequence
  Synthetic Construct
AQHDRASVRAQ

SEQ ID NO: 9750 - protein, 11 aa, Artificial Sequence
  Synthetic Construct
AQDSPSRGRAQ

SEQ ID NO: 9751 - protein, 11 aa, Artificial Sequence
  Synthetic Construct
AQSNNIHSKAQ

SEQ ID NO: 9752 - protein, 11 aa, Artificial Sequence
  Synthetic Construct
AQINNIVIPAQ

SEQ ID NO: 9753 - protein, 11 aa, Artificial Sequence
  Synthetic Construct
AQIRSSDETAQ

SEQ ID NO: 9754 - protein, 11 aa, Artificial Sequence
  Synthetic Construct
AQNMPSLVAAQ

SEQ ID NO: 9755 - protein, 11 aa, Artificial Sequence
  Synthetic Construct
AQNRTLESIAQ

SEQ ID NO: 9756 - protein, 11 aa, Artificial Sequence
  Synthetic Construct
AQPQHNNQPAQ

SEQ ID NO: 9757 - protein, 11 aa, Artificial Sequence
  Synthetic Construct
AQLGYNAHPAQ

SEQ ID NO: 9758 - protein, 11 aa, Artificial Sequence
  Synthetic Construct
AQLKHQYDGAQ

SEQ ID NO: 9759 - protein, 11 aa, Artificial Sequence
  Synthetic Construct
AQHYSPTREAQ

SEQ ID NO: 9760 - protein, 11 aa, Artificial Sequence
  Synthetic Construct
AQSYRSTSDAQ

SEQ ID NO: 9761 - protein, 11 aa, Artificial Sequence
  Synthetic Construct
AQVTPTAALAQ

SEQ ID NO: 9762 - protein, 11 aa, Artificial Sequence
  Synthetic Construct
AQLEQRYSSAQ

SEQ ID NO: 9763 - protein, 11 aa, Artificial Sequence
  Synthetic Construct
AQMNNIRQSAQ

SEQ ID NO: 9764 - protein, 11 aa, Artificial Sequence
  Synthetic Construct
AQSSRNDASAQ

SEQ ID NO: 9765 - protein, 11 aa, Artificial Sequence
  Synthetic Construct
AQGTDRKPFAQ

SEQ ID NO: 9766 - protein, 11 aa, Artificial Sequence
  Synthetic Construct
AQRVNKEDRAQ

SEQ ID NO: 9767 - protein, 11 aa, Artificial Sequence
  Synthetic Construct
AQTGRSLATAQ

SEQ ID NO: 9768 - protein, 11 aa, Artificial Sequence
  Synthetic Construct
AQMKSSTSNAQ

SEQ ID NO: 9769 - protein, 11 aa, Artificial Sequence
  Synthetic Construct
AQRHDLASNAQ

SEQ ID NO: 9770 - protein, 11 aa, Artificial Sequence
  Synthetic Construct
AQLMAVSTPAQ

SEQ ID NO: 9771 - protein, 11 aa, Artificial Sequence
  Synthetic Construct
AQREGIYTLAQ

SEQ ID NO: 9772 - protein, 11 aa, Artificial Sequence
  Synthetic Construct
AQDNKGSLSAQ

SEQ ID NO: 9773 - protein, 11 aa, Artificial Sequence
  Synthetic Construct
AQKGQVTHGAQ

SEQ ID NO: 9774 - protein, 11 aa, Artificial Sequence
  Synthetic Construct
AQSKTLNNLAQ

SEQ ID NO: 9775 - protein, 11 aa, Artificial Sequence
  Synthetic Construct
AQRNPQVPTAQ

SEQ ID NO: 9776 - protein, 11 aa, Artificial Sequence
  Synthetic Construct
AQSANASNTAQ

SEQ ID NO: 9777 - protein, 11 aa, Artificial Sequence
  Synthetic Construct
AQGYMKPAIAQ

SEQ ID NO: 9778 - protein, 11 aa, Artificial Sequence
  Synthetic Construct
AQSSHGPTPAQ

SEQ ID NO: 9779 - protein, 11 aa, Artificial Sequence
  Synthetic Construct
AQSTRNPPQAQ

SEQ ID NO: 9780 - protein, 11 aa, Artificial Sequence
  Synthetic Construct
AQLNRINEQAQ

SEQ ID NO: 9781 - protein, 11 aa, Artificial Sequence
  Synthetic Construct
AQGAAKSQNAQ

SEQ ID NO: 9782 - protein, 11 aa, Artificial Sequence
  Synthetic Construct
AQLPTLHGPAQ

SEQ ID NO: 9783 - protein, 11 aa, Artificial Sequence
  Synthetic Construct
AQVPSTIKGAQ

SEQ ID NO: 9784 - protein, 11 aa, Artificial Sequence
  Synthetic Construct
AQTSSMRESAQ

SEQ ID NO: 9785 - protein, 11 aa, Artificial Sequence
  Synthetic Construct
AQLMSSNNAAQ

SEQ ID NO: 9786 - protein, 11 aa, Artificial Sequence
  Synthetic Construct
AQAKTQSATAQ

SEQ ID NO: 9787 - protein, 11 aa, Artificial Sequence
  Synthetic Construct
AQKEGQSRYAQ

SEQ ID NO: 9788 - protein, 11 aa, Artificial Sequence
  Synthetic Construct
AQKVNSSATAQ

SEQ ID NO: 9789 - protein, 11 aa, Artificial Sequence
  Synthetic Construct
AQRTTSLVAAQ

SEQ ID NO: 9790 - protein, 11 aa, Artificial Sequence
  Synthetic Construct
AQMTNQSAHAQ

SEQ ID NO: 9791 - protein, 11 aa, Artificial Sequence
  Synthetic Construct
AQPHIRGENAQ

SEQ ID NO: 9792 - protein, 11 aa, Artificial Sequence
  Synthetic Construct
AQRTQSSISAQ

SEQ ID NO: 9793 - protein, 11 aa, Artificial Sequence
  Synthetic Construct
AQMFTTTGAAQ

SEQ ID NO: 9794 - protein, 11 aa, Artificial Sequence
  Synthetic Construct
AQSNIKLMAAQ

SEQ ID NO: 9795 - protein, 11 aa, Artificial Sequence
  Synthetic Construct
AQSTQGTRDAQ

SEQ ID NO: 9796 - protein, 11 aa, Artificial Sequence
  Synthetic Construct
AQILSGRNGAQ

SEQ ID NO: 9797 - protein, 11 aa, Artificial Sequence
  Synthetic Construct
AQGLKVSGSAQ

SEQ ID NO: 9798 - protein, 11 aa, Artificial Sequence
  Synthetic Construct
AQTGANLPNAQ

SEQ ID NO: 9799 - protein, 11 aa, Artificial Sequence
  Synthetic Construct
AQYSLSMPNAQ

SEQ ID NO: 9800 - protein, 11 aa, Artificial Sequence
  Synthetic Construct
AQTFERKAAAQ

SEQ ID NO: 9801 - protein, 11 aa, Artificial Sequence
  Synthetic Construct
AQLGRASSVAQ

SEQ ID NO: 9802 - protein, 11 aa, Artificial Sequence
  Synthetic Construct
AQRTKTSDGAQ

SEQ ID NO: 9803 - protein, 11 aa, Artificial Sequence
  Synthetic Construct
AQLNPHLGPAQ

SEQ ID NO: 9804 - protein, 11 aa, Artificial Sequence
  Synthetic Construct
AQIMPNNTMAQ

SEQ ID NO: 9805 - protein, 11 aa, Artificial Sequence
  Synthetic Construct
AQHKSDSGYAQ

SEQ ID NO: 9806 - protein, 11 aa, Artificial Sequence
  Synthetic Construct
AQDRLNKNSAQ

SEQ ID NO: 9807 - protein, 11 aa, Artificial Sequence
  Synthetic Construct
AQMSGGSSKAQ

SEQ ID NO: 9808 - protein, 11 aa, Artificial Sequence
  Synthetic Construct
AQQREQGNAAQ

SEQ ID NO: 9809 - protein, 11 aa, Artificial Sequence
  Synthetic Construct
AQGGGNVTSAQ

SEQ ID NO: 9810 - protein, 11 aa, Artificial Sequence
  Synthetic Construct
AQNLKNAYVAQ

SEQ ID NO: 9811 - protein, 11 aa, Artificial Sequence
  Synthetic Construct
AQSKNDRPGAQ

SEQ ID NO: 9812 - protein, 11 aa, Artificial Sequence
  Synthetic Construct
AQRGSGQDIAQ

SEQ ID NO: 9813 - protein, 11 aa, Artificial Sequence
  Synthetic Construct
AQVGSNTSYAQ

SEQ ID NO: 9814 - protein, 11 aa, Artificial Sequence
  Synthetic Construct
AQSPRIGSTAQ

SEQ ID NO: 9815 - protein, 11 aa, Artificial Sequence
  Synthetic Construct
AQGTLKETSAQ

SEQ ID NO: 9816 - protein, 11 aa, Artificial Sequence
  Synthetic Construct
AQSIQRTVAAQ

SEQ ID NO: 9817 - protein, 11 aa, Artificial Sequence
  Synthetic Construct
AQRGESNGTAQ

SEQ ID NO: 9818 - protein, 11 aa, Artificial Sequence
  Synthetic Construct
AQEPSNARVAQ

SEQ ID NO: 9819 - protein, 11 aa, Artificial Sequence
  Synthetic Construct
AQSQATMNKAQ

SEQ ID NO: 9820 - protein, 11 aa, Artificial Sequence
  Synthetic Construct
AQAQGTSTTAQ

SEQ ID NO: 9821 - protein, 11 aa, Artificial Sequence
  Synthetic Construct
AQYMSKNNLAQ

SEQ ID NO: 9822 - protein, 11 aa, Artificial Sequence
  Synthetic Construct
AQNTTNMSKAQ

SEQ ID NO: 9823 - protein, 11 aa, Artificial Sequence
  Synthetic Construct
AQSKASKTEAQ

SEQ ID NO: 9824 - protein, 11 aa, Artificial Sequence
  Synthetic Construct
AQMAGSIVTAQ

SEQ ID NO: 9825 - protein, 11 aa, Artificial Sequence
  Synthetic Construct
AQVNSSQTPAQ

SEQ ID NO: 9826 - protein, 11 aa, Artificial Sequence
  Synthetic Construct
AQTRSALLDAQ

SEQ ID NO: 9827 - protein, 11 aa, Artificial Sequence
  Synthetic Construct
AQGISYSPSAQ

SEQ ID NO: 9828 - protein, 11 aa, Artificial Sequence
  Synthetic Construct
AQHGREVPQAQ

SEQ ID NO: 9829 - protein, 11 aa, Artificial Sequence
  Synthetic Construct
AQTRSADNRAQ

SEQ ID NO: 9830 - protein, 11 aa, Artificial Sequence
  Synthetic Construct
AQSGNSSRGAQ

SEQ ID NO: 9831 - protein, 11 aa, Artificial Sequence
  Synthetic Construct
AQTTKGNPSAQ

SEQ ID NO: 9832 - protein, 11 aa, Artificial Sequence
  Synthetic Construct
AQDMRSTRDAQ

SEQ ID NO: 9833 - protein, 11 aa, Artificial Sequence
  Synthetic Construct
AQLGNSLPAAQ

SEQ ID NO: 9834 - protein, 11 aa, Artificial Sequence
  Synthetic Construct
AQLTSMSIPAQ

SEQ ID NO: 9835 - protein, 11 aa, Artificial Sequence
  Synthetic Construct
AQGTHIKQAAQ

SEQ ID NO: 9836 - protein, 11 aa, Artificial Sequence
  Synthetic Construct
AQTQGRIVSAQ

SEQ ID NO: 9837 - protein, 11 aa, Artificial Sequence
  Synthetic Construct
AQLGGNNTLAQ

SEQ ID NO: 9838 - protein, 11 aa, Artificial Sequence
  Synthetic Construct
AQMSANNGRAQ

SEQ ID NO: 9839 - protein, 11 aa, Artificial Sequence
  Synthetic Construct
AQVTNPMSAAQ

SEQ ID NO: 9840 - protein, 11 aa, Artificial Sequence
  Synthetic Construct
AQEAYKSTSAQ

SEQ ID NO: 9841 - protein, 11 aa, Artificial Sequence
  Synthetic Construct
AQRPNNQGQAQ

SEQ ID NO: 9842 - protein, 11 aa, Artificial Sequence
  Synthetic Construct
AQMNFAGSGAQ

SEQ ID NO: 9843 - protein, 11 aa, Artificial Sequence
  Synthetic Construct
AQKTNHSSSAQ

SEQ ID NO: 9844 - protein, 11 aa, Artificial Sequence
  Synthetic Construct
AQNGYGSQTAQ

SEQ ID NO: 9845 - protein, 11 aa, Artificial Sequence
  Synthetic Construct
AQKTGHQFTAQ

SEQ ID NO: 9846 - protein, 11 aa, Artificial Sequence
  Synthetic Construct
AQTARTLQLAQ

SEQ ID NO: 9847 - protein, 11 aa, Artificial Sequence
  Synthetic Construct
AQQASTTQIAQ

SEQ ID NO: 9848 - protein, 11 aa, Artificial Sequence
  Synthetic Construct
AQTAFDTRGAQ

SEQ ID NO: 9849 - protein, 11 aa, Artificial Sequence
  Synthetic Construct
AQVNSHVARAQ

SEQ ID NO: 9850 - protein, 11 aa, Artificial Sequence
  Synthetic Construct
AQSPLHSNTAQ

SEQ ID NO: 9851 - protein, 11 aa, Artificial Sequence
  Synthetic Construct
AQLSRVTINAQ

SEQ ID NO: 9852 - protein, 11 aa, Artificial Sequence
  Synthetic Construct
AQTQHNVDSAQ

SEQ ID NO: 9853 - protein, 11 aa, Artificial Sequence
  Synthetic Construct
AQTFQTSNSAQ

SEQ ID NO: 9854 - protein, 11 aa, Artificial Sequence
  Synthetic Construct
AQSNHVSVNAQ

SEQ ID NO: 9855 - protein, 11 aa, Artificial Sequence
  Synthetic Construct
AQMLHSSITAQ

SEQ ID NO: 9856 - protein, 11 aa, Artificial Sequence
  Synthetic Construct
AQLKATDGSAQ

SEQ ID NO: 9857 - protein, 11 aa, Artificial Sequence
  Synthetic Construct
AQLGNMHNMAQ

SEQ ID NO: 9858 - protein, 11 aa, Artificial Sequence
  Synthetic Construct
AQINRLISGAQ

SEQ ID NO: 9859 - protein, 11 aa, Artificial Sequence
  Synthetic Construct
AQTRSNLASAQ

SEQ ID NO: 9860 - protein, 11 aa, Artificial Sequence
  Synthetic Construct
AQHSNGVRGAQ

SEQ ID NO: 9861 - protein, 11 aa, Artificial Sequence
  Synthetic Construct
AQAGNPREKAQ

SEQ ID NO: 9862 - protein, 11 aa, Artificial Sequence
  Synthetic Construct
AQRARDVDEAQ

SEQ ID NO: 9863 - protein, 11 aa, Artificial Sequence
  Synthetic Construct
AQVSNGPSLAQ

SEQ ID NO: 9864 - protein, 11 aa, Artificial Sequence
  Synthetic Construct
AQANQRGVGAQ

SEQ ID NO: 9865 - protein, 11 aa, Artificial Sequence
  Synthetic Construct
AQMRSETLNAQ

SEQ ID NO: 9866 - protein, 11 aa, Artificial Sequence
  Synthetic Construct
AQKPSSQLLAQ

SEQ ID NO: 9867 - protein, 11 aa, Artificial Sequence
  Synthetic Construct
AQSLRPHDRAQ

SEQ ID NO: 9868 - protein, 11 aa, Artificial Sequence
  Synthetic Construct
AQGSNASKYAQ

SEQ ID NO: 9869 - protein, 11 aa, Artificial Sequence
  Synthetic Construct
AQTNRDLGPAQ

SEQ ID NO: 9870 - protein, 11 aa, Artificial Sequence
  Synthetic Construct
AQWGSTAGAAQ

SEQ ID NO: 9871 - protein, 11 aa, Artificial Sequence
  Synthetic Construct
AQISGADRTAQ

SEQ ID NO: 9872 - protein, 11 aa, Artificial Sequence
  Synthetic Construct
AQSAVRSPIAQ

SEQ ID NO: 9873 - protein, 11 aa, Artificial Sequence
  Synthetic Construct
AQRVSHTETAQ

SEQ ID NO: 9874 - protein, 11 aa, Artificial Sequence
  Synthetic Construct
AQKANSQITAQ

SEQ ID NO: 9875 - protein, 11 aa, Artificial Sequence
  Synthetic Construct
AQPSVYREPAQ

SEQ ID NO: 9876 - protein, 11 aa, Artificial Sequence
  Synthetic Construct
AQTTNFVTSAQ

SEQ ID NO: 9877 - protein, 11 aa, Artificial Sequence
  Synthetic Construct
AQNLMPTDRAQ

SEQ ID NO: 9878 - protein, 11 aa, Artificial Sequence
  Synthetic Construct
AQTNHTGSQAQ

SEQ ID NO: 9879 - protein, 11 aa, Artificial Sequence
  Synthetic Construct
AQHWNGTNPAQ

SEQ ID NO: 9880 - protein, 11 aa, Artificial Sequence
  Synthetic Construct
AQHKSIGQEAQ

SEQ ID NO: 9881 - protein, 11 aa, Artificial Sequence
  Synthetic Construct
AQTRPIPISAQ

SEQ ID NO: 9882 - protein, 11 aa, Artificial Sequence
  Synthetic Construct
AQNPGMSRMAQ

SEQ ID NO: 9883 - protein, 11 aa, Artificial Sequence
  Synthetic Construct
AQIANRVSPAQ

SEQ ID NO: 9884 - protein, 11 aa, Artificial Sequence
  Synthetic Construct
AQTALANQKAQ

SEQ ID NO: 9885 - protein, 11 aa, Artificial Sequence
  Synthetic Construct
AQTSLSSSAAQ

SEQ ID NO: 9886 - protein, 11 aa, Artificial Sequence
  Synthetic Construct
AQALTGNMSAQ

SEQ ID NO: 9887 - protein, 11 aa, Artificial Sequence
  Synthetic Construct
AQMQTKNVPAQ

SEQ ID NO: 9888 - protein, 11 aa, Artificial Sequence
  Synthetic Construct
AQQATKTNVAQ

SEQ ID NO: 9889 - protein, 11 aa, Artificial Sequence
  Synthetic Construct
AQLHTTSSVAQ

SEQ ID NO: 9890 - protein, 11 aa, Artificial Sequence
  Synthetic Construct
AQYVQSSSNAQ

SEQ ID NO: 9891 - protein, 11 aa, Artificial Sequence
  Synthetic Construct
AQTMKIRTEAQ

SEQ ID NO: 9892 - protein, 11 aa, Artificial Sequence
  Synthetic Construct
AQKSHSPGSAQ

SEQ ID NO: 9893 - protein, 11 aa, Artificial Sequence
  Synthetic Construct
AQKAVDPPNAQ

SEQ ID NO: 9894 - protein, 11 aa, Artificial Sequence
  Synthetic Construct
AQNAPPMSPAQ

SEQ ID NO: 9895 - protein, 11 aa, Artificial Sequence
  Synthetic Construct
AQINKMFTPAQ

SEQ ID NO: 9896 - protein, 11 aa, Artificial Sequence
  Synthetic Construct
AQYAKATLGAQ

SEQ ID NO: 9897 - protein, 11 aa, Artificial Sequence
  Synthetic Construct
AQHLARPSEAQ

SEQ ID NO: 9898 - protein, 11 aa, Artificial Sequence
  Synthetic Construct
AQQLNSDRNAQ

SEQ ID NO: 9899 - protein, 11 aa, Artificial Sequence
  Synthetic Construct
AQMRPDTSYAQ

SEQ ID NO: 9900 - protein, 11 aa, Artificial Sequence
  Synthetic Construct
AQGVAMSSGAQ

SEQ ID NO: 9901 - protein, 11 aa, Artificial Sequence
  Synthetic Construct
AQGHSRPDRAQ

SEQ ID NO: 9902 - protein, 11 aa, Artificial Sequence
  Synthetic Construct
AQVFQATRTAQ

SEQ ID NO: 9903 - protein, 11 aa, Artificial Sequence
  Synthetic Construct
AQTSLTSYTAQ

SEQ ID NO: 9904 - protein, 11 aa, Artificial Sequence
  Synthetic Construct
AQKLNTGDIAQ

SEQ ID NO: 9905 - protein, 11 aa, Artificial Sequence
  Synthetic Construct
AQRTNETIVAQ

SEQ ID NO: 9906 - protein, 11 aa, Artificial Sequence
  Synthetic Construct
AQRLQNSTPAQ

SEQ ID NO: 9907 - protein, 11 aa, Artificial Sequence
  Synthetic Construct
AQTSRLTSGAQ

SEQ ID NO: 9908 - protein, 11 aa, Artificial Sequence
  Synthetic Construct
AQSNTTFSAAQ

SEQ ID NO: 9909 - protein, 11 aa, Artificial Sequence
  Synthetic Construct
AQDQRSSPAAQ

SEQ ID NO: 9910 - protein, 11 aa, Artificial Sequence
  Synthetic Construct
AQVGSGGSRAQ

SEQ ID NO: 9911 - protein, 11 aa, Artificial Sequence
  Synthetic Construct
AQRSTNAPNAQ

SEQ ID NO: 9912 - protein, 11 aa, Artificial Sequence
  Synthetic Construct
AQMAGQQRLAQ

SEQ ID NO: 9913 - protein, 11 aa, Artificial Sequence
  Synthetic Construct
AQIRNSAPPAQ

SEQ ID NO: 9914 - protein, 11 aa, Artificial Sequence
  Synthetic Construct
AQLSTKSFNAQ

SEQ ID NO: 9915 - protein, 11 aa, Artificial Sequence
  Synthetic Construct
AQWPGSITAAQ

SEQ ID NO: 9916 - protein, 11 aa, Artificial Sequence
  Synthetic Construct
AQTGGVHAQAQ

SEQ ID NO: 9917 - protein, 11 aa, Artificial Sequence
  Synthetic Construct
AQSERSSMAAQ

SEQ ID NO: 9918 - protein, 11 aa, Artificial Sequence
  Synthetic Construct
AQFQNGRNNAQ

SEQ ID NO: 9919 - protein, 11 aa, Artificial Sequence
  Synthetic Construct
AQGGSRLPQAQ

SEQ ID NO: 9920 - protein, 11 aa, Artificial Sequence
  Synthetic Construct
AQGGNSLSVAQ

SEQ ID NO: 9921 - protein, 11 aa, Artificial Sequence
  Synthetic Construct
AQSKKIDHGAQ

SEQ ID NO: 9922 - protein, 11 aa, Artificial Sequence
  Synthetic Construct
AQYRDTLAAAQ

SEQ ID NO: 9923 - protein, 11 aa, Artificial Sequence
  Synthetic Construct
AQLHSGERNAQ

SEQ ID NO: 9924 - protein, 11 aa, Artificial Sequence
  Synthetic Construct
AQIMPHGSPAQ

SEQ ID NO: 9925 - protein, 11 aa, Artificial Sequence
  Synthetic Construct
AQTARTLNMAQ

SEQ ID NO: 9926 - protein, 11 aa, Artificial Sequence
  Synthetic Construct
AQASVQGHSAQ

SEQ ID NO: 9927 - protein, 11 aa, Artificial Sequence
  Synthetic Construct
AQLNNAGRAAQ

SEQ ID NO: 9928 - protein, 11 aa, Artificial Sequence
  Synthetic Construct
AQGLRGSHAAQ

SEQ ID NO: 9929 - protein, 11 aa, Artificial Sequence
  Synthetic Construct
AQFVRDSYSAQ

SEQ ID NO: 9930 - protein, 11 aa, Artificial Sequence
  Synthetic Construct
AQGRFTGTEAQ

SEQ ID NO: 9931 - protein, 11 aa, Artificial Sequence
  Synthetic Construct
AQRQNPIELAQ

SEQ ID NO: 9932 - protein, 11 aa, Artificial Sequence
  Synthetic Construct
AQVRDKFGTAQ

SEQ ID NO: 9933 - protein, 11 aa, Artificial Sequence
  Synthetic Construct
AQLPSNSNRAQ

SEQ ID NO: 9934 - protein, 11 aa, Artificial Sequence
  Synthetic Construct
AQVRQEHTSAQ

SEQ ID NO: 9935 - protein, 11 aa, Artificial Sequence
  Synthetic Construct
AQIRQGPTNAQ

SEQ ID NO: 9936 - protein, 11 aa, Artificial Sequence
  Synthetic Construct
AQDYSKSNTAQ

SEQ ID NO: 9937 - protein, 11 aa, Artificial Sequence
  Synthetic Construct
AQMSNVNVSAQ

SEQ ID NO: 9938 - protein, 11 aa, Artificial Sequence
  Synthetic Construct
AQMSSGRSLAQ

SEQ ID NO: 9939 - protein, 11 aa, Artificial Sequence
  Synthetic Construct
AQGLRDIRAAQ

SEQ ID NO: 9940 - protein, 11 aa, Artificial Sequence
  Synthetic Construct
AQLISAHKGAQ

SEQ ID NO: 9941 - protein, 11 aa, Artificial Sequence
  Synthetic Construct
AQPINTHAAAQ

SEQ ID NO: 9942 - protein, 11 aa, Artificial Sequence
  Synthetic Construct
AQMPHVGNAAQ

SEQ ID NO: 9943 - protein, 11 aa, Artificial Sequence
  Synthetic Construct
AQYGSSAINAQ

SEQ ID NO: 9944 - protein, 11 aa, Artificial Sequence
  Synthetic Construct
AQHASMPSSAQ

SEQ ID NO: 9945 - protein, 11 aa, Artificial Sequence
  Synthetic Construct
AQFGENARFAQ

SEQ ID NO: 9946 - protein, 11 aa, Artificial Sequence
  Synthetic Construct
AQSRHDLPSAQ

SEQ ID NO: 9947 - protein, 11 aa, Artificial Sequence
  Synthetic Construct
AQRSQGANMAQ

SEQ ID NO: 9948 - protein, 11 aa, Artificial Sequence
  Synthetic Construct
AQANSNSHSAQ

SEQ ID NO: 9949 - protein, 11 aa, Artificial Sequence
  Synthetic Construct
AQQARQNQGAQ

SEQ ID NO: 9950 - protein, 11 aa, Artificial Sequence
  Synthetic Construct
AQGVASNTTAQ

SEQ ID NO: 9951 - protein, 11 aa, Artificial Sequence
  Synthetic Construct
AQKYSSSQSAQ

SEQ ID NO: 9952 - protein, 11 aa, Artificial Sequence
  Synthetic Construct
AQSAKTLNTAQ

SEQ ID NO: 9953 - protein, 11 aa, Artificial Sequence
  Synthetic Construct
AQGIRTTNAAQ

SEQ ID NO: 9954 - protein, 11 aa, Artificial Sequence
  Synthetic Construct
AQMNTTINRAQ

SEQ ID NO: 9955 - protein, 11 aa, Artificial Sequence
  Synthetic Construct
AQLKNTSLPAQ

SEQ ID NO: 9956 - protein, 11 aa, Artificial Sequence
  Synthetic Construct
AQTNRAATMAQ

SEQ ID NO: 9957 - protein, 11 aa, Artificial Sequence
  Synthetic Construct
AQHGYPNVPAQ

SEQ ID NO: 9958 - protein, 11 aa, Artificial Sequence
  Synthetic Construct
AQWGYRGAEAQ

SEQ ID NO: 9959 - protein, 11 aa, Artificial Sequence
  Synthetic Construct
AQLLVTNTSAQ

SEQ ID NO: 9960 - protein, 11 aa, Artificial Sequence
  Synthetic Construct
AQKNRLPPDAQ

SEQ ID NO: 9961 - protein, 11 aa, Artificial Sequence
  Synthetic Construct
AQYRSQEHPAQ

SEQ ID NO: 9962 - protein, 11 aa, Artificial Sequence
  Synthetic Construct
AQHGGRVSPAQ

SEQ ID NO: 9963 - protein, 11 aa, Artificial Sequence
  Synthetic Construct
AQGQNRLASAQ

SEQ ID NO: 9964 - protein, 11 aa, Artificial Sequence
  Synthetic Construct
AQQSVSATRAQ

SEQ ID NO: 9965 - protein, 11 aa, Artificial Sequence
  Synthetic Construct
AQQRPIPQAAQ

SEQ ID NO: 9966 - protein, 11 aa, Artificial Sequence
  Synthetic Construct
AQQRAIGIEAQ

SEQ ID NO: 9967 - protein, 11 aa, Artificial Sequence
  Synthetic Construct
AQFGHVGINAQ

SEQ ID NO: 9968 - protein, 11 aa, Artificial Sequence
  Synthetic Construct
AQFEHVRSEAQ

SEQ ID NO: 9969 - protein, 11 aa, Artificial Sequence
  Synthetic Construct
AQKSVTSNTAQ

SEQ ID NO: 9970 - protein, 11 aa, Artificial Sequence
  Synthetic Construct
AQLTGNVTAAQ

SEQ ID NO: 9971 - protein, 11 aa, Artificial Sequence
  Synthetic Construct
AQNHAYPSAAQ

SEQ ID NO: 9972 - protein, 11 aa, Artificial Sequence
  Synthetic Construct
AQMPQGKSVAQ

SEQ ID NO: 9973 - protein, 11 aa, Artificial Sequence
  Synthetic Construct
AQLRTAATSAQ

SEQ ID NO: 9974 - protein, 11 aa, Artificial Sequence
  Synthetic Construct
AQDSQHRVSAQ

SEQ ID NO: 9975 - protein, 11 aa, Artificial Sequence
  Synthetic Construct
AQFLNEHTVAQ

SEQ ID NO: 9976 - protein, 11 aa, Artificial Sequence
  Synthetic Construct
AQNSTGTSMAQ

SEQ ID NO: 9977 - protein, 11 aa, Artificial Sequence
  Synthetic Construct
AQHSPPMSAAQ

SEQ ID NO: 9978 - protein, 11 aa, Artificial Sequence
  Synthetic Construct
AQLMSQRPTAQ

SEQ ID NO: 9979 - protein, 11 aa, Artificial Sequence
  Synthetic Construct
AQNTNVNPPAQ

SEQ ID NO: 9980 - protein, 11 aa, Artificial Sequence
  Synthetic Construct
AQWGGYSSAAQ

SEQ ID NO: 9981 - protein, 11 aa, Artificial Sequence
  Synthetic Construct
AQYSLNPSGAQ

SEQ ID NO: 9982 - protein, 11 aa, Artificial Sequence
  Synthetic Construct
AQKESKDRVAQ

SEQ ID NO: 9983 - protein, 11 aa, Artificial Sequence
  Synthetic Construct
AQKLVSSPDAQ

SEQ ID NO: 9984 - protein, 11 aa, Artificial Sequence
  Synthetic Construct
AQNTASHNAAQ

SEQ ID NO: 9985 - protein, 11 aa, Artificial Sequence
  Synthetic Construct
AQDMSNKTYAQ

SEQ ID NO: 9986 - protein, 11 aa, Artificial Sequence
  Synthetic Construct
AQLVHKDFPAQ

SEQ ID NO: 9987 - protein, 11 aa, Artificial Sequence
  Synthetic Construct
AQKPALAQNAQ

SEQ ID NO: 9988 - protein, 11 aa, Artificial Sequence
  Synthetic Construct
AQGNAQPSKAQ

SEQ ID NO: 9989 - protein, 11 aa, Artificial Sequence
  Synthetic Construct
AQRVAHTENAQ

SEQ ID NO: 9990 - protein, 11 aa, Artificial Sequence
  Synthetic Construct
AQVSASFMAAQ

SEQ ID NO: 9991 - protein, 11 aa, Artificial Sequence
  Synthetic Construct
AQRVLTADAAQ

SEQ ID NO: 9992 - protein, 11 aa, Artificial Sequence
  Synthetic Construct
AQTVVGTKQAQ

SEQ ID NO: 9993 - protein, 11 aa, Artificial Sequence
  Synthetic Construct
AQLARTQPSAQ

SEQ ID NO: 9994 - protein, 11 aa, Artificial Sequence
  Synthetic Construct
AQMSSSHSAAQ

SEQ ID NO: 9995 - protein, 11 aa, Artificial Sequence
  Synthetic Construct
AQPSSKSPSAQ

SEQ ID NO: 9996 - protein, 11 aa, Artificial Sequence
  Synthetic Construct
AQYSGAMSVAQ

SEQ ID NO: 9997 - protein, 11 aa, Artificial Sequence
  Synthetic Construct
AQPPPTKSYAQ

SEQ ID NO: 9998 - protein, 11 aa, Artificial Sequence
  Synthetic Construct
AQSAPHATTAQ

SEQ ID NO: 9999 - protein, 11 aa, Artificial Sequence
  Synthetic Construct
AQASKPMVAAQ

SEQ ID NO: 10000 - protein, 11 aa, Artificial Sequence
  Synthetic Construct
AQTLTYGDRAQ

SEQ ID NO: 10001 - protein, 11 aa, Artificial Sequence
  Synthetic Construct
AQARSDSKDAQ

SEQ ID NO: 10002 - protein, 11 aa, Artificial Sequence
  Synthetic Construct
AQMSKAASLAQ

SEQ ID NO: 10003 - protein, 11 aa, Artificial Sequence
  Synthetic Construct
AQSTHTSAVAQ

SEQ ID NO: 10004 - protein, 11 aa, Artificial Sequence
  Synthetic Construct
AQTARLQDGAQ

SEQ ID NO: 10005 - protein, 11 aa, Artificial Sequence
  Synthetic Construct
AQRPVLGQPAQ

SEQ ID NO: 10006 - protein, 11 aa, Artificial Sequence
  Synthetic Construct
AQASFKTEVAQ

SEQ ID NO: 10007 - protein, 11 aa, Artificial Sequence
  Synthetic Construct
AQVTRTVNAAQ

SEQ ID NO: 10008 - protein, 11 aa, Artificial Sequence
  Synthetic Construct
AQDHARSGGAQ

SEQ ID NO: 10009 - protein, 11 aa, Artificial Sequence
  Synthetic Construct
AQTTHLTVSAQ

SEQ ID NO: 10010 - protein, 11 aa, Artificial Sequence
  Synthetic Construct
AQVPKSNGTAQ

SEQ ID NO: 10011 - protein, 11 aa, Artificial Sequence
  Synthetic Construct
AQRLGVGPEAQ

SEQ ID NO: 10012 - protein, 11 aa, Artificial Sequence
  Synthetic Construct
AQNNRQTSDAQ

SEQ ID NO: 10013 - protein, 11 aa, Artificial Sequence
  Synthetic Construct
AQRFTNNEAAQ

SEQ ID NO: 10014 - protein, 11 aa, Artificial Sequence
  Synthetic Construct
AQSSHQMRGAQ

SEQ ID NO: 10015 - protein, 11 aa, Artificial Sequence
  Synthetic Construct
AQTTMGTMLAQ

SEQ ID NO: 10016 - protein, 11 aa, Artificial Sequence
  Synthetic Construct
AQTNGGVPIAQ

SEQ ID NO: 10017 - protein, 11 aa, Artificial Sequence
  Synthetic Construct
AQKSNEGNGAQ

SEQ ID NO: 10018 - protein, 11 aa, Artificial Sequence
  Synthetic Construct
AQNVAMTTLAQ

SEQ ID NO: 10019 - protein, 11 aa, Artificial Sequence
  Synthetic Construct
AQYSGHTPMAQ

SEQ ID NO: 10020 - protein, 11 aa, Artificial Sequence
  Synthetic Construct
AQGTPNRALAQ

SEQ ID NO: 10021 - protein, 11 aa, Artificial Sequence
  Synthetic Construct
AQRSGPTQPAQ

SEQ ID NO: 10022 - protein, 11 aa, Artificial Sequence
  Synthetic Construct
AQIFNLKQDAQ

SEQ ID NO: 10023 - protein, 11 aa, Artificial Sequence
  Synthetic Construct
AQHAMSLSPAQ

SEQ ID NO: 10024 - protein, 11 aa, Artificial Sequence
  Synthetic Construct
AQSESMLREAQ

SEQ ID NO: 10025 - protein, 11 aa, Artificial Sequence
  Synthetic Construct
AQLPRPPQAAQ

SEQ ID NO: 10026 - protein, 11 aa, Artificial Sequence
  Synthetic Construct
AQLGLGALSAQ

SEQ ID NO: 10027 - protein, 11 aa, Artificial Sequence
  Synthetic Construct
AQIPKSADIAQ

SEQ ID NO: 10028 - protein, 11 aa, Artificial Sequence
  Synthetic Construct
AQAQSLRTMAQ

SEQ ID NO: 10029 - protein, 11 aa, Artificial Sequence
  Synthetic Construct
AQMLTSSLDAQ

SEQ ID NO: 10030 - protein, 11 aa, Artificial Sequence
  Synthetic Construct
AQIYRDNERAQ

SEQ ID NO: 10031 - protein, 11 aa, Artificial Sequence
  Synthetic Construct
AQSPPTMPAAQ

SEQ ID NO: 10032 - protein, 11 aa, Artificial Sequence
  Synthetic Construct
AQPMRSGTPAQ

SEQ ID NO: 10033 - protein, 11 aa, Artificial Sequence
  Synthetic Construct
AQLLSKSSEAQ

SEQ ID NO: 10034 - protein, 11 aa, Artificial Sequence
  Synthetic Construct
AQTANFQERAQ

SEQ ID NO: 10035 - protein, 11 aa, Artificial Sequence
  Synthetic Construct
AQSGNRPVTAQ

SEQ ID NO: 10036 - protein, 11 aa, Artificial Sequence
  Synthetic Construct
AQLNQVDSRAQ

SEQ ID NO: 10037 - protein, 11 aa, Artificial Sequence
  Synthetic Construct
AQITPSSSKAQ

SEQ ID NO: 10038 - protein, 11 aa, Artificial Sequence
  Synthetic Construct
AQDVSLTKAAQ

SEQ ID NO: 10039 - protein, 11 aa, Artificial Sequence
  Synthetic Construct
AQINMRTAVAQ

SEQ ID NO: 10040 - protein, 11 aa, Artificial Sequence
  Synthetic Construct
AQSKNTGSAAQ

SEQ ID NO: 10041 - protein, 11 aa, Artificial Sequence
  Synthetic Construct
AQGSAHQEPAQ

SEQ ID NO: 10042 - protein, 11 aa, Artificial Sequence
  Synthetic Construct
AQSKNALNHAQ

SEQ ID NO: 10043 - protein, 11 aa, Artificial Sequence
  Synthetic Construct
AQGKAVSVSAQ

SEQ ID NO: 10044 - protein, 11 aa, Artificial Sequence
  Synthetic Construct
AQYSGTGTVAQ

SEQ ID NO: 10045 - protein, 11 aa, Artificial Sequence
  Synthetic Construct
AQSIPDRRGAQ

SEQ ID NO: 10046 - protein, 11 aa, Artificial Sequence
  Synthetic Construct
AQNIANLNAAQ

SEQ ID NO: 10047 - protein, 11 aa, Artificial Sequence
  Synthetic Construct
AQSGARELNAQ

SEQ ID NO: 10048 - protein, 11 aa, Artificial Sequence
  Synthetic Construct
AQGHSYTKEAQ

SEQ ID NO: 10049 - protein, 11 aa, Artificial Sequence
  Synthetic Construct
AQTLNSIRAAQ

SEQ ID NO: 10050 - protein, 11 aa, Artificial Sequence
  Synthetic Construct
AQLSLSSIAAQ

SEQ ID NO: 10051 - protein, 11 aa, Artificial Sequence
  Synthetic Construct
AQNVSRVTNAQ

SEQ ID NO: 10052 - protein, 11 aa, Artificial Sequence
  Synthetic Construct
AQYDTTANRAQ

SEQ ID NO: 10053 - protein, 11 aa, Artificial Sequence
  Synthetic Construct
AQIDRLNSSAQ

SEQ ID NO: 10054 - protein, 11 aa, Artificial Sequence
  Synthetic Construct
AQTTTNRISAQ

SEQ ID NO: 10055 - protein, 11 aa, Artificial Sequence
  Synthetic Construct
AQFNTVRDRAQ

SEQ ID NO: 10056 - protein, 11 aa, Artificial Sequence
  Synthetic Construct
AQRTLADELAQ

SEQ ID NO: 10057 - protein, 11 aa, Artificial Sequence
  Synthetic Construct
AQRHTIEQAAQ

SEQ ID NO: 10058 - protein, 11 aa, Artificial Sequence
  Synthetic Construct
AQQTMGSSVAQ

SEQ ID NO: 10059 - protein, 11 aa, Artificial Sequence
  Synthetic Construct
AQLNRPQHSAQ

SEQ ID NO: 10060 - protein, 11 aa, Artificial Sequence
  Synthetic Construct
AQMSVALRGAQ

SEQ ID NO: 10061 - protein, 11 aa, Artificial Sequence
  Synthetic Construct
AQDNLARMGAQ

SEQ ID NO: 10062 - protein, 11 aa, Artificial Sequence
  Synthetic Construct
AQTAHNALLAQ

SEQ ID NO: 10063 - protein, 11 aa, Artificial Sequence
  Synthetic Construct
AQHTDRSGLAQ

SEQ ID NO: 10064 - protein, 11 aa, Artificial Sequence
  Synthetic Construct
AQYVGGIVPAQ

SEQ ID NO: 10065 - protein, 11 aa, Artificial Sequence
  Synthetic Construct
AQKPNQTPNAQ

SEQ ID NO: 10066 - protein, 11 aa, Artificial Sequence
  Synthetic Construct
AQAGSSLLPAQ

SEQ ID NO: 10067 - protein, 11 aa, Artificial Sequence
  Synthetic Construct
AQSNVHDRSAQ

SEQ ID NO: 10068 - protein, 11 aa, Artificial Sequence
  Synthetic Construct
AQVTKLGSPAQ

SEQ ID NO: 10069 - protein, 11 aa, Artificial Sequence
  Synthetic Construct
AQRGVERSSAQ

SEQ ID NO: 10070 - protein, 11 aa, Artificial Sequence
  Synthetic Construct
AQTSLSGSNAQ

SEQ ID NO: 10071 - protein, 11 aa, Artificial Sequence
  Synthetic Construct
AQLSLSTNNAQ

SEQ ID NO: 10072 - protein, 11 aa, Artificial Sequence
  Synthetic Construct
AQLGQITRPAQ

SEQ ID NO: 10073 - protein, 11 aa, Artificial Sequence
  Synthetic Construct
AQNASPGSSAQ

SEQ ID NO: 10074 - protein, 11 aa, Artificial Sequence
  Synthetic Construct
AQMKANSLSAQ

SEQ ID NO: 10075 - protein, 11 aa, Artificial Sequence
  Synthetic Construct
AQHKGMANSAQ

SEQ ID NO: 10076 - protein, 11 aa, Artificial Sequence
  Synthetic Construct
AQGRNNYPDAQ

SEQ ID NO: 10077 - protein, 11 aa, Artificial Sequence
  Synthetic Construct
AQLPDQKWQAQ

SEQ ID NO: 10078 - protein, 11 aa, Artificial Sequence
  Synthetic Construct
AQGVNNRGSAQ

SEQ ID NO: 10079 - protein, 11 aa, Artificial Sequence
  Synthetic Construct
AQNRIGMQPAQ

SEQ ID NO: 10080 - protein, 11 aa, Artificial Sequence
  Synthetic Construct
AQEKVPSLNAQ

SEQ ID NO: 10081 - protein, 11 aa, Artificial Sequence
  Synthetic Construct
AQGRDSSNPAQ

SEQ ID NO: 10082 - protein, 11 aa, Artificial Sequence
  Synthetic Construct
AQTGRPNLMAQ

SEQ ID NO: 10083 - protein, 11 aa, Artificial Sequence
  Synthetic Construct
AQVAGRSPMAQ

SEQ ID NO: 10084 - protein, 11 aa, Artificial Sequence
  Synthetic Construct
AQLPHVSVPAQ

SEQ ID NO: 10085 - protein, 11 aa, Artificial Sequence
  Synthetic Construct
AQLRTGSFAAQ

SEQ ID NO: 10086 - protein, 11 aa, Artificial Sequence
  Synthetic Construct
AQAGVSSGSAQ

SEQ ID NO: 10087 - protein, 11 aa, Artificial Sequence
  Synthetic Construct
AQWRDSGHGAQ

SEQ ID NO: 10088 - protein, 11 aa, Artificial Sequence
  Synthetic Construct
AQSFGNRPVAQ

SEQ ID NO: 10089 - protein, 11 aa, Artificial Sequence
  Synthetic Construct
AQKVSHNGDAQ

SEQ ID NO: 10090 - protein, 11 aa, Artificial Sequence
  Synthetic Construct
AQNTPPYVQAQ

SEQ ID NO: 10091 - protein, 11 aa, Artificial Sequence
  Synthetic Construct
AQKKDNNQPAQ

SEQ ID NO: 10092 - protein, 11 aa, Artificial Sequence
  Synthetic Construct
AQTIKSLPVAQ

SEQ ID NO: 10093 - protein, 11 aa, Artificial Sequence
  Synthetic Construct
AQINAMRSQAQ

SEQ ID NO: 10094 - protein, 11 aa, Artificial Sequence
  Synthetic Construct
AQGNSIAKGAQ

SEQ ID NO: 10095 - protein, 11 aa, Artificial Sequence
  Synthetic Construct
AQVTTPKAFAQ

SEQ ID NO: 10096 - protein, 11 aa, Artificial Sequence
  Synthetic Construct
AQGSVAGSRAQ

SEQ ID NO: 10097 - protein, 11 aa, Artificial Sequence
  Synthetic Construct
AQSANNAPKAQ

SEQ ID NO: 10098 - protein, 11 aa, Artificial Sequence
  Synthetic Construct
AQDRLNPLPAQ

SEQ ID NO: 10099 - protein, 11 aa, Artificial Sequence
  Synthetic Construct
AQRNQPTDVAQ

SEQ ID NO: 10100 - protein, 11 aa, Artificial Sequence
  Synthetic Construct
AQTQVGSGPAQ

SEQ ID NO: 10101 - protein, 11 aa, Artificial Sequence
  Synthetic Construct
AQLSQVSRPAQ

SEQ ID NO: 10102 - protein, 11 aa, Artificial Sequence
  Synthetic Construct
AQNGANLQMAQ

SEQ ID NO: 10103 - protein, 11 aa, Artificial Sequence
  Synthetic Construct
AQMLTTNSVAQ

SEQ ID NO: 10104 - protein, 11 aa, Artificial Sequence
  Synthetic Construct
AQTSTRPSPAQ

SEQ ID NO: 10105 - protein, 11 aa, Artificial Sequence
  Synthetic Construct
AQKYIGSGEAQ

SEQ ID NO: 10106 - protein, 11 aa, Artificial Sequence
  Synthetic Construct
AQNNLTRVTAQ

SEQ ID NO: 10107 - protein, 11 aa, Artificial Sequence
  Synthetic Construct
AQKIETMMPAQ

SEQ ID NO: 10108 - protein, 11 aa, Artificial Sequence
  Synthetic Construct
AQLSHHTRDAQ

SEQ ID NO: 10109 - protein, 11 aa, Artificial Sequence
  Synthetic Construct
AQTRTNPTEAQ

SEQ ID NO: 10110 - protein, 11 aa, Artificial Sequence
  Synthetic Construct
AQSTRNVVGAQ

SEQ ID NO: 10111 - protein, 11 aa, Artificial Sequence
  Synthetic Construct
AQSVDLRKDAQ

SEQ ID NO: 10112 - protein, 11 aa, Artificial Sequence
  Synthetic Construct
AQNAAAPARAQ

SEQ ID NO: 10113 - protein, 11 aa, Artificial Sequence
  Synthetic Construct
AQTQIAISPAQ

SEQ ID NO: 10114 - protein, 11 aa, Artificial Sequence
  Synthetic Construct
AQQKNLSQSAQ

SEQ ID NO: 10115 - protein, 11 aa, Artificial Sequence
  Synthetic Construct
AQTSMGGEPAQ

SEQ ID NO: 10116 - protein, 11 aa, Artificial Sequence
  Synthetic Construct
AQSTSHQNTAQ

SEQ ID NO: 10117 - protein, 11 aa, Artificial Sequence
  Synthetic Construct
AQLRGSMQSAQ

SEQ ID NO: 10118 - protein, 11 aa, Artificial Sequence
  Synthetic Construct
AQVTHQIHNAQ

SEQ ID NO: 10119 - protein, 11 aa, Artificial Sequence
  Synthetic Construct
AQNVRNAPGAQ

SEQ ID NO: 10120 - protein, 11 aa, Artificial Sequence
  Synthetic Construct
AQQSRSAAAAQ

SEQ ID NO: 10121 - protein, 11 aa, Artificial Sequence
  Synthetic Construct
AQHNQAPSGAQ

SEQ ID NO: 10122 - protein, 11 aa, Artificial Sequence
  Synthetic Construct
AQIGSMHHTAQ

SEQ ID NO: 10123 - protein, 11 aa, Artificial Sequence
  Synthetic Construct
AQTNPGPLAAQ

SEQ ID NO: 10124 - protein, 11 aa, Artificial Sequence
  Synthetic Construct
AQNTPHNASAQ

SEQ ID NO: 10125 - protein, 11 aa, Artificial Sequence
  Synthetic Construct
AQRVIGNSSAQ

SEQ ID NO: 10126 - protein, 11 aa, Artificial Sequence
  Synthetic Construct
AQSTGNRSVAQ

SEQ ID NO: 10127 - protein, 11 aa, Artificial Sequence
  Synthetic Construct
AQMNSEVTRAQ

SEQ ID NO: 10128 - protein, 11 aa, Artificial Sequence
  Synthetic Construct
AQQQAKGSTAQ

SEQ ID NO: 10129 - protein, 11 aa, Artificial Sequence
  Synthetic Construct
AQLGIQRGGAQ

SEQ ID NO: 10130 - protein, 11 aa, Artificial Sequence
  Synthetic Construct
AQHVGAATSAQ

SEQ ID NO: 10131 - protein, 11 aa, Artificial Sequence
  Synthetic Construct
AQKWNSTMEAQ

SEQ ID NO: 10132 - protein, 11 aa, Artificial Sequence
  Synthetic Construct
AQSRVPESNAQ

SEQ ID NO: 10133 - protein, 11 aa, Artificial Sequence
  Synthetic Construct
AQLMAKSMSAQ

SEQ ID NO: 10134 - protein, 11 aa, Artificial Sequence
  Synthetic Construct
AQRPMEPSIAQ

SEQ ID NO: 10135 - protein, 11 aa, Artificial Sequence
  Synthetic Construct
AQQVTSSRPAQ

SEQ ID NO: 10136 - protein, 11 aa, Artificial Sequence
  Synthetic Construct
AQRDANMSSAQ

SEQ ID NO: 10137 - protein, 11 aa, Artificial Sequence
  Synthetic Construct
AQGLLSQDGAQ

SEQ ID NO: 10138 - protein, 11 aa, Artificial Sequence
  Synthetic Construct
AQTINAHSIAQ

SEQ ID NO: 10139 - protein, 11 aa, Artificial Sequence
  Synthetic Construct
AQLTGNKPQAQ

SEQ ID NO: 10140 - protein, 11 aa, Artificial Sequence
  Synthetic Construct
AQTFDTNKTAQ

SEQ ID NO: 10141 - protein, 11 aa, Artificial Sequence
  Synthetic Construct
AQTLQTTRLAQ

SEQ ID NO: 10142 - protein, 11 aa, Artificial Sequence
  Synthetic Construct
AQTSQMRSPAQ

SEQ ID NO: 10143 - protein, 11 aa, Artificial Sequence
  Synthetic Construct
AQVSPSNKAAQ

SEQ ID NO: 10144 - protein, 11 aa, Artificial Sequence
  Synthetic Construct
AQLNRTYPPAQ

SEQ ID NO: 10145 - protein, 11 aa, Artificial Sequence
  Synthetic Construct
AQNAELAVRAQ

SEQ ID NO: 10146 - protein, 11 aa, Artificial Sequence
  Synthetic Construct
AQRPNTTTDAQ

SEQ ID NO: 10147 - protein, 11 aa, Artificial Sequence
  Synthetic Construct
AQTNRTQLYAQ

SEQ ID NO: 10148 - protein, 11 aa, Artificial Sequence
  Synthetic Construct
AQPKSSGINAQ

SEQ ID NO: 10149 - protein, 11 aa, Artificial Sequence
  Synthetic Construct
AQNNSNTRQAQ

SEQ ID NO: 10150 - protein, 11 aa, Artificial Sequence
  Synthetic Construct
AQRVTDAGSAQ

SEQ ID NO: 10151 - protein, 11 aa, Artificial Sequence
  Synthetic Construct
AQDTPTTRTAQ

SEQ ID NO: 10152 - protein, 11 aa, Artificial Sequence
  Synthetic Construct
AQNLNLSMSAQ

SEQ ID NO: 10153 - protein, 11 aa, Artificial Sequence
  Synthetic Construct
AQPNRTANNAQ

SEQ ID NO: 10154 - protein, 11 aa, Artificial Sequence
  Synthetic Construct
AQWNRTSTAAQ

SEQ ID NO: 10155 - protein, 11 aa, Artificial Sequence
  Synthetic Construct
AQQSNPVIPAQ

SEQ ID NO: 10156 - protein, 11 aa, Artificial Sequence
  Synthetic Construct
AQIRNVTSDAQ

SEQ ID NO: 10157 - protein, 11 aa, Artificial Sequence
  Synthetic Construct
AQEVTDTTRAQ

SEQ ID NO: 10158 - protein, 11 aa, Artificial Sequence
  Synthetic Construct
AQAQNKSGPAQ

SEQ ID NO: 10159 - protein, 11 aa, Artificial Sequence
  Synthetic Construct
AQYINQTESAQ

SEQ ID NO: 10160 - protein, 11 aa, Artificial Sequence
  Synthetic Construct
AQRVPVSENAQ

SEQ ID NO: 10161 - protein, 11 aa, Artificial Sequence
  Synthetic Construct
AQQNGTKLQAQ

SEQ ID NO: 10162 - protein, 11 aa, Artificial Sequence
  Synthetic Construct
AQGYSNNTAAQ

SEQ ID NO: 10163 - protein, 11 aa, Artificial Sequence
  Synthetic Construct
AQNRGMGNVAQ

SEQ ID NO: 10164 - protein, 11 aa, Artificial Sequence
  Synthetic Construct
AQYMRDPSTAQ

SEQ ID NO: 10165 - protein, 11 aa, Artificial Sequence
  Synthetic Construct
AQSIPSRDVAQ

SEQ ID NO: 10166 - protein, 11 aa, Artificial Sequence
  Synthetic Construct
AQGPVSMNSAQ

SEQ ID NO: 10167 - protein, 11 aa, Artificial Sequence
  Synthetic Construct
AQSEGVTRLAQ

SEQ ID NO: 10168 - protein, 11 aa, Artificial Sequence
  Synthetic Construct
AQSVNAGAMAQ

SEQ ID NO: 10169 - protein, 11 aa, Artificial Sequence
  Synthetic Construct
AQEMTKTIPAQ

SEQ ID NO: 10170 - protein, 11 aa, Artificial Sequence
  Synthetic Construct
AQHASVKMPAQ

SEQ ID NO: 10171 - protein, 11 aa, Artificial Sequence
  Synthetic Construct
AQNNGLKLSAQ

SEQ ID NO: 10172 - protein, 11 aa, Artificial Sequence
  Synthetic Construct
AQPVSHNAGAQ

SEQ ID NO: 10173 - protein, 11 aa, Artificial Sequence
  Synthetic Construct
AQKVAAAAAAQ

SEQ ID NO: 10174 - protein, 11 aa, Artificial Sequence
  Synthetic Construct
AQMANAIRSAQ

SEQ ID NO: 10175 - protein, 11 aa, Artificial Sequence
  Synthetic Construct
AQFGQSTSGAQ

SEQ ID NO: 10176 - protein, 11 aa, Artificial Sequence
  Synthetic Construct
AQTSSTILRAQ

SEQ ID NO: 10177 - protein, 11 aa, Artificial Sequence
  Synthetic Construct
AQNVSRAEHAQ

SEQ ID NO: 10178 - protein, 11 aa, Artificial Sequence
  Synthetic Construct
AQRTAPSTEAQ

SEQ ID NO: 10179 - protein, 11 aa, Artificial Sequence
  Synthetic Construct
AQLARSEHLAQ

SEQ ID NO: 10180 - protein, 11 aa, Artificial Sequence
  Synthetic Construct
AQSTGHPSQAQ

SEQ ID NO: 10181 - protein, 11 aa, Artificial Sequence
  Synthetic Construct
AQSRPDKNLAQ

SEQ ID NO: 10182 - protein, 11 aa, Artificial Sequence
  Synthetic Construct
AQKKSDSPNAQ

SEQ ID NO: 10183 - protein, 11 aa, Artificial Sequence
  Synthetic Construct
AQVNSRIYAAQ

SEQ ID NO: 10184 - protein, 11 aa, Artificial Sequence
  Synthetic Construct
AQLRQMANGAQ

SEQ ID NO: 10185 - protein, 11 aa, Artificial Sequence
  Synthetic Construct
AQERLKGSSAQ

SEQ ID NO: 10186 - protein, 11 aa, Artificial Sequence
  Synthetic Construct
AQMSYMRVDAQ

SEQ ID NO: 10187 - protein, 11 aa, Artificial Sequence
  Synthetic Construct
AQFNSKLQLAQ

SEQ ID NO: 10188 - protein, 11 aa, Artificial Sequence
  Synthetic Construct
AQREHVNDSAQ

SEQ ID NO: 10189 - protein, 11 aa, Artificial Sequence
  Synthetic Construct
AQGSPSQNTAQ

SEQ ID NO: 10190 - protein, 11 aa, Artificial Sequence
  Synthetic Construct
AQHTAEKAPAQ

SEQ ID NO: 10191 - protein, 11 aa, Artificial Sequence
  Synthetic Construct
AQSMSGKLDAQ

SEQ ID NO: 10192 - protein, 11 aa, Artificial Sequence
  Synthetic Construct
AQTSQSRTSAQ

SEQ ID NO: 10193 - protein, 11 aa, Artificial Sequence
  Synthetic Construct
AQWPTQSGSAQ

SEQ ID NO: 10194 - protein, 11 aa, Artificial Sequence
  Synthetic Construct
AQDNTTRLKAQ

SEQ ID NO: 10195 - protein, 11 aa, Artificial Sequence
  Synthetic Construct
AQSSAAGKWAQ

SEQ ID NO: 10196 - protein, 11 aa, Artificial Sequence
  Synthetic Construct
AQSKFAHVAAQ

SEQ ID NO: 10197 - protein, 11 aa, Artificial Sequence
  Synthetic Construct
AQQTYQGSTAQ

SEQ ID NO: 10198 - protein, 11 aa, Artificial Sequence
  Synthetic Construct
AQTVNLNRAAQ

SEQ ID NO: 10199 - protein, 11 aa, Artificial Sequence
  Synthetic Construct
AQRYGSSLPAQ

SEQ ID NO: 10200 - protein, 11 aa, Artificial Sequence
  Synthetic Construct
AQRSNSSNLAQ

SEQ ID NO: 10201 - protein, 11 aa, Artificial Sequence
  Synthetic Construct
AQQGPSIRDAQ

SEQ ID NO: 10202 - protein, 11 aa, Artificial Sequence
  Synthetic Construct
AQWRDLAPVAQ

SEQ ID NO: 10203 - protein, 11 aa, Artificial Sequence
  Synthetic Construct
AQHSDIQRPAQ

SEQ ID NO: 10204 - protein, 11 aa, Artificial Sequence
  Synthetic Construct
AQLAAMTNAAQ

SEQ ID NO: 10205 - protein, 11 aa, Artificial Sequence
  Synthetic Construct
AQSANHTHTAQ

SEQ ID NO: 10206 - protein, 11 aa, Artificial Sequence
  Synthetic Construct
AQGKLSVENAQ

SEQ ID NO: 10207 - protein, 11 aa, Artificial Sequence
  Synthetic Construct
AQKPGANPPAQ

SEQ ID NO: 10208 - protein, 11 aa, Artificial Sequence
  Synthetic Construct
AQLTEGRHDAQ

SEQ ID NO: 10209 - protein, 11 aa, Artificial Sequence
  Synthetic Construct
AQLGSNIYPAQ

SEQ ID NO: 10210 - protein, 11 aa, Artificial Sequence
  Synthetic Construct
AQNGAHSSEAQ

SEQ ID NO: 10211 - protein, 11 aa, Artificial Sequence
  Synthetic Construct
AQNTMGGAAAQ

SEQ ID NO: 10212 - protein, 11 aa, Artificial Sequence
  Synthetic Construct
AQRTPIGQPAQ

SEQ ID NO: 10213 - protein, 11 aa, Artificial Sequence
  Synthetic Construct
AQYSVAQQPAQ

SEQ ID NO: 10214 - protein, 11 aa, Artificial Sequence
  Synthetic Construct
AQPHSKGMLAQ

SEQ ID NO: 10215 - protein, 11 aa, Artificial Sequence
  Synthetic Construct
AQVPAHGMGAQ

SEQ ID NO: 10216 - protein, 11 aa, Artificial Sequence
  Synthetic Construct
AQIGGVPQRAQ

SEQ ID NO: 10217 - protein, 11 aa, Artificial Sequence
  Synthetic Construct
AQVQGTVSRAQ

SEQ ID NO: 10218 - protein, 11 aa, Artificial Sequence
  Synthetic Construct
AQSGGSGAPAQ

SEQ ID NO: 10219 - protein, 11 aa, Artificial Sequence
  Synthetic Construct
AQKVPTQTEAQ

SEQ ID NO: 10220 - protein, 11 aa, Artificial Sequence
  Synthetic Construct
AQISTMKPSAQ

SEQ ID NO: 10221 - protein, 11 aa, Artificial Sequence
  Synthetic Construct
AQSRVVEQAAQ

SEQ ID NO: 10222 - protein, 11 aa, Artificial Sequence
  Synthetic Construct
AQVLSRQSTAQ

SEQ ID NO: 10223 - protein, 11 aa, Artificial Sequence
  Synthetic Construct
AQVVTTSSMAQ

SEQ ID NO: 10224 - protein, 11 aa, Artificial Sequence
  Synthetic Construct
AQSTGSSGLAQ

SEQ ID NO: 10225 - protein, 11 aa, Artificial Sequence
  Synthetic Construct
AQPNRAANNAQ

SEQ ID NO: 10226 - protein, 11 aa, Artificial Sequence
  Synthetic Construct
AQYPVNSQPAQ

SEQ ID NO: 10227 - protein, 11 aa, Artificial Sequence
  Synthetic Construct
AQKSASPYDAQ

SEQ ID NO: 10228 - protein, 11 aa, Artificial Sequence
  Synthetic Construct
AQSKSWGAAAQ

SEQ ID NO: 10229 - protein, 11 aa, Artificial Sequence
  Synthetic Construct
AQSAMLKVDAQ

SEQ ID NO: 10230 - protein, 11 aa, Artificial Sequence
  Synthetic Construct
AQRSQTIQAAQ

SEQ ID NO: 10231 - protein, 11 aa, Artificial Sequence
  Synthetic Construct
AQPSSRLGDAQ

SEQ ID NO: 10232 - protein, 11 aa, Artificial Sequence
  Synthetic Construct
AQIGPRGTQAQ

SEQ ID NO: 10233 - protein, 11 aa, Artificial Sequence
  Synthetic Construct
AQASKGQYLAQ

SEQ ID NO: 10234 - protein, 11 aa, Artificial Sequence
  Synthetic Construct
AQVRTLTVDAQ

SEQ ID NO: 10235 - protein, 11 aa, Artificial Sequence
  Synthetic Construct
AQRGNAANEAQ

SEQ ID NO: 10236 - protein, 11 aa, Artificial Sequence
  Synthetic Construct
AQFGSHPSVAQ

SEQ ID NO: 10237 - protein, 11 aa, Artificial Sequence
  Synthetic Construct
AQGHPTPVNAQ

SEQ ID NO: 10238 - protein, 11 aa, Artificial Sequence
  Synthetic Construct
AQSLNPVRMAQ

SEQ ID NO: 10239 - protein, 11 aa, Artificial Sequence
  Synthetic Construct
AQSIRGQPFAQ

SEQ ID NO: 10240 - protein, 11 aa, Artificial Sequence
  Synthetic Construct
AQTAKFNQGAQ

SEQ ID NO: 10241 - protein, 11 aa, Artificial Sequence
  Synthetic Construct
AQLISTHDMAQ

SEQ ID NO: 10242 - protein, 11 aa, Artificial Sequence
  Synthetic Construct
AQQSRDNIRAQ

SEQ ID NO: 10243 - protein, 11 aa, Artificial Sequence
  Synthetic Construct
AQNNGNKGFAQ

SEQ ID NO: 10244 - protein, 11 aa, Artificial Sequence
  Synthetic Construct
AQNVNYDGRAQ

SEQ ID NO: 10245 - protein, 11 aa, Artificial Sequence
  Synthetic Construct
AQFMKGASAAQ

SEQ ID NO: 10246 - protein, 11 aa, Artificial Sequence
  Synthetic Construct
AQLATSTQMAQ

SEQ ID NO: 10247 - protein, 11 aa, Artificial Sequence
  Synthetic Construct
AQVHGGYSAAQ

SEQ ID NO: 10248 - protein, 11 aa, Artificial Sequence
  Synthetic Construct
AQRGSEPMQAQ

SEQ ID NO: 10249 - protein, 11 aa, Artificial Sequence
  Synthetic Construct
AQGLRTSGTAQ

SEQ ID NO: 10250 - protein, 11 aa, Artificial Sequence
  Synthetic Construct
AQLYKGGVSAQ

SEQ ID NO: 10251 - protein, 11 aa, Artificial Sequence
  Synthetic Construct
AQMKTHSPPAQ

SEQ ID NO: 10252 - protein, 7 aa, Artificial Sequence
  Synthetic Construct
TLQIPFK

SEQ ID NO: 10253 - protein, 7 aa, Artificial Sequence
  Synthetic Construct
TALKPFL

SEQ ID NO: 10254 - protein, 7 aa, Artificial Sequence
  Synthetic Construct
TTLKPFL

SEQ ID NO: 10255 - protein, 7 aa, Artificial Sequence
  Synthetic Construct
SIERPFK

SEQ ID NO: 10256 - protein, 7 aa, Artificial Sequence
  Synthetic Construct
TQNRPFL

SEQ ID NO: 10257 - protein, 7 aa, Artificial Sequence
  Synthetic Construct
TMQKPFI

SEQ ID NO: 10258 - protein, 7 aa, Artificial Sequence
  Synthetic Construct
TSTRPFL

SEQ ID NO: 10259 - protein, 7 aa, Artificial Sequence
  Synthetic Construct
GTFVPPT

SEQ ID NO: 10260 - protein, 7 aa, Artificial Sequence
  Synthetic Construct
WSTNAGY

SEQ ID NO: 10261 - protein, 7 aa, Artificial Sequence
  Synthetic Construct
TLERPFT

SEQ ID NO: 10262 - protein, 7 aa, Artificial Sequence
  Synthetic Construct
TAAKPFL

SEQ ID NO: 10263 - protein, 7 aa, Artificial Sequence
  Synthetic Construct
IRIGYSQ

SEQ ID NO: 10264 - protein, 7 aa, Artificial Sequence
  Synthetic Construct
ERVGFAQ

SEQ ID NO: 10265 - protein, 7 aa, Artificial Sequence
  Synthetic Construct
ADLLNYR

SEQ ID NO: 10266 - protein, 7 aa, Artificial Sequence
  Synthetic Construct
LVAGFSQ

SEQ ID NO: 10267 - protein, 7 aa, Artificial Sequence
  Synthetic Construct
SSLKPFL

SEQ ID NO: 10268 - protein, 7 aa, Artificial Sequence
  Synthetic Construct
THSRPFI

SEQ ID NO: 10269 - protein, 7 aa, Artificial Sequence
  Synthetic Construct
PFPGYSA

SEQ ID NO: 10270 - protein, 7 aa, Artificial Sequence
  Synthetic Construct
IIVGYSQ

SEQ ID NO: 10271 - protein, 7 aa, Artificial Sequence
  Synthetic Construct
RYQGDSV

SEQ ID NO: 10272 - protein, 7 aa, Artificial Sequence
  Synthetic Construct
RYAGDSI

SEQ ID NO: 10273 - protein, 7 aa, Artificial Sequence
  Synthetic Construct
KTIGEHW

SEQ ID NO: 10274 - protein, 7 aa, Artificial Sequence
  Synthetic Construct
WMTHGSA

SEQ ID NO: 10275 - protein, 7 aa, Artificial Sequence
  Synthetic Construct
AASRPFL

SEQ ID NO: 10276 - protein, 7 aa, Artificial Sequence
  Synthetic Construct
TTSRPFL

SEQ ID NO: 10277 - protein, 7 aa, Artificial Sequence
  Synthetic Construct
ARVGLAQ

SEQ ID NO: 10278 - protein, 7 aa, Artificial Sequence
  Synthetic Construct
GTSPNLA

SEQ ID NO: 10279 - protein, 7 aa, Artificial Sequence
  Synthetic Construct
VRTGYSS

SEQ ID NO: 10280 - protein, 7 aa, Artificial Sequence
  Synthetic Construct
IRVGYSS

SEQ ID NO: 10281 - protein, 7 aa, Artificial Sequence
  Synthetic Construct
TTLRPFI

SEQ ID NO: 10282 - protein, 7 aa, Artificial Sequence
  Synthetic Construct
GITSLFK

SEQ ID NO: 10283 - protein, 7 aa, Artificial Sequence
  Synthetic Construct
TTQTPFR

SEQ ID NO: 10284 - protein, 7 aa, Artificial Sequence
  Synthetic Construct
TVSRPFL

SEQ ID NO: 10285 - protein, 7 aa, Artificial Sequence
  Synthetic Construct
YGTNPFR

SEQ ID NO: 10286 - protein, 7 aa, Artificial Sequence
  Synthetic Construct
PTMVDSS

SEQ ID NO: 10287 - protein, 7 aa, Artificial Sequence
  Synthetic Construct
NKASSQN

SEQ ID NO: 10288 - protein, 7 aa, Artificial Sequence
  Synthetic Construct
TFRSSND

SEQ ID NO: 10289 - protein, 7 aa, Artificial Sequence
  Synthetic Construct
LPDRYPN

SEQ ID NO: 10290 - protein, 7 aa, Artificial Sequence
  Synthetic Construct
QNVTKGV

SEQ ID NO: 10291 - protein, 7 aa, Artificial Sequence
  Synthetic Construct
AQSPILR

SEQ ID NO: 10292 - protein, 7 aa, Artificial Sequence
  Synthetic Construct
VATGYSS

SEQ ID NO: 10293 - protein, 7 aa, Artificial Sequence
  Synthetic Construct
LNSNRPN

SEQ ID NO: 10294 - protein, 7 aa, Artificial Sequence
  Synthetic Construct
TIRNNTI

SEQ ID NO: 10295 - protein, 7 aa, Artificial Sequence
  Synthetic Construct
DLSRIFK

SEQ ID NO: 10296 - protein, 7 aa, Artificial Sequence
  Synthetic Construct
LSNSASQ

SEQ ID NO: 10297 - protein, 7 aa, Artificial Sequence
  Synthetic Construct
LENMVMS

SEQ ID NO: 10298 - protein, 7 aa, Artificial Sequence
  Synthetic Construct
LTQQTDV

SEQ ID NO: 10299 - protein, 7 aa, Artificial Sequence
  Synthetic Construct
AGLAHAT

SEQ ID NO: 10300 - protein, 7 aa, Artificial Sequence
  Synthetic Construct
NAHTALD

SEQ ID NO: 10301 - protein, 7 aa, Artificial Sequence
  Synthetic Construct
WPILRAD

SEQ ID NO: 10302 - protein, 7 aa, Artificial Sequence
  Synthetic Construct
ALAGLSL

SEQ ID NO: 10303 - protein, 7 aa, Artificial Sequence
  Synthetic Construct
RIDMPFK

SEQ ID NO: 10304 - protein, 7 aa, Artificial Sequence
  Synthetic Construct
TMSLSSS

SEQ ID NO: 10305 - protein, 7 aa, Artificial Sequence
  Synthetic Construct
QNVAKNL

SEQ ID NO: 10306 - protein, 7 aa, Artificial Sequence
  Synthetic Construct
FDNPNNV

SEQ ID NO: 10307 - protein, 7 aa, Artificial Sequence
  Synthetic Construct
VLMRESL

SEQ ID NO: 10308 - protein, 7 aa, Artificial Sequence
  Synthetic Construct
HHDTGSA

SEQ ID NO: 10309 - protein, 7 aa, Artificial Sequence
  Synthetic Construct
DAPNSVD

SEQ ID NO: 10310 - protein, 7 aa, Artificial Sequence
  Synthetic Construct
TASRDAK

SEQ ID NO: 10311 - protein, 7 aa, Artificial Sequence
  Synthetic Construct
TNYTKQI

SEQ ID NO: 10312 - protein, 7 aa, Artificial Sequence
  Synthetic Construct
PHNASVL

SEQ ID NO: 10313 - protein, 7 aa, Artificial Sequence
  Synthetic Construct
TNNTRNI

SEQ ID NO: 10314 - protein, 7 aa, Artificial Sequence
  Synthetic Construct
MVPNHSG

SEQ ID NO: 10315 - protein, 7 aa, Artificial Sequence
  Synthetic Construct
PVPQSEH

SEQ ID NO: 10316 - protein, 7 aa, Artificial Sequence
  Synthetic Construct
LYHGGST

SEQ ID NO: 10317 - protein, 7 aa, Artificial Sequence
  Synthetic Construct
MIHTRET

SEQ ID NO: 10318 - protein, 7 aa, Artificial Sequence
  Synthetic Construct
TNNTKPL

SEQ ID NO: 10319 - protein, 7 aa, Artificial Sequence
  Synthetic Construct
LNTTRNT

SEQ ID NO: 10320 - protein, 7 aa, Artificial Sequence
  Synthetic Construct
ALHNSQN

SEQ ID NO: 10321 - protein, 7 aa, Artificial Sequence
  Synthetic Construct
VNSTRNV

SEQ ID NO: 10322 - protein, 7 aa, Artificial Sequence
  Synthetic Construct
GVGVVTK

SEQ ID NO: 10323 - protein, 7 aa, Artificial Sequence
  Synthetic Construct
VLSKQLA

SEQ ID NO: 10324 - protein, 7 aa, Artificial Sequence
  Synthetic Construct
SKSLQPL

SEQ ID NO: 10325 - protein, 7 aa, Artificial Sequence
  Synthetic Construct
SNSTRLV

SEQ ID NO: 10326 - protein, 7 aa, Artificial Sequence
  Synthetic Construct
LNQTKQI

SEQ ID NO: 10327 - protein, 7 aa, Artificial Sequence
  Synthetic Construct
NNSVRQL

SEQ ID NO: 10328 - protein, 7 aa, Artificial Sequence
  Synthetic Construct
MSGYSHT

SEQ ID NO: 10329 - protein, 7 aa, Artificial Sequence
  Synthetic Construct
VKVPIIT

SEQ ID NO: 10330 - protein, 7 aa, Artificial Sequence
  Synthetic Construct
GNNTRAV

SEQ ID NO: 10331 - protein, 7 aa, Artificial Sequence
  Synthetic Construct
QNQIKNI

SEQ ID NO: 10332 - protein, 7 aa, Artificial Sequence
  Synthetic Construct
TNMTKPL

SEQ ID NO: 10333 - protein, 7 aa, Artificial Sequence
  Synthetic Construct
NNSTRLS

SEQ ID NO: 10334 - protein, 7 aa, Artificial Sequence
  Synthetic Construct
SMLTSIV

SEQ ID NO: 10335 - protein, 7 aa, Artificial Sequence
  Synthetic Construct
LNATASR

SEQ ID NO: 10336 - protein, 7 aa, Artificial Sequence
  Synthetic Construct
NTGVQVR

SEQ ID NO: 10337 - protein, 7 aa, Artificial Sequence
  Synthetic Construct
TNTVRPI

SEQ ID NO: 10338 - protein, 7 aa, Artificial Sequence
  Synthetic Construct
QSTPGAT

SEQ ID NO: 10339 - protein, 7 aa, Artificial Sequence
  Synthetic Construct
GHSENSR

SEQ ID NO: 10340 - protein, 7 aa, Artificial Sequence
  Synthetic Construct
LPTQTLR

SEQ ID NO: 10341 - protein, 7 aa, Artificial Sequence
  Synthetic Construct
KNAPMPD

SEQ ID NO: 10342 - protein, 7 aa, Artificial Sequence
  Synthetic Construct
SNSTKPT

SEQ ID NO: 10343 - protein, 7 aa, Artificial Sequence
  Synthetic Construct
PIITMPA

SEQ ID NO: 10344 - protein, 7 aa, Artificial Sequence
  Synthetic Construct
PLKGIGS

SEQ ID NO: 10345 - protein, 7 aa, Artificial Sequence
  Synthetic Construct
VLSVNHL

SEQ ID NO: 10346 - protein, 7 aa, Artificial Sequence
  Synthetic Construct
SVAAVHM

SEQ ID NO: 10347 - protein, 7 aa, Artificial Sequence
  Synthetic Construct
SNSIRLV

SEQ ID NO: 10348 - protein, 7 aa, Artificial Sequence
  Synthetic Construct
HNDTRPL

SEQ ID NO: 10349 - protein, 7 aa, Artificial Sequence
  Synthetic Construct
PPVRSTA

SEQ ID NO: 10350 - protein, 7 aa, Artificial Sequence
  Synthetic Construct
MNTVRNL

SEQ ID NO: 10351 - protein, 7 aa, Artificial Sequence
  Synthetic Construct
LTDGHRI

SEQ ID NO: 10352 - protein, 7 aa, Artificial Sequence
  Synthetic Construct
TNAVKLT

SEQ ID NO: 10353 - protein, 7 aa, Artificial Sequence
  Synthetic Construct
RVDAVLS

SEQ ID NO: 10354 - protein, 7 aa, Artificial Sequence
  Synthetic Construct
TNAVKST

SEQ ID NO: 10355 - protein, 7 aa, Artificial Sequence
  Synthetic Construct
MLNTTAR

SEQ ID NO: 10356 - protein, 7 aa, Artificial Sequence
  Synthetic Construct
GNNTRPT

SEQ ID NO: 10357 - protein, 7 aa, Artificial Sequence
  Synthetic Construct
QSGGSAL

SEQ ID NO: 10358 - protein, 7 aa, Artificial Sequence
  Synthetic Construct
VIALSTM

SEQ ID NO: 10359 - protein, 7 aa, Artificial Sequence
  Synthetic Construct
LNTIRNV

SEQ ID NO: 10360 - protein, 7 aa, Artificial Sequence
  Synthetic Construct
SNATRSV

SEQ ID NO: 10361 - protein, 7 aa, Artificial Sequence
  Synthetic Construct
GNGTKFI

SEQ ID NO: 10362 - protein, 7 aa, Artificial Sequence
  Synthetic Construct
SNTIRPV

SEQ ID NO: 10363 - protein, 7 aa, Artificial Sequence
  Synthetic Construct
SNSTRAI

SEQ ID NO: 10364 - protein, 7 aa, Artificial Sequence
  Synthetic Construct
FHLTDRG

SEQ ID NO: 10365 - protein, 7 aa, Artificial Sequence
  Synthetic Construct
PIRSDTV

SEQ ID NO: 10366 - protein, 7 aa, Artificial Sequence
  Synthetic Construct
ANQIHNT

SEQ ID NO: 10367 - protein, 7 aa, Artificial Sequence
  Synthetic Construct
SNTVRNT

SEQ ID NO: 10368 - protein, 7 aa, Artificial Sequence
  Synthetic Construct
TSLGYSS

SEQ ID NO: 10369 - protein, 7 aa, Artificial Sequence
  Synthetic Construct
ISGVQTR

SEQ ID NO: 10370 - protein, 7 aa, Artificial Sequence
  Synthetic Construct
SNAVRQT

SEQ ID NO: 10371 - protein, 7 aa, Artificial Sequence
  Synthetic Construct
SLSELRI

SEQ ID NO: 10372 - protein, 7 aa, Artificial Sequence
  Synthetic Construct
STEKRDE

SEQ ID NO: 10373 - protein, 7 aa, Artificial Sequence
  Synthetic Construct
NLVGTLI

SEQ ID NO: 10374 - protein, 7 aa, Artificial Sequence
  Synthetic Construct
GNNIRLT

SEQ ID NO: 10375 - protein, 7 aa, Artificial Sequence
  Synthetic Construct
AVPTGLR

SEQ ID NO: 10376 - protein, 7 aa, Artificial Sequence
  Synthetic Construct
GDNSLTR

SEQ ID NO: 10377 - protein, 7 aa, Artificial Sequence
  Synthetic Construct
HADNRLK

SEQ ID NO: 10378 - protein, 7 aa, Artificial Sequence
  Synthetic Construct
SNATRNF

SEQ ID NO: 10379 - protein, 7 aa, Artificial Sequence
  Synthetic Construct
GNTTRGL

SEQ ID NO: 10380 - protein, 7 aa, Artificial Sequence
  Synthetic Construct
LNLTATN

SEQ ID NO: 10381 - protein, 7 aa, Artificial Sequence
  Synthetic Construct
SGVSTTD

SEQ ID NO: 10382 - protein, 7 aa, Artificial Sequence
  Synthetic Construct
YAKTLAM

SEQ ID NO: 10383 - protein, 7 aa, Artificial Sequence
  Synthetic Construct
MNHTKPT

SEQ ID NO: 10384 - protein, 7 aa, Artificial Sequence
  Synthetic Construct
ANATRNS

SEQ ID NO: 10385 - protein, 7 aa, Artificial Sequence
  Synthetic Construct
QNQTKIT

SEQ ID NO: 10386 - protein, 7 aa, Artificial Sequence
  Synthetic Construct
SNAIKAT

SEQ ID NO: 10387 - protein, 7 aa, Artificial Sequence
  Synthetic Construct
YPDNYGK

SEQ ID NO: 10388 - protein, 7 aa, Artificial Sequence
  Synthetic Construct
GNTTIRS

SEQ ID NO: 10389 - protein, 7 aa, Artificial Sequence
  Synthetic Construct
LGLTGAV

SEQ ID NO: 10390 - protein, 7 aa, Artificial Sequence
  Synthetic Construct
ANSTRIL

SEQ ID NO: 10391 - protein, 7 aa, Artificial Sequence
  Synthetic Construct
DNAIRAQ

SEQ ID NO: 10392 - protein, 7 aa, Artificial Sequence
  Synthetic Construct
TNYTKLM

SEQ ID NO: 10393 - protein, 7 aa, Artificial Sequence
  Synthetic Construct
HNSPSSY

SEQ ID NO: 10394 - protein, 7 aa, Artificial Sequence
  Synthetic Construct
ENMVRSV

SEQ ID NO: 10395 - protein, 7 aa, Artificial Sequence
  Synthetic Construct
TNNIKSY

SEQ ID NO: 10396 - protein, 7 aa, Artificial Sequence
  Synthetic Construct
TNSTRPV

SEQ ID NO: 10397 - protein, 7 aa, Artificial Sequence
  Synthetic Construct
HTAPPHP

SEQ ID NO: 10398 - protein, 7 aa, Artificial Sequence
  Synthetic Construct
ALSQNTS

SEQ ID NO: 10399 - protein, 7 aa, Artificial Sequence
  Synthetic Construct
PNVTKNA

SEQ ID NO: 10400 - protein, 7 aa, Artificial Sequence
  Synthetic Construct
LDTLTGY

SEQ ID NO: 10401 - protein, 7 aa, Artificial Sequence
  Synthetic Construct
PNSVRSV

SEQ ID NO: 10402 - protein, 7 aa, Artificial Sequence
  Synthetic Construct
TSSHLPH

SEQ ID NO: 10403 - protein, 7 aa, Artificial Sequence
  Synthetic Construct
VLHGGND

SEQ ID NO: 10404 - protein, 7 aa, Artificial Sequence
  Synthetic Construct
SNYVKSA

SEQ ID NO: 10405 - protein, 7 aa, Artificial Sequence
  Synthetic Construct
DNNSTRW

SEQ ID NO: 10406 - protein, 7 aa, Artificial Sequence
  Synthetic Construct
TVMKGFT

SEQ ID NO: 10407 - protein, 7 aa, Artificial Sequence
  Synthetic Construct
SHTLSTL

SEQ ID NO: 10408 - protein, 7 aa, Artificial Sequence
  Synthetic Construct
PGPQQAK

SEQ ID NO: 10409 - protein, 7 aa, Artificial Sequence
  Synthetic Construct
TFGTSKL

SEQ ID NO: 10410 - protein, 7 aa, Artificial Sequence
  Synthetic Construct
SNAVTNR

SEQ ID NO: 10411 - protein, 7 aa, Artificial Sequence
  Synthetic Construct
LSMSTVP

SEQ ID NO: 10412 - protein, 7 aa, Artificial Sequence
  Synthetic Construct
RRYDGRE

SEQ ID NO: 10413 - protein, 7 aa, Artificial Sequence
  Synthetic Construct
TNSTKNI

SEQ ID NO: 10414 - protein, 7 aa, Artificial Sequence
  Synthetic Construct
INAQWSA

SEQ ID NO: 10415 - protein, 7 aa, Artificial Sequence
  Synthetic Construct
AQTSNDP

SEQ ID NO: 10416 - protein, 7 aa, Artificial Sequence
  Synthetic Construct
TNETRMV

SEQ ID NO: 10417 - protein, 7 aa, Artificial Sequence
  Synthetic Construct
ANATRGV

SEQ ID NO: 10418 - protein, 7 aa, Artificial Sequence
  Synthetic Construct
ADVNASG

SEQ ID NO: 10419 - protein, 7 aa, Artificial Sequence
  Synthetic Construct
LSERNYV

SEQ ID NO: 10420 - protein, 7 aa, Artificial Sequence
  Synthetic Construct
SGELARA

SEQ ID NO: 10421 - protein, 7 aa, Artificial Sequence
  Synthetic Construct
GNTAKNI

SEQ ID NO: 10422 - protein, 7 aa, Artificial Sequence
  Synthetic Construct
DNAVRPL

SEQ ID NO: 10423 - protein, 7 aa, Artificial Sequence
  Synthetic Construct
MMLSGLN

SEQ ID NO: 10424 - protein, 7 aa, Artificial Sequence
  Synthetic Construct
PNTIRNV

SEQ ID NO: 10425 - protein, 7 aa, Artificial Sequence
  Synthetic Construct
ENLTRGV

SEQ ID NO: 10426 - protein, 7 aa, Artificial Sequence
  Synthetic Construct
FSARSTG

SEQ ID NO: 10427 - protein, 7 aa, Artificial Sequence
  Synthetic Construct
ENATRTY

SEQ ID NO: 10428 - protein, 7 aa, Artificial Sequence
  Synthetic Construct
GNSTRMN

SEQ ID NO: 10429 - protein, 7 aa, Artificial Sequence
  Synthetic Construct
GNSTKSP

SEQ ID NO: 10430 - protein, 7 aa, Artificial Sequence
  Synthetic Construct
MQTTLHL

SEQ ID NO: 10431 - protein, 7 aa, Artificial Sequence
  Synthetic Construct
NPTLITL

SEQ ID NO: 10432 - protein, 7 aa, Artificial Sequence
  Synthetic Construct
LISGHAQ

SEQ ID NO: 10433 - protein, 7 aa, Artificial Sequence
  Synthetic Construct
FNQVRSL

SEQ ID NO: 10434 - protein, 7 aa, Artificial Sequence
  Synthetic Construct
MNILREV

SEQ ID NO: 10435 - protein, 7 aa, Artificial Sequence
  Synthetic Construct
SAMMRGV

SEQ ID NO: 10436 - protein, 7 aa, Artificial Sequence
  Synthetic Construct
PMLSSPS

SEQ ID NO: 10437 - protein, 7 aa, Artificial Sequence
  Synthetic Construct
QNNTLRS

SEQ ID NO: 10438 - protein, 7 aa, Artificial Sequence
  Synthetic Construct
RHSDPVE

SEQ ID NO: 10439 - protein, 7 aa, Artificial Sequence
  Synthetic Construct
VNTTFST

SEQ ID NO: 10440 - protein, 7 aa, Artificial Sequence
  Synthetic Construct
INSTRGI

SEQ ID NO: 10441 - protein, 7 aa, Artificial Sequence
  Synthetic Construct
TNAVRDL

SEQ ID NO: 10442 - protein, 7 aa, Artificial Sequence
  Synthetic Construct
SNSTRLS

SEQ ID NO: 10443 - protein, 7 aa, Artificial Sequence
  Synthetic Construct
TSIAGSF

SEQ ID NO: 10444 - protein, 7 aa, Artificial Sequence
  Synthetic Construct
LGSTYPR

SEQ ID NO: 10445 - protein, 7 aa, Artificial Sequence
  Synthetic Construct
ANVTTQR

SEQ ID NO: 10446 - protein, 7 aa, Artificial Sequence
  Synthetic Construct
SNSVRLS

SEQ ID NO: 10447 - protein, 7 aa, Artificial Sequence
  Synthetic Construct
ATNEPDR

SEQ ID NO: 10448 - protein, 7 aa, Artificial Sequence
  Synthetic Construct
RMNPEQS

SEQ ID NO: 10449 - protein, 7 aa, Artificial Sequence
  Synthetic Construct
SVSGSAN

SEQ ID NO: 10450 - protein, 7 aa, Artificial Sequence
  Synthetic Construct
PSNSTTR

SEQ ID NO: 10451 - protein, 7 aa, Artificial Sequence
  Synthetic Construct
LFHGTHE

SEQ ID NO: 10452 - protein, 7 aa, Artificial Sequence
  Synthetic Construct
PQLGSTK

SEQ ID NO: 10453 - protein, 7 aa, Artificial Sequence
  Synthetic Construct
PISANRL

SEQ ID NO: 10454 - protein, 7 aa, Artificial Sequence
  Synthetic Construct
NSGNLSM

SEQ ID NO: 10455 - protein, 7 aa, Artificial Sequence
  Synthetic Construct
KVEAIGM

SEQ ID NO: 10456 - protein, 7 aa, Artificial Sequence
  Synthetic Construct
KTLLNSV

SEQ ID NO: 10457 - protein, 7 aa, Artificial Sequence
  Synthetic Construct
NAMDLKV

SEQ ID NO: 10458 - protein, 7 aa, Artificial Sequence
  Synthetic Construct
MMGNGSS

SEQ ID NO: 10459 - protein, 7 aa, Artificial Sequence
  Synthetic Construct
SNSTKAL

SEQ ID NO: 10460 - protein, 7 aa, Artificial Sequence
  Synthetic Construct
SNSTRGT

SEQ ID NO: 10461 - protein, 7 aa, Artificial Sequence
  Synthetic Construct
SLSSLHV

SEQ ID NO: 10462 - protein, 7 aa, Artificial Sequence
  Synthetic Construct
TLSGALT

SEQ ID NO: 10463 - protein, 7 aa, Artificial Sequence
  Synthetic Construct
PNTVRNN

SEQ ID NO: 10464 - protein, 7 aa, Artificial Sequence
  Synthetic Construct
NNNVKMT

SEQ ID NO: 10465 - protein, 7 aa, Artificial Sequence
  Synthetic Construct
SVAKPFM

SEQ ID NO: 10466 - protein, 7 aa, Artificial Sequence
  Synthetic Construct
TQTTRLS

SEQ ID NO: 10467 - protein, 7 aa, Artificial Sequence
  Synthetic Construct
NNATRGG

SEQ ID NO: 10468 - protein, 7 aa, Artificial Sequence
  Synthetic Construct
TNTTARI

SEQ ID NO: 10469 - protein, 7 aa, Artificial Sequence
  Synthetic Construct
ENSIRTI

SEQ ID NO: 10470 - protein, 7 aa, Artificial Sequence
  Synthetic Construct
IRETSGK

SEQ ID NO: 10471 - protein, 7 aa, Artificial Sequence
  Synthetic Construct
SIYYHTE

SEQ ID NO: 10472 - protein, 7 aa, Artificial Sequence
  Synthetic Construct
VLDNSGQ

SEQ ID NO: 10473 - protein, 7 aa, Artificial Sequence
  Synthetic Construct
SHNMTIR

SEQ ID NO: 10474 - protein, 7 aa, Artificial Sequence
  Synthetic Construct
TIPSAGK

SEQ ID NO: 10475 - protein, 7 aa, Artificial Sequence
  Synthetic Construct
PRHTLSQ

SEQ ID NO: 10476 - protein, 7 aa, Artificial Sequence
  Synthetic Construct
SLNVQDV

SEQ ID NO: 10477 - protein, 7 aa, Artificial Sequence
  Synthetic Construct
YQSLANP

SEQ ID NO: 10478 - protein, 7 aa, Artificial Sequence
  Synthetic Construct
ILNMSTD

SEQ ID NO: 10479 - protein, 7 aa, Artificial Sequence
  Synthetic Construct
VLHLGHS

SEQ ID NO: 10480 - protein, 7 aa, Artificial Sequence
  Synthetic Construct
GVTQTPR

SEQ ID NO: 10481 - protein, 7 aa, Artificial Sequence
  Synthetic Construct
TNDTRRI

SEQ ID NO: 10482 - protein, 7 aa, Artificial Sequence
  Synthetic Construct
QTDHTSR

SEQ ID NO: 10483 - protein, 7 aa, Artificial Sequence
  Synthetic Construct
KNEIKNV

SEQ ID NO: 10484 - protein, 7 aa, Artificial Sequence
  Synthetic Construct
WTGNERL

SEQ ID NO: 10485 - protein, 7 aa, Artificial Sequence
  Synthetic Construct
GKSDAMR

SEQ ID NO: 10486 - protein, 7 aa, Artificial Sequence
  Synthetic Construct
GNATRTY

SEQ ID NO: 10487 - protein, 7 aa, Artificial Sequence
  Synthetic Construct
ASNLGLP

SEQ ID NO: 10488 - protein, 7 aa, Artificial Sequence
  Synthetic Construct
SSLSGSP

SEQ ID NO: 10489 - protein, 7 aa, Artificial Sequence
  Synthetic Construct
AAVNQGV

SEQ ID NO: 10490 - protein, 7 aa, Artificial Sequence
  Synthetic Construct
DQNQPRE

SEQ ID NO: 10491 - protein, 7 aa, Artificial Sequence
  Synthetic Construct
LTQDKQA

SEQ ID NO: 10492 - protein, 7 aa, Artificial Sequence
  Synthetic Construct
FGSNEHN

SEQ ID NO: 10493 - protein, 7 aa, Artificial Sequence
  Synthetic Construct
LNQPNVR

SEQ ID NO: 10494 - protein, 7 aa, Artificial Sequence
  Synthetic Construct
MNTTRNL

SEQ ID NO: 10495 - protein, 7 aa, Artificial Sequence
  Synthetic Construct
TNSTRTS

SEQ ID NO: 10496 - protein, 7 aa, Artificial Sequence
  Synthetic Construct
FELSHVP

SEQ ID NO: 10497 - protein, 7 aa, Artificial Sequence
  Synthetic Construct
EGLGNAA

SEQ ID NO: 10498 - protein, 7 aa, Artificial Sequence
  Synthetic Construct
LTVTLNH

SEQ ID NO: 10499 - protein, 7 aa, Artificial Sequence
  Synthetic Construct
FGNAIQS

SEQ ID NO: 10500 - protein, 7 aa, Artificial Sequence
  Synthetic Construct
PGGGLTP

SEQ ID NO: 10501 - protein, 7 aa, Artificial Sequence
  Synthetic Construct
PNMTRSL

SEQ ID NO: 10502 - protein, 7 aa, Artificial Sequence
  Synthetic Construct
SQLHRLQ

SEQ ID NO: 10503 - protein, 7 aa, Artificial Sequence
  Synthetic Construct
NDPVLTV

SEQ ID NO: 10504 - protein, 7 aa, Artificial Sequence
  Synthetic Construct
ENSVRTT

SEQ ID NO: 10505 - protein, 7 aa, Artificial Sequence
  Synthetic Construct
DRVTNPK

SEQ ID NO: 10506 - protein, 7 aa, Artificial Sequence
  Synthetic Construct
LNTGQMR

SEQ ID NO: 10507 - protein, 7 aa, Artificial Sequence
  Synthetic Construct
ISPSQVK

SEQ ID NO: 10508 - protein, 7 aa, Artificial Sequence
  Synthetic Construct
YSADKTT

SEQ ID NO: 10509 - protein, 7 aa, Artificial Sequence
  Synthetic Construct
IDSAGMA

SEQ ID NO: 10510 - protein, 7 aa, Artificial Sequence
  Synthetic Construct
SNNIKLN

SEQ ID NO: 10511 - protein, 7 aa, Artificial Sequence
  Synthetic Construct
LETQPRT

SEQ ID NO: 10512 - protein, 7 aa, Artificial Sequence
  Synthetic Construct
NLHSNVL

SEQ ID NO: 10513 - protein, 7 aa, Artificial Sequence
  Synthetic Construct
MVKDTQL

SEQ ID NO: 10514 - protein, 7 aa, Artificial Sequence
  Synthetic Construct
LMHLTNP

SEQ ID NO: 10515 - protein, 7 aa, Artificial Sequence
  Synthetic Construct
VASPDKR

SEQ ID NO: 10516 - protein, 7 aa, Artificial Sequence
  Synthetic Construct
VVAVLTS

SEQ ID NO: 10517 - protein, 7 aa, Artificial Sequence
  Synthetic Construct
NIMVNVP

SEQ ID NO: 10518 - protein, 7 aa, Artificial Sequence
  Synthetic Construct
PYSGQRT

SEQ ID NO: 10519 - protein, 7 aa, Artificial Sequence
  Synthetic Construct
PLLKTNT

SEQ ID NO: 10520 - protein, 7 aa, Artificial Sequence
  Synthetic Construct
GNTTVRG

SEQ ID NO: 10521 - protein, 7 aa, Artificial Sequence
  Synthetic Construct
TNKVRDD

SEQ ID NO: 10522 - protein, 7 aa, Artificial Sequence
  Synthetic Construct
PSTALLV

SEQ ID NO: 10523 - protein, 7 aa, Artificial Sequence
  Synthetic Construct
IQSITLK

SEQ ID NO: 10524 - protein, 7 aa, Artificial Sequence
  Synthetic Construct
PLHANMS

SEQ ID NO: 10525 - protein, 7 aa, Artificial Sequence
  Synthetic Construct
TAHAEAR

SEQ ID NO: 10526 - protein, 7 aa, Artificial Sequence
  Synthetic Construct
TNTDSYR

SEQ ID NO: 10527 - protein, 7 aa, Artificial Sequence
  Synthetic Construct
THVSLDR

SEQ ID NO: 10528 - protein, 7 aa, Artificial Sequence
  Synthetic Construct
FSTKDHV

SEQ ID NO: 10529 - protein, 7 aa, Artificial Sequence
  Synthetic Construct
DNTQTAP

SEQ ID NO: 10530 - protein, 7 aa, Artificial Sequence
  Synthetic Construct
SNRIISG

SEQ ID NO: 10531 - protein, 7 aa, Artificial Sequence
  Synthetic Construct
TNSVRNN

SEQ ID NO: 10532 - protein, 7 aa, Artificial Sequence
  Synthetic Construct
SNEVRNM

SEQ ID NO: 10533 - protein, 7 aa, Artificial Sequence
  Synthetic Construct
ELYKPSR

SEQ ID NO: 10534 - protein, 7 aa, Artificial Sequence
  Synthetic Construct
WITGGAS

SEQ ID NO: 10535 - protein, 7 aa, Artificial Sequence
  Synthetic Construct
NNSVRPT

SEQ ID NO: 10536 - protein, 7 aa, Artificial Sequence
  Synthetic Construct
HTAVLRT

SEQ ID NO: 10537 - protein, 7 aa, Artificial Sequence
  Synthetic Construct
NTLSLAP

SEQ ID NO: 10538 - protein, 7 aa, Artificial Sequence
  Synthetic Construct
PNASVNS

SEQ ID NO: 10539 - protein, 7 aa, Artificial Sequence
  Synthetic Construct
VTGGNTY

SEQ ID NO: 10540 - protein, 7 aa, Artificial Sequence
  Synthetic Construct
VNENLIE

SEQ ID NO: 10541 - protein, 7 aa, Artificial Sequence
  Synthetic Construct
VLTTHSN

SEQ ID NO: 10542 - protein, 7 aa, Artificial Sequence
  Synthetic Construct
HTQLPLT

SEQ ID NO: 10543 - protein, 7 aa, Artificial Sequence
  Synthetic Construct
RQSLEAL

SEQ ID NO: 10544 - protein, 7 aa, Artificial Sequence
  Synthetic Construct
PDVTEGR

SEQ ID NO: 10545 - protein, 7 aa, Artificial Sequence
  Synthetic Construct
PTNIMLD

SEQ ID NO: 10546 - protein, 7 aa, Artificial Sequence
  Synthetic Construct
PNMSAMI

SEQ ID NO: 10547 - protein, 7 aa, Artificial Sequence
  Synthetic Construct
IMNGQAL

SEQ ID NO: 10548 - protein, 7 aa, Artificial Sequence
  Synthetic Construct
NNNSTRF

SEQ ID NO: 10549 - protein, 7 aa, Artificial Sequence
  Synthetic Construct
ANVTRST

SEQ ID NO: 10550 - protein, 7 aa, Artificial Sequence
  Synthetic Construct
QNLGLNV

SEQ ID NO: 10551 - protein, 7 aa, Artificial Sequence
  Synthetic Construct
QAQMSSA

SEQ ID NO: 10552 - protein, 7 aa, Artificial Sequence
  Synthetic Construct
LTMATNV

SEQ ID NO: 10553 - protein, 7 aa, Artificial Sequence
  Synthetic Construct
DRDSVQN

SEQ ID NO: 10554 - protein, 7 aa, Artificial Sequence
  Synthetic Construct
VNPTNNL

SEQ ID NO: 10555 - protein, 7 aa, Artificial Sequence
  Synthetic Construct
PSFTTMS

SEQ ID NO: 10556 - protein, 7 aa, Artificial Sequence
  Synthetic Construct
RETPIPK

SEQ ID NO: 10557 - protein, 7 aa, Artificial Sequence
  Synthetic Construct
SLNFTTA

SEQ ID NO: 10558 - protein, 7 aa, Artificial Sequence
  Synthetic Construct
GMSGVAQ

SEQ ID NO: 10559 - protein, 7 aa, Artificial Sequence
  Synthetic Construct
KVDAAQS

SEQ ID NO: 10560 - protein, 7 aa, Artificial Sequence
  Synthetic Construct
HITTNVS

SEQ ID NO: 10561 - protein, 7 aa, Artificial Sequence
  Synthetic Construct
ERESARL

SEQ ID NO: 10562 - protein, 7 aa, Artificial Sequence
  Synthetic Construct
DNRTQRT

SEQ ID NO: 10563 - protein, 7 aa, Artificial Sequence
  Synthetic Construct
SAPNVTI

SEQ ID NO: 10564 - protein, 7 aa, Artificial Sequence
  Synthetic Construct
ENGTRNT

SEQ ID NO: 10565 - protein, 7 aa, Artificial Sequence
  Synthetic Construct
GTAVFTA

SEQ ID NO: 10566 - protein, 7 aa, Artificial Sequence
  Synthetic Construct
ANNMSQT

SEQ ID NO: 10567 - protein, 7 aa, Artificial Sequence
  Synthetic Construct
GNHTYNL

SEQ ID NO: 10568 - protein, 7 aa, Artificial Sequence
  Synthetic Construct
LSPSNSN

SEQ ID NO: 10569 - protein, 7 aa, Artificial Sequence
  Synthetic Construct
MGADHRT

SEQ ID NO: 10570 - protein, 7 aa, Artificial Sequence
  Synthetic Construct
SNSTRGS

SEQ ID NO: 10571 - protein, 7 aa, Artificial Sequence
  Synthetic Construct
NTSGVPK

SEQ ID NO: 10572 - protein, 7 aa, Artificial Sequence
  Synthetic Construct
INTAVVS

SEQ ID NO: 10573 - protein, 7 aa, Artificial Sequence
  Synthetic Construct
MGVQAYV

SEQ ID NO: 10574 - protein, 7 aa, Artificial Sequence
  Synthetic Construct
GNFVKPN

SEQ ID NO: 10575 - protein, 7 aa, Artificial Sequence
  Synthetic Construct
VNSVRMI

SEQ ID NO: 10576 - protein, 7 aa, Artificial Sequence
  Synthetic Construct
HDSANSR

SEQ ID NO: 10577 - protein, 7 aa, Artificial Sequence
  Synthetic Construct
LGVRDDS

SEQ ID NO: 10578 - protein, 7 aa, Artificial Sequence
  Synthetic Construct
SNAVRAN

SEQ ID NO: 10579 - protein, 7 aa, Artificial Sequence
  Synthetic Construct
PVLAATM

SEQ ID NO: 10580 - protein, 7 aa, Artificial Sequence
  Synthetic Construct
NKPVSGN

SEQ ID NO: 10581 - protein, 7 aa, Artificial Sequence
  Synthetic Construct
VGLASHT

SEQ ID NO: 10582 - protein, 7 aa, Artificial Sequence
  Synthetic Construct
GSNTNMK

SEQ ID NO: 10583 - protein, 7 aa, Artificial Sequence
  Synthetic Construct
VATTVHN

SEQ ID NO: 10584 - protein, 7 aa, Artificial Sequence
  Synthetic Construct
NTLDSRV

SEQ ID NO: 10585 - protein, 7 aa, Artificial Sequence
  Synthetic Construct
REANLQA

SEQ ID NO: 10586 - protein, 7 aa, Artificial Sequence
  Synthetic Construct
VDALSHM

SEQ ID NO: 10587 - protein, 7 aa, Artificial Sequence
  Synthetic Construct
LRLAGLA

SEQ ID NO: 10588 - protein, 7 aa, Artificial Sequence
  Synthetic Construct
ITVTNYS

SEQ ID NO: 10589 - protein, 7 aa, Artificial Sequence
  Synthetic Construct
WDSGSGE

SEQ ID NO: 10590 - protein, 7 aa, Artificial Sequence
  Synthetic Construct
FASETVA

SEQ ID NO: 10591 - protein, 7 aa, Artificial Sequence
  Synthetic Construct
QNVTGTR

SEQ ID NO: 10592 - protein, 7 aa, Artificial Sequence
  Synthetic Construct
LNGLNVS

SEQ ID NO: 10593 - protein, 7 aa, Artificial Sequence
  Synthetic Construct
NMLKQSE

SEQ ID NO: 10594 - protein, 7 aa, Artificial Sequence
  Synthetic Construct
FNEVPKA

SEQ ID NO: 10595 - protein, 7 aa, Artificial Sequence
  Synthetic Construct
LGDITGF

SEQ ID NO: 10596 - protein, 7 aa, Artificial Sequence
  Synthetic Construct
ISASHSR

SEQ ID NO: 10597 - protein, 7 aa, Artificial Sequence
  Synthetic Construct
SQTQIAL

SEQ ID NO: 10598 - protein, 7 aa, Artificial Sequence
  Synthetic Construct
NMATQMK

SEQ ID NO: 10599 - protein, 7 aa, Artificial Sequence
  Synthetic Construct
VNHNIRL

SEQ ID NO: 10600 - protein, 7 aa, Artificial Sequence
  Synthetic Construct
NALQVPV

SEQ ID NO: 10601 - protein, 7 aa, Artificial Sequence
  Synthetic Construct
NSTGIDT

SEQ ID NO: 10602 - protein, 7 aa, Artificial Sequence
  Synthetic Construct
VVAGHLN

SEQ ID NO: 10603 - protein, 7 aa, Artificial Sequence
  Synthetic Construct
RNDAILN

SEQ ID NO: 10604 - protein, 7 aa, Artificial Sequence
  Synthetic Construct
NRVDSRA

SEQ ID NO: 10605 - protein, 7 aa, Artificial Sequence
  Synthetic Construct
STHSTYV

SEQ ID NO: 10606 - protein, 7 aa, Artificial Sequence
  Synthetic Construct
SGHGTLR

SEQ ID NO: 10607 - protein, 7 aa, Artificial Sequence
  Synthetic Construct
PNSTTLS

SEQ ID NO: 10608 - protein, 7 aa, Artificial Sequence
  Synthetic Construct
DTKPTNT

SEQ ID NO: 10609 - protein, 7 aa, Artificial Sequence
  Synthetic Construct
NRDTINN

SEQ ID NO: 10610 - protein, 7 aa, Artificial Sequence
  Synthetic Construct
PRTLSDG

SEQ ID NO: 10611 - protein, 7 aa, Artificial Sequence
  Synthetic Construct
TKDVTTS

SEQ ID NO: 10612 - protein, 7 aa, Artificial Sequence
  Synthetic Construct
LGNPTPS

SEQ ID NO: 10613 - protein, 7 aa, Artificial Sequence
  Synthetic Construct
YQAMYRD

SEQ ID NO: 10614 - protein, 7 aa, Artificial Sequence
  Synthetic Construct
SGVQEFD

SEQ ID NO: 10615 - protein, 7 aa, Artificial Sequence
  Synthetic Construct
SNHLSTV

SEQ ID NO: 10616 - protein, 7 aa, Artificial Sequence
  Synthetic Construct
HDERANM

SEQ ID NO: 10617 - protein, 7 aa, Artificial Sequence
  Synthetic Construct
TNSTRSP

SEQ ID NO: 10618 - protein, 7 aa, Artificial Sequence
  Synthetic Construct
PTDKSYP

SEQ ID NO: 10619 - protein, 7 aa, Artificial Sequence
  Synthetic Construct
MTEQRTA

SEQ ID NO: 10620 - protein, 7 aa, Artificial Sequence
  Synthetic Construct
TNATHSK

SEQ ID NO: 10621 - protein, 7 aa, Artificial Sequence
  Synthetic Construct
NRGTFSA

SEQ ID NO: 10622 - protein, 7 aa, Artificial Sequence
  Synthetic Construct
NTTKFNT

SEQ ID NO: 10623 - protein, 7 aa, Artificial Sequence
  Synthetic Construct
GIPPLTK

SEQ ID NO: 10624 - protein, 7 aa, Artificial Sequence
  Synthetic Construct
TANSTQR

SEQ ID NO: 10625 - protein, 7 aa, Artificial Sequence
  Synthetic Construct
TQGPGPK

SEQ ID NO: 10626 - protein, 7 aa, Artificial Sequence
  Synthetic Construct
MNTTRNY

SEQ ID NO: 10627 - protein, 7 aa, Artificial Sequence
  Synthetic Construct
LREGTFM

SEQ ID NO: 10628 - protein, 7 aa, Artificial Sequence
  Synthetic Construct
NISSTDR

SEQ ID NO: 10629 - protein, 7 aa, Artificial Sequence
  Synthetic Construct
SVSRPFQ

SEQ ID NO: 10630 - protein, 7 aa, Artificial Sequence
  Synthetic Construct
PMSANGK

SEQ ID NO: 10631 - protein, 7 aa, Artificial Sequence
  Synthetic Construct
EVRGNTF

SEQ ID NO: 10632 - protein, 7 aa, Artificial Sequence
  Synthetic Construct
SQKGLSV

SEQ ID NO: 10633 - protein, 7 aa, Artificial Sequence
  Synthetic Construct
IAENLSA

SEQ ID NO: 10634 - protein, 7 aa, Artificial Sequence
  Synthetic Construct
FSNMNLK

SEQ ID NO: 10635 - protein, 7 aa, Artificial Sequence
  Synthetic Construct
PRERTYT

SEQ ID NO: 10636 - protein, 7 aa, Artificial Sequence
  Synthetic Construct
WSHNPDS

SEQ ID NO: 10637 - protein, 7 aa, Artificial Sequence
  Synthetic Construct
GLQTLIT

SEQ ID NO: 10638 - protein, 7 aa, Artificial Sequence
  Synthetic Construct
SNRTKDI

SEQ ID NO: 10639 - protein, 7 aa, Artificial Sequence
  Synthetic Construct
VTETILK

SEQ ID NO: 10640 - protein, 7 aa, Artificial Sequence
  Synthetic Construct
YVTRSGL

SEQ ID NO: 10641 - protein, 7 aa, Artificial Sequence
  Synthetic Construct
MNANILV

SEQ ID NO: 10642 - protein, 7 aa, Artificial Sequence
  Synthetic Construct
TTNRVGT

SEQ ID NO: 10643 - protein, 7 aa, Artificial Sequence
  Synthetic Construct
VLKSHLQ

SEQ ID NO: 10644 - protein, 7 aa, Artificial Sequence
  Synthetic Construct
SDGLRTQ

SEQ ID NO: 10645 - protein, 7 aa, Artificial Sequence
  Synthetic Construct
LNSVKPN

SEQ ID NO: 10646 - protein, 7 aa, Artificial Sequence
  Synthetic Construct
SQAIAPK

SEQ ID NO: 10647 - protein, 7 aa, Artificial Sequence
  Synthetic Construct
SNNVRAP

SEQ ID NO: 10648 - protein, 7 aa, Artificial Sequence
  Synthetic Construct
ISHLSES

SEQ ID NO: 10649 - protein, 7 aa, Artificial Sequence
  Synthetic Construct
LLPGMRF

SEQ ID NO: 10650 - protein, 7 aa, Artificial Sequence
  Synthetic Construct
LLASATK

SEQ ID NO: 10651 - protein, 7 aa, Artificial Sequence
  Synthetic Construct
NHNGMVS

SEQ ID NO: 10652 - protein, 7 aa, Artificial Sequence
  Synthetic Construct
HSGELNN

SEQ ID NO: 10653 - protein, 7 aa, Artificial Sequence
  Synthetic Construct
LSAPKDT

SEQ ID NO: 10654 - protein, 7 aa, Artificial Sequence
  Synthetic Construct
IGTHVGT

SEQ ID NO: 10655 - protein, 7 aa, Artificial Sequence
  Synthetic Construct
AVALASA

SEQ ID NO: 10656 - protein, 7 aa, Artificial Sequence
  Synthetic Construct
ITLQSNA

SEQ ID NO: 10657 - protein, 7 aa, Artificial Sequence
  Synthetic Construct
VDHSLTS

SEQ ID NO: 10658 - protein, 7 aa, Artificial Sequence
  Synthetic Construct
GNEATSL

SEQ ID NO: 10659 - protein, 7 aa, Artificial Sequence
  Synthetic Construct
PVSSTTL

SEQ ID NO: 10660 - protein, 7 aa, Artificial Sequence
  Synthetic Construct
PYQTSSA

SEQ ID NO: 10661 - protein, 7 aa, Artificial Sequence
  Synthetic Construct
TSVVSAF

SEQ ID NO: 10662 - protein, 7 aa, Artificial Sequence
  Synthetic Construct
NGVPDNN

SEQ ID NO: 10663 - protein, 7 aa, Artificial Sequence
  Synthetic Construct
STQTIGF

SEQ ID NO: 10664 - protein, 7 aa, Artificial Sequence
  Synthetic Construct
IRSSDLA

SEQ ID NO: 10665 - protein, 7 aa, Artificial Sequence
  Synthetic Construct
NTQSAKY

SEQ ID NO: 10666 - protein, 7 aa, Artificial Sequence
  Synthetic Construct
SLESSRQ

SEQ ID NO: 10667 - protein, 7 aa, Artificial Sequence
  Synthetic Construct
LNLASGR

SEQ ID NO: 10668 - protein, 7 aa, Artificial Sequence
  Synthetic Construct
MQERREY

SEQ ID NO: 10669 - protein, 7 aa, Artificial Sequence
  Synthetic Construct
WLLKDGY

SEQ ID NO: 10670 - protein, 7 aa, Artificial Sequence
  Synthetic Construct
GRYQTTS

SEQ ID NO: 10671 - protein, 7 aa, Artificial Sequence
  Synthetic Construct
NTTKFPF

SEQ ID NO: 10672 - protein, 7 aa, Artificial Sequence
  Synthetic Construct
MSNGISR

SEQ ID NO: 10673 - protein, 7 aa, Artificial Sequence
  Synthetic Construct
PIRDPEK

SEQ ID NO: 10674 - protein, 7 aa, Artificial Sequence
  Synthetic Construct
STLSPHV

SEQ ID NO: 10675 - protein, 7 aa, Artificial Sequence
  Synthetic Construct
FMPISSA

SEQ ID NO: 10676 - protein, 7 aa, Artificial Sequence
  Synthetic Construct
RSDTQSS

SEQ ID NO: 10677 - protein, 7 aa, Artificial Sequence
  Synthetic Construct
DNHVMAR

SEQ ID NO: 10678 - protein, 7 aa, Artificial Sequence
  Synthetic Construct
NLSSKSW

SEQ ID NO: 10679 - protein, 7 aa, Artificial Sequence
  Synthetic Construct
STILKDT

SEQ ID NO: 10680 - protein, 7 aa, Artificial Sequence
  Synthetic Construct
PTHQSKP

SEQ ID NO: 10681 - protein, 7 aa, Artificial Sequence
  Synthetic Construct
TEVTQNK

SEQ ID NO: 10682 - protein, 7 aa, Artificial Sequence
  Synthetic Construct
HLDSNGS

SEQ ID NO: 10683 - protein, 7 aa, Artificial Sequence
  Synthetic Construct
NTDSRVG

SEQ ID NO: 10684 - protein, 7 aa, Artificial Sequence
  Synthetic Construct
SMGLKEK

SEQ ID NO: 10685 - protein, 7 aa, Artificial Sequence
  Synthetic Construct
LSTSYTR

SEQ ID NO: 10686 - protein, 7 aa, Artificial Sequence
  Synthetic Construct
SGMSNNH

SEQ ID NO: 10687 - protein, 7 aa, Artificial Sequence
  Synthetic Construct
TNYDLRA

SEQ ID NO: 10688 - protein, 7 aa, Artificial Sequence
  Synthetic Construct
TPQSQEM

SEQ ID NO: 10689 - protein, 7 aa, Artificial Sequence
  Synthetic Construct
NSNMVTP

SEQ ID NO: 10690 - protein, 7 aa, Artificial Sequence
  Synthetic Construct
SAVPNVK

SEQ ID NO: 10691 - protein, 7 aa, Artificial Sequence
  Synthetic Construct
VLVAGSR

SEQ ID NO: 10692 - protein, 7 aa, Artificial Sequence
  Synthetic Construct
GNNSRNM

SEQ ID NO: 10693 - protein, 7 aa, Artificial Sequence
  Synthetic Construct
MPRGHVS

SEQ ID NO: 10694 - protein, 7 aa, Artificial Sequence
  Synthetic Construct
WSHSENS

SEQ ID NO: 10695 - protein, 7 aa, Artificial Sequence
  Synthetic Construct
FEKDPVA

SEQ ID NO: 10696 - protein, 7 aa, Artificial Sequence
  Synthetic Construct
ITQATPS

SEQ ID NO: 10697 - protein, 7 aa, Artificial Sequence
  Synthetic Construct
ANLSHLH

SEQ ID NO: 10698 - protein, 7 aa, Artificial Sequence
  Synthetic Construct
GITNSTI

SEQ ID NO: 10699 - protein, 7 aa, Artificial Sequence
  Synthetic Construct
PSQQPTR

SEQ ID NO: 10700 - protein, 7 aa, Artificial Sequence
  Synthetic Construct
QQTHEDI

SEQ ID NO: 10701 - protein, 7 aa, Artificial Sequence
  Synthetic Construct
QVNVSPD

SEQ ID NO: 10702 - protein, 7 aa, Artificial Sequence
  Synthetic Construct
KAVVTQT

SEQ ID NO: 10703 - protein, 7 aa, Artificial Sequence
  Synthetic Construct
NTVRSST

SEQ ID NO: 10704 - protein, 7 aa, Artificial Sequence
  Synthetic Construct
NASSHLL

SEQ ID NO: 10705 - protein, 7 aa, Artificial Sequence
  Synthetic Construct
YIKDSTP

SEQ ID NO: 10706 - protein, 7 aa, Artificial Sequence
  Synthetic Construct
SSESTNL

SEQ ID NO: 10707 - protein, 7 aa, Artificial Sequence
  Synthetic Construct
KENVEGN

SEQ ID NO: 10708 - protein, 7 aa, Artificial Sequence
  Synthetic Construct
NNVLGTP

SEQ ID NO: 10709 - protein, 7 aa, Artificial Sequence
  Synthetic Construct
QNVSILD

SEQ ID NO: 10710 - protein, 7 aa, Artificial Sequence
  Synthetic Construct
PLNSENN

SEQ ID NO: 10711 - protein, 7 aa, Artificial Sequence
  Synthetic Construct
TINLVGY

SEQ ID NO: 10712 - protein, 7 aa, Artificial Sequence
  Synthetic Construct
PALAAQA

SEQ ID NO: 10713 - protein, 7 aa, Artificial Sequence
  Synthetic Construct
TLQNSIT

SEQ ID NO: 10714 - protein, 7 aa, Artificial Sequence
  Synthetic Construct
LGGTDGH

SEQ ID NO: 10715 - protein, 7 aa, Artificial Sequence
  Synthetic Construct
AGPINNT

SEQ ID NO: 10716 - protein, 7 aa, Artificial Sequence
  Synthetic Construct
HVLTQSV

SEQ ID NO: 10717 - protein, 7 aa, Artificial Sequence
  Synthetic Construct
TTIPSHQ

SEQ ID NO: 10718 - protein, 7 aa, Artificial Sequence
  Synthetic Construct
HDGLLSR

SEQ ID NO: 10719 - protein, 7 aa, Artificial Sequence
  Synthetic Construct
SIHTGLT

SEQ ID NO: 10720 - protein, 7 aa, Artificial Sequence
  Synthetic Construct
GNMTKFT

SEQ ID NO: 10721 - protein, 7 aa, Artificial Sequence
  Synthetic Construct
YALSTDT

SEQ ID NO: 10722 - protein, 7 aa, Artificial Sequence
  Synthetic Construct
TQADNLK

SEQ ID NO: 10723 - protein, 7 aa, Artificial Sequence
  Synthetic Construct
WYKTLDA

SEQ ID NO: 10724 - protein, 7 aa, Artificial Sequence
  Synthetic Construct
PQYAKIS

SEQ ID NO: 10725 - protein, 7 aa, Artificial Sequence
  Synthetic Construct
LATDNKS

SEQ ID NO: 10726 - protein, 7 aa, Artificial Sequence
  Synthetic Construct
LSVVITS

SEQ ID NO: 10727 - protein, 7 aa, Artificial Sequence
  Synthetic Construct
NVPTSPR

SEQ ID NO: 10728 - protein, 7 aa, Artificial Sequence
  Synthetic Construct
ARPDLKL

SEQ ID NO: 10729 - protein, 7 aa, Artificial Sequence
  Synthetic Construct
SALANTL

SEQ ID NO: 10730 - protein, 7 aa, Artificial Sequence
  Synthetic Construct
LMDFSNP

SEQ ID NO: 10731 - protein, 7 aa, Artificial Sequence
  Synthetic Construct
PRTELIS

SEQ ID NO: 10732 - protein, 7 aa, Artificial Sequence
  Synthetic Construct
TSDIKSK

SEQ ID NO: 10733 - protein, 7 aa, Artificial Sequence
  Synthetic Construct
SNATMRF

SEQ ID NO: 10734 - protein, 7 aa, Artificial Sequence
  Synthetic Construct
VQSPALQ

SEQ ID NO: 10735 - protein, 7 aa, Artificial Sequence
  Synthetic Construct
TANTTSR

SEQ ID NO: 10736 - protein, 7 aa, Artificial Sequence
  Synthetic Construct
QHMTSQI

SEQ ID NO: 10737 - protein, 7 aa, Artificial Sequence
  Synthetic Construct
SNMSLSS

SEQ ID NO: 10738 - protein, 7 aa, Artificial Sequence
  Synthetic Construct
ITGIPTS

SEQ ID NO: 10739 - protein, 7 aa, Artificial Sequence
  Synthetic Construct
FTNNVRD

SEQ ID NO: 10740 - protein, 7 aa, Artificial Sequence
  Synthetic Construct
NSNAGGK

SEQ ID NO: 10741 - protein, 7 aa, Artificial Sequence
  Synthetic Construct
YNTDITK

SEQ ID NO: 10742 - protein, 7 aa, Artificial Sequence
  Synthetic Construct
FSNPDKM

SEQ ID NO: 10743 - protein, 7 aa, Artificial Sequence
  Synthetic Construct
LMTTSTI

SEQ ID NO: 10744 - protein, 7 aa, Artificial Sequence
  Synthetic Construct
TNSTLRQ

SEQ ID NO: 10745 - protein, 7 aa, Artificial Sequence
  Synthetic Construct
SNYTKII

SEQ ID NO: 10746 - protein, 7 aa, Artificial Sequence
  Synthetic Construct
SAGLISS

SEQ ID NO: 10747 - protein, 7 aa, Artificial Sequence
  Synthetic Construct
KQGPMLS

SEQ ID NO: 10748 - protein, 7 aa, Artificial Sequence
  Synthetic Construct
VRTPGVQ

SEQ ID NO: 10749 - protein, 7 aa, Artificial Sequence
  Synthetic Construct
TPDHRER

SEQ ID NO: 10750 - protein, 7 aa, Artificial Sequence
  Synthetic Construct
MNATVPS

SEQ ID NO: 10751 - protein, 7 aa, Artificial Sequence
  Synthetic Construct
LHSMLAP

SEQ ID NO: 10752 - protein, 7 aa, Artificial Sequence
  Synthetic Construct
DMHHSQP

SEQ ID NO: 10753 - protein, 7 aa, Artificial Sequence
  Synthetic Construct
KPLPTTY

SEQ ID NO: 10754 - protein, 7 aa, Artificial Sequence
  Synthetic Construct
AMQVTLS

SEQ ID NO: 10755 - protein, 7 aa, Artificial Sequence
  Synthetic Construct
SPTHDAR

SEQ ID NO: 10756 - protein, 7 aa, Artificial Sequence
  Synthetic Construct
ALSVKEL

SEQ ID NO: 10757 - protein, 7 aa, Artificial Sequence
  Synthetic Construct
PSRVPTQ

SEQ ID NO: 10758 - protein, 7 aa, Artificial Sequence
  Synthetic Construct
GSLGLGK

SEQ ID NO: 10759 - protein, 7 aa, Artificial Sequence
  Synthetic Construct
HSSYSSK

SEQ ID NO: 10760 - protein, 7 aa, Artificial Sequence
  Synthetic Construct
PNPSNPS

SEQ ID NO: 10761 - protein, 7 aa, Artificial Sequence
  Synthetic Construct
TKNGVAQ

SEQ ID NO: 10762 - protein, 7 aa, Artificial Sequence
  Synthetic Construct
GSTSSAY

SEQ ID NO: 10763 - protein, 7 aa, Artificial Sequence
  Synthetic Construct
RSTHENT

SEQ ID NO: 10764 - protein, 7 aa, Artificial Sequence
  Synthetic Construct
SGHDRDA

SEQ ID NO: 10765 - protein, 7 aa, Artificial Sequence
  Synthetic Construct
NTQSYTS

SEQ ID NO: 10766 - protein, 7 aa, Artificial Sequence
  Synthetic Construct
DRVPHLR

SEQ ID NO: 10767 - protein, 7 aa, Artificial Sequence
  Synthetic Construct
NNPPHMR

SEQ ID NO: 10768 - protein, 7 aa, Artificial Sequence
  Synthetic Construct
RSLQSQF

SEQ ID NO: 10769 - protein, 7 aa, Artificial Sequence
  Synthetic Construct
IRDDRSL

SEQ ID NO: 10770 - protein, 7 aa, Artificial Sequence
  Synthetic Construct
MLSAPLP

SEQ ID NO: 10771 - protein, 7 aa, Artificial Sequence
  Synthetic Construct
TSSILTT

SEQ ID NO: 10772 - protein, 7 aa, Artificial Sequence
  Synthetic Construct
REQMNLV

SEQ ID NO: 10773 - protein, 7 aa, Artificial Sequence
  Synthetic Construct
KTQSLSN

SEQ ID NO: 10774 - protein, 7 aa, Artificial Sequence
  Synthetic Construct
LKTAEYT

SEQ ID NO: 10775 - protein, 7 aa, Artificial Sequence
  Synthetic Construct
SSEKPFR

SEQ ID NO: 10776 - protein, 7 aa, Artificial Sequence
  Synthetic Construct
PTSGVFG

SEQ ID NO: 10777 - protein, 7 aa, Artificial Sequence
  Synthetic Construct
GPSIVTM

SEQ ID NO: 10778 - protein, 7 aa, Artificial Sequence
  Synthetic Construct
TSDKSSL

SEQ ID NO: 10779 - protein, 7 aa, Artificial Sequence
  Synthetic Construct
NTITMAK

SEQ ID NO: 10780 - protein, 7 aa, Artificial Sequence
  Synthetic Construct
RNQPVPS

SEQ ID NO: 10781 - protein, 7 aa, Artificial Sequence
  Synthetic Construct
SVHLNLQ

SEQ ID NO: 10782 - protein, 7 aa, Artificial Sequence
  Synthetic Construct
YNLTMVS

SEQ ID NO: 10783 - protein, 7 aa, Artificial Sequence
  Synthetic Construct
TADSHPR

SEQ ID NO: 10784 - protein, 7 aa, Artificial Sequence
  Synthetic Construct
LLGEKVM

SEQ ID NO: 10785 - protein, 7 aa, Artificial Sequence
  Synthetic Construct
WDLTAPQ

SEQ ID NO: 10786 - protein, 7 aa, Artificial Sequence
  Synthetic Construct
VLADRLP

SEQ ID NO: 10787 - protein, 7 aa, Artificial Sequence
  Synthetic Construct
SRALPNS

SEQ ID NO: 10788 - protein, 7 aa, Artificial Sequence
  Synthetic Construct
SSLNMPR

SEQ ID NO: 10789 - protein, 7 aa, Artificial Sequence
  Synthetic Construct
QKVSILA

SEQ ID NO: 10790 - protein, 7 aa, Artificial Sequence
  Synthetic Construct
RGDNSRL

SEQ ID NO: 10791 - protein, 7 aa, Artificial Sequence
  Synthetic Construct
RIDLGSQ

SEQ ID NO: 10792 - protein, 7 aa, Artificial Sequence
  Synthetic Construct
ASLGLRA

SEQ ID NO: 10793 - protein, 7 aa, Artificial Sequence
  Synthetic Construct
SMQNGLR

SEQ ID NO: 10794 - protein, 7 aa, Artificial Sequence
  Synthetic Construct
TLAVGIA

SEQ ID NO: 10795 - protein, 7 aa, Artificial Sequence
  Synthetic Construct
GQTVTGA

SEQ ID NO: 10796 - protein, 7 aa, Artificial Sequence
  Synthetic Construct
HALSPSP

SEQ ID NO: 10797 - protein, 7 aa, Artificial Sequence
  Synthetic Construct
VSSVFTE

SEQ ID NO: 10798 - protein, 7 aa, Artificial Sequence
  Synthetic Construct
YGAGAVK

SEQ ID NO: 10799 - protein, 7 aa, Artificial Sequence
  Synthetic Construct
KETLPNA

SEQ ID NO: 10800 - protein, 7 aa, Artificial Sequence
  Synthetic Construct
IPSQTPL

SEQ ID NO: 10801 - protein, 7 aa, Artificial Sequence
  Synthetic Construct
SAISTFV

SEQ ID NO: 10802 - protein, 7 aa, Artificial Sequence
  Synthetic Construct
VNSTSST

SEQ ID NO: 10803 - protein, 7 aa, Artificial Sequence
  Synthetic Construct
PTRDYKE

SEQ ID NO: 10804 - protein, 7 aa, Artificial Sequence
  Synthetic Construct
NNPASTQ

SEQ ID NO: 10805 - protein, 7 aa, Artificial Sequence
  Synthetic Construct
VTQTSVN

SEQ ID NO: 10806 - protein, 7 aa, Artificial Sequence
  Synthetic Construct
WAGTTSH

SEQ ID NO: 10807 - protein, 7 aa, Artificial Sequence
  Synthetic Construct
VTAGFSA

SEQ ID NO: 10808 - protein, 7 aa, Artificial Sequence
  Synthetic Construct
LHSPSMQ

SEQ ID NO: 10809 - protein, 7 aa, Artificial Sequence
  Synthetic Construct
FPTQPSM

SEQ ID NO: 10810 - protein, 7 aa, Artificial Sequence
  Synthetic Construct
AQSVNDG

SEQ ID NO: 10811 - protein, 7 aa, Artificial Sequence
  Synthetic Construct
VASTTYT

SEQ ID NO: 10812 - protein, 7 aa, Artificial Sequence
  Synthetic Construct
LGGLNSV

SEQ ID NO: 10813 - protein, 7 aa, Artificial Sequence
  Synthetic Construct
AGAPSLS

SEQ ID NO: 10814 - protein, 7 aa, Artificial Sequence
  Synthetic Construct
SNRKIDD

SEQ ID NO: 10815 - protein, 7 aa, Artificial Sequence
  Synthetic Construct
SPNNRAV

SEQ ID NO: 10816 - protein, 7 aa, Artificial Sequence
  Synthetic Construct
VLREDQS

SEQ ID NO: 10817 - protein, 7 aa, Artificial Sequence
  Synthetic Construct
LLATGLK

SEQ ID NO: 10818 - protein, 7 aa, Artificial Sequence
  Synthetic Construct
VHLRSQI

SEQ ID NO: 10819 - protein, 7 aa, Artificial Sequence
  Synthetic Construct
SANSNLK

SEQ ID NO: 10820 - protein, 7 aa, Artificial Sequence
  Synthetic Construct
SKAGEGN

SEQ ID NO: 10821 - protein, 7 aa, Artificial Sequence
  Synthetic Construct
VSNPAMK

SEQ ID NO: 10822 - protein, 7 aa, Artificial Sequence
  Synthetic Construct
INGNNQR

SEQ ID NO: 10823 - protein, 7 aa, Artificial Sequence
  Synthetic Construct
YKSTTLS

SEQ ID NO: 10824 - protein, 7 aa, Artificial Sequence
  Synthetic Construct
KEGLVSR

SEQ ID NO: 10825 - protein, 7 aa, Artificial Sequence
  Synthetic Construct
HLKVMTI

SEQ ID NO: 10826 - protein, 7 aa, Artificial Sequence
  Synthetic Construct
RTNDHSS

SEQ ID NO: 10827 - protein, 7 aa, Artificial Sequence
  Synthetic Construct
LPSQSAK

SEQ ID NO: 10828 - protein, 7 aa, Artificial Sequence
  Synthetic Construct
ITLRHLQ

SEQ ID NO: 10829 - protein, 7 aa, Artificial Sequence
  Synthetic Construct
QMIANIP

SEQ ID NO: 10830 - protein, 7 aa, Artificial Sequence
  Synthetic Construct
SSSTDQH

SEQ ID NO: 10831 - protein, 7 aa, Artificial Sequence
  Synthetic Construct
RSTDFTP

SEQ ID NO: 10832 - protein, 7 aa, Artificial Sequence
  Synthetic Construct
QHASISA

SEQ ID NO: 10833 - protein, 7 aa, Artificial Sequence
  Synthetic Construct
NISSMQM

SEQ ID NO: 10834 - protein, 7 aa, Artificial Sequence
  Synthetic Construct
SGNVVGR

SEQ ID NO: 10835 - protein, 7 aa, Artificial Sequence
  Synthetic Construct
SKGDTSA

SEQ ID NO: 10836 - protein, 7 aa, Artificial Sequence
  Synthetic Construct
LLNTGTK

SEQ ID NO: 10837 - protein, 7 aa, Artificial Sequence
  Synthetic Construct
GTGASMN

SEQ ID NO: 10838 - protein, 7 aa, Artificial Sequence
  Synthetic Construct
RLDANST

SEQ ID NO: 10839 - protein, 7 aa, Artificial Sequence
  Synthetic Construct
LPERPNS

SEQ ID NO: 10840 - protein, 7 aa, Artificial Sequence
  Synthetic Construct
AREILNH

SEQ ID NO: 10841 - protein, 7 aa, Artificial Sequence
  Synthetic Construct
NFKTTNS

SEQ ID NO: 10842 - protein, 7 aa, Artificial Sequence
  Synthetic Construct
GRTVQDR

SEQ ID NO: 10843 - protein, 7 aa, Artificial Sequence
  Synthetic Construct
GMNQTTT

SEQ ID NO: 10844 - protein, 7 aa, Artificial Sequence
  Synthetic Construct
VGKDGVL

SEQ ID NO: 10845 - protein, 7 aa, Artificial Sequence
  Synthetic Construct
VTRDGAK

SEQ ID NO: 10846 - protein, 7 aa, Artificial Sequence
  Synthetic Construct
GTATYGK

SEQ ID NO: 10847 - protein, 7 aa, Artificial Sequence
  Synthetic Construct
MLGAEGY

SEQ ID NO: 10848 - protein, 7 aa, Artificial Sequence
  Synthetic Construct
VTQQNHH

SEQ ID NO: 10849 - protein, 7 aa, Artificial Sequence
  Synthetic Construct
TVNADQL

SEQ ID NO: 10850 - protein, 7 aa, Artificial Sequence
  Synthetic Construct
QMQNSPI

SEQ ID NO: 10851 - protein, 7 aa, Artificial Sequence
  Synthetic Construct
GTLASSK

SEQ ID NO: 10852 - protein, 7 aa, Artificial Sequence
  Synthetic Construct
SNVTIAH

SEQ ID NO: 10853 - protein, 7 aa, Artificial Sequence
  Synthetic Construct
ANNSRPF

SEQ ID NO: 10854 - protein, 7 aa, Artificial Sequence
  Synthetic Construct
IATAGGP

SEQ ID NO: 10855 - protein, 7 aa, Artificial Sequence
  Synthetic Construct
AFSGPSR

SEQ ID NO: 10856 - protein, 7 aa, Artificial Sequence
  Synthetic Construct
LTNLVSR

SEQ ID NO: 10857 - protein, 7 aa, Artificial Sequence
  Synthetic Construct
AGQHLAL

SEQ ID NO: 10858 - protein, 7 aa, Artificial Sequence
  Synthetic Construct
SVVASAN

SEQ ID NO: 10859 - protein, 7 aa, Artificial Sequence
  Synthetic Construct
ETVSTSL

SEQ ID NO: 10860 - protein, 7 aa, Artificial Sequence
  Synthetic Construct
ILAALTG

SEQ ID NO: 10861 - protein, 7 aa, Artificial Sequence
  Synthetic Construct
TTDKAAL

SEQ ID NO: 10862 - protein, 7 aa, Artificial Sequence
  Synthetic Construct
YLDKPGA

SEQ ID NO: 10863 - protein, 7 aa, Artificial Sequence
  Synthetic Construct
PNLSNLM

SEQ ID NO: 10864 - protein, 7 aa, Artificial Sequence
  Synthetic Construct
INAPTAS

SEQ ID NO: 10865 - protein, 7 aa, Artificial Sequence
  Synthetic Construct
HGGTSLA

SEQ ID NO: 10866 - protein, 7 aa, Artificial Sequence
  Synthetic Construct
NIQLSLA

SEQ ID NO: 10867 - protein, 7 aa, Artificial Sequence
  Synthetic Construct
TLHMSSK

SEQ ID NO: 10868 - protein, 7 aa, Artificial Sequence
  Synthetic Construct
AIINPHS

SEQ ID NO: 10869 - protein, 7 aa, Artificial Sequence
  Synthetic Construct
NTLINVS

SEQ ID NO: 10870 - protein, 7 aa, Artificial Sequence
  Synthetic Construct
NSVVLAM

SEQ ID NO: 10871 - protein, 7 aa, Artificial Sequence
  Synthetic Construct
NMASLSA

SEQ ID NO: 10872 - protein, 7 aa, Artificial Sequence
  Synthetic Construct
SSTHLLA

SEQ ID NO: 10873 - protein, 7 aa, Artificial Sequence
  Synthetic Construct
DNSQSDK

SEQ ID NO: 10874 - protein, 7 aa, Artificial Sequence
  Synthetic Construct
GITTNAH

SEQ ID NO: 10875 - protein, 7 aa, Artificial Sequence
  Synthetic Construct
SSTINGY

SEQ ID NO: 10876 - protein, 7 aa, Artificial Sequence
  Synthetic Construct
NHTRMNE

SEQ ID NO: 10877 - protein, 7 aa, Artificial Sequence
  Synthetic Construct
GNQQKNL

SEQ ID NO: 10878 - protein, 7 aa, Artificial Sequence
  Synthetic Construct
GTSDRQQ

SEQ ID NO: 10879 - protein, 7 aa, Artificial Sequence
  Synthetic Construct
SDSEYKP

SEQ ID NO: 10880 - protein, 7 aa, Artificial Sequence
  Synthetic Construct
TAAHVSY

SEQ ID NO: 10881 - protein, 7 aa, Artificial Sequence
  Synthetic Construct
MATTHAA

SEQ ID NO: 10882 - protein, 7 aa, Artificial Sequence
  Synthetic Construct
NSVRQSL

SEQ ID NO: 10883 - protein, 7 aa, Artificial Sequence
  Synthetic Construct
SGSGVSS

SEQ ID NO: 10884 - protein, 7 aa, Artificial Sequence
  Synthetic Construct
PTTRITD

SEQ ID NO: 10885 - protein, 7 aa, Artificial Sequence
  Synthetic Construct
SHEAKNP

SEQ ID NO: 10886 - protein, 7 aa, Artificial Sequence
  Synthetic Construct
PYSTADR

SEQ ID NO: 10887 - protein, 7 aa, Artificial Sequence
  Synthetic Construct
MLSNTNH

SEQ ID NO: 10888 - protein, 7 aa, Artificial Sequence
  Synthetic Construct
SLGLGGS

SEQ ID NO: 10889 - protein, 7 aa, Artificial Sequence
  Synthetic Construct
NAMNMPV

SEQ ID NO: 10890 - protein, 7 aa, Artificial Sequence
  Synthetic Construct
MLGHIAN

SEQ ID NO: 10891 - protein, 7 aa, Artificial Sequence
  Synthetic Construct
KGQTVSE

SEQ ID NO: 10892 - protein, 7 aa, Artificial Sequence
  Synthetic Construct
MDNRNNW

SEQ ID NO: 10893 - protein, 7 aa, Artificial Sequence
  Synthetic Construct
LLHRNDV

SEQ ID NO: 10894 - protein, 7 aa, Artificial Sequence
  Synthetic Construct
ANLVSAK

SEQ ID NO: 10895 - protein, 7 aa, Artificial Sequence
  Synthetic Construct
SLTRDLK

SEQ ID NO: 10896 - protein, 7 aa, Artificial Sequence
  Synthetic Construct
GGQIVSR

SEQ ID NO: 10897 - protein, 7 aa, Artificial Sequence
  Synthetic Construct
NYTPDKR

SEQ ID NO: 10898 - protein, 7 aa, Artificial Sequence
  Synthetic Construct
LYANHHS

SEQ ID NO: 10899 - protein, 7 aa, Artificial Sequence
  Synthetic Construct
ESVAGHM

SEQ ID NO: 10900 - protein, 7 aa, Artificial Sequence
  Synthetic Construct
EPRQDAH

SEQ ID NO: 10901 - protein, 7 aa, Artificial Sequence
  Synthetic Construct
SVGGTTQ

SEQ ID NO: 10902 - protein, 7 aa, Artificial Sequence
  Synthetic Construct
QPAMFNG

SEQ ID NO: 10903 - protein, 7 aa, Artificial Sequence
  Synthetic Construct
VKQTVMS

SEQ ID NO: 10904 - protein, 7 aa, Artificial Sequence
  Synthetic Construct
LYEQASK

SEQ ID NO: 10905 - protein, 7 aa, Artificial Sequence
  Synthetic Construct
INAAIAL

SEQ ID NO: 10906 - protein, 7 aa, Artificial Sequence
  Synthetic Construct
LELSHSR

SEQ ID NO: 10907 - protein, 7 aa, Artificial Sequence
  Synthetic Construct
SVKSIMN

SEQ ID NO: 10908 - protein, 7 aa, Artificial Sequence
  Synthetic Construct
VPNREPK

SEQ ID NO: 10909 - protein, 7 aa, Artificial Sequence
  Synthetic Construct
IASLLSR

SEQ ID NO: 10910 - protein, 7 aa, Artificial Sequence
  Synthetic Construct
ANNVADR

SEQ ID NO: 10911 - protein, 7 aa, Artificial Sequence
  Synthetic Construct
SVDRAER

SEQ ID NO: 10912 - protein, 7 aa, Artificial Sequence
  Synthetic Construct
VLADRVP

SEQ ID NO: 10913 - protein, 7 aa, Artificial Sequence
  Synthetic Construct
RTDSSHP

SEQ ID NO: 10914 - protein, 7 aa, Artificial Sequence
  Synthetic Construct
ILGTGGQ

SEQ ID NO: 10915 - protein, 7 aa, Artificial Sequence
  Synthetic Construct
STAQASY

SEQ ID NO: 10916 - protein, 7 aa, Artificial Sequence
  Synthetic Construct
VGPINTV

SEQ ID NO: 10917 - protein, 7 aa, Artificial Sequence
  Synthetic Construct
QTNNTVR

SEQ ID NO: 10918 - protein, 7 aa, Artificial Sequence
  Synthetic Construct
GNAVRST

SEQ ID NO: 10919 - protein, 7 aa, Artificial Sequence
  Synthetic Construct
QNLTKGQ

SEQ ID NO: 10920 - protein, 7 aa, Artificial Sequence
  Synthetic Construct
KQLSKDY

SEQ ID NO: 10921 - protein, 7 aa, Artificial Sequence
  Synthetic Construct
MVQNGLI

SEQ ID NO: 10922 - protein, 7 aa, Artificial Sequence
  Synthetic Construct
IVEHMPL

SEQ ID NO: 10923 - protein, 7 aa, Artificial Sequence
  Synthetic Construct
YDTTSIF

SEQ ID NO: 10924 - protein, 7 aa, Artificial Sequence
  Synthetic Construct
NSISSSA

SEQ ID NO: 10925 - protein, 7 aa, Artificial Sequence
  Synthetic Construct
GGNNSLH

SEQ ID NO: 10926 - protein, 7 aa, Artificial Sequence
  Synthetic Construct
ISGASLM

SEQ ID NO: 10927 - protein, 7 aa, Artificial Sequence
  Synthetic Construct
ATLSRNV

SEQ ID NO: 10928 - protein, 7 aa, Artificial Sequence
  Synthetic Construct
LANNVPL

SEQ ID NO: 10929 - protein, 7 aa, Artificial Sequence
  Synthetic Construct
WSDPSDL

SEQ ID NO: 10930 - protein, 7 aa, Artificial Sequence
  Synthetic Construct
SSLTDQP

SEQ ID NO: 10931 - protein, 7 aa, Artificial Sequence
  Synthetic Construct
YVPDHTR

SEQ ID NO: 10932 - protein, 7 aa, Artificial Sequence
  Synthetic Construct
NNTEGKA

SEQ ID NO: 10933 - protein, 7 aa, Artificial Sequence
  Synthetic Construct
GNSVRLI

SEQ ID NO: 10934 - protein, 7 aa, Artificial Sequence
  Synthetic Construct
IAQSNTL

SEQ ID NO: 10935 - protein, 7 aa, Artificial Sequence
  Synthetic Construct
HDNATKY

SEQ ID NO: 10936 - protein, 7 aa, Artificial Sequence
  Synthetic Construct
TKANEMQ

SEQ ID NO: 10937 - protein, 7 aa, Artificial Sequence
  Synthetic Construct
YLGTVVA

SEQ ID NO: 10938 - protein, 7 aa, Artificial Sequence
  Synthetic Construct
PSIELKP

SEQ ID NO: 10939 - protein, 7 aa, Artificial Sequence
  Synthetic Construct
AAGNVLM

SEQ ID NO: 10940 - protein, 7 aa, Artificial Sequence
  Synthetic Construct
TSVANLR

SEQ ID NO: 10941 - protein, 7 aa, Artificial Sequence
  Synthetic Construct
FSREPKP

SEQ ID NO: 10942 - protein, 7 aa, Artificial Sequence
  Synthetic Construct
TPRENWG

SEQ ID NO: 10943 - protein, 7 aa, Artificial Sequence
  Synthetic Construct
SQNVGTK

SEQ ID NO: 10944 - protein, 7 aa, Artificial Sequence
  Synthetic Construct
YLDKGRT

SEQ ID NO: 10945 - protein, 7 aa, Artificial Sequence
  Synthetic Construct
TSTTPFL

SEQ ID NO: 10946 - protein, 7 aa, Artificial Sequence
  Synthetic Construct
RQDNLEL

SEQ ID NO: 10947 - protein, 7 aa, Artificial Sequence
  Synthetic Construct
ISDSRVH

SEQ ID NO: 10948 - protein, 7 aa, Artificial Sequence
  Synthetic Construct
SQSSHYK

SEQ ID NO: 10949 - protein, 7 aa, Artificial Sequence
  Synthetic Construct
LNRVVSQ

SEQ ID NO: 10950 - protein, 7 aa, Artificial Sequence
  Synthetic Construct
MALDNSR

SEQ ID NO: 10951 - protein, 7 aa, Artificial Sequence
  Synthetic Construct
LIQSMAK

SEQ ID NO: 10952 - protein, 7 aa, Artificial Sequence
  Synthetic Construct
AGEPNSR

SEQ ID NO: 10953 - protein, 7 aa, Artificial Sequence
  Synthetic Construct
SNQSTVR

SEQ ID NO: 10954 - protein, 7 aa, Artificial Sequence
  Synthetic Construct
TSNLSER

SEQ ID NO: 10955 - protein, 7 aa, Artificial Sequence
  Synthetic Construct
SNSTSRA

SEQ ID NO: 10956 - protein, 7 aa, Artificial Sequence
  Synthetic Construct
MQQQFPS

SEQ ID NO: 10957 - protein, 7 aa, Artificial Sequence
  Synthetic Construct
FNTLAEV

SEQ ID NO: 10958 - protein, 7 aa, Artificial Sequence
  Synthetic Construct
PGVTVIS

SEQ ID NO: 10959 - protein, 7 aa, Artificial Sequence
  Synthetic Construct
LQNVHDS

SEQ ID NO: 10960 - protein, 7 aa, Artificial Sequence
  Synthetic Construct
NSVIGGS

SEQ ID NO: 10961 - protein, 7 aa, Artificial Sequence
  Synthetic Construct
NEGVRPL

SEQ ID NO: 10962 - protein, 7 aa, Artificial Sequence
  Synthetic Construct
SVNPSVV

SEQ ID NO: 10963 - protein, 7 aa, Artificial Sequence
  Synthetic Construct
MSTTSED

SEQ ID NO: 10964 - protein, 7 aa, Artificial Sequence
  Synthetic Construct
IHSGLPK

SEQ ID NO: 10965 - protein, 7 aa, Artificial Sequence
  Synthetic Construct
GMNGYPK

SEQ ID NO: 10966 - protein, 7 aa, Artificial Sequence
  Synthetic Construct
SIRDSVK

SEQ ID NO: 10967 - protein, 7 aa, Artificial Sequence
  Synthetic Construct
MLKPDNV

SEQ ID NO: 10968 - protein, 7 aa, Artificial Sequence
  Synthetic Construct
AFTSSLG

SEQ ID NO: 10969 - protein, 7 aa, Artificial Sequence
  Synthetic Construct
MLDKSSS

SEQ ID NO: 10970 - protein, 7 aa, Artificial Sequence
  Synthetic Construct
KTQNTQM

SEQ ID NO: 10971 - protein, 7 aa, Artificial Sequence
  Synthetic Construct
GTTSSMA

SEQ ID NO: 10972 - protein, 7 aa, Artificial Sequence
  Synthetic Construct
GSAASQA

SEQ ID NO: 10973 - protein, 7 aa, Artificial Sequence
  Synthetic Construct
AHSNIDS

SEQ ID NO: 10974 - protein, 7 aa, Artificial Sequence
  Synthetic Construct
GSASSLL

SEQ ID NO: 10975 - protein, 7 aa, Artificial Sequence
  Synthetic Construct
LSPNSSF

SEQ ID NO: 10976 - protein, 7 aa, Artificial Sequence
  Synthetic Construct
GHSVTPS

SEQ ID NO: 10977 - protein, 7 aa, Artificial Sequence
  Synthetic Construct
KGGNSID

SEQ ID NO: 10978 - protein, 7 aa, Artificial Sequence
  Synthetic Construct
LGPSPSA

SEQ ID NO: 10979 - protein, 7 aa, Artificial Sequence
  Synthetic Construct
QLPMLNA

SEQ ID NO: 10980 - protein, 7 aa, Artificial Sequence
  Synthetic Construct
ATNILTA

SEQ ID NO: 10981 - protein, 7 aa, Artificial Sequence
  Synthetic Construct
LMQNGQK

SEQ ID NO: 10982 - protein, 7 aa, Artificial Sequence
  Synthetic Construct
HNNGQAL

SEQ ID NO: 10983 - protein, 7 aa, Artificial Sequence
  Synthetic Construct
SITQTLS

SEQ ID NO: 10984 - protein, 7 aa, Artificial Sequence
  Synthetic Construct
GNRISNT

SEQ ID NO: 10985 - protein, 7 aa, Artificial Sequence
  Synthetic Construct
GPQNDPP

SEQ ID NO: 10986 - protein, 7 aa, Artificial Sequence
  Synthetic Construct
INGMGPN

SEQ ID NO: 10987 - protein, 7 aa, Artificial Sequence
  Synthetic Construct
TGNAHPN

SEQ ID NO: 10988 - protein, 7 aa, Artificial Sequence
  Synthetic Construct
YAVNLNN

SEQ ID NO: 10989 - protein, 7 aa, Artificial Sequence
  Synthetic Construct
ALISNST

SEQ ID NO: 10990 - protein, 7 aa, Artificial Sequence
  Synthetic Construct
SHVSTTM

SEQ ID NO: 10991 - protein, 7 aa, Artificial Sequence
  Synthetic Construct
LDDFVRP

SEQ ID NO: 10992 - protein, 7 aa, Artificial Sequence
  Synthetic Construct
NNTARSV

SEQ ID NO: 10993 - protein, 7 aa, Artificial Sequence
  Synthetic Construct
NKYPQPS

SEQ ID NO: 10994 - protein, 7 aa, Artificial Sequence
  Synthetic Construct
YASELFV

SEQ ID NO: 10995 - protein, 7 aa, Artificial Sequence
  Synthetic Construct
FYTANAS

SEQ ID NO: 10996 - protein, 7 aa, Artificial Sequence
  Synthetic Construct
FTKSNAT

SEQ ID NO: 10997 - protein, 7 aa, Artificial Sequence
  Synthetic Construct
LAVSQMR

SEQ ID NO: 10998 - protein, 7 aa, Artificial Sequence
  Synthetic Construct
RNGQLIV

SEQ ID NO: 10999 - protein, 7 aa, Artificial Sequence
  Synthetic Construct
DTANTAR

SEQ ID NO: 11000 - protein, 7 aa, Artificial Sequence
  Synthetic Construct
KPTEVQH

SEQ ID NO: 11001 - protein, 7 aa, Artificial Sequence
  Synthetic Construct
LTNAATY

SEQ ID NO: 11002 - protein, 7 aa, Artificial Sequence
  Synthetic Construct
ISNVQAN

SEQ ID NO: 11003 - protein, 7 aa, Artificial Sequence
  Synthetic Construct
ESRNNGF

SEQ ID NO: 11004 - protein, 7 aa, Artificial Sequence
  Synthetic Construct
STGPTMH

SEQ ID NO: 11005 - protein, 7 aa, Artificial Sequence
  Synthetic Construct
TPGESHK

SEQ ID NO: 11006 - protein, 7 aa, Artificial Sequence
  Synthetic Construct
SVSIASS

SEQ ID NO: 11007 - protein, 7 aa, Artificial Sequence
  Synthetic Construct
NGVTQSK

SEQ ID NO: 11008 - protein, 7 aa, Artificial Sequence
  Synthetic Construct
AKNTYAS

SEQ ID NO: 11009 - protein, 7 aa, Artificial Sequence
  Synthetic Construct
GTSDGHR

SEQ ID NO: 11010 - protein, 7 aa, Artificial Sequence
  Synthetic Construct
WSQNKGY

SEQ ID NO: 11011 - protein, 7 aa, Artificial Sequence
  Synthetic Construct
GQLARSV

SEQ ID NO: 11012 - protein, 7 aa, Artificial Sequence
  Synthetic Construct
IGGGAQK

SEQ ID NO: 11013 - protein, 7 aa, Artificial Sequence
  Synthetic Construct
AGNASHT

SEQ ID NO: 11014 - protein, 7 aa, Artificial Sequence
  Synthetic Construct
FNQVGKM

SEQ ID NO: 11015 - protein, 7 aa, Artificial Sequence
  Synthetic Construct
TRDTLYK

SEQ ID NO: 11016 - protein, 7 aa, Artificial Sequence
  Synthetic Construct
NGSPSYN

SEQ ID NO: 11017 - protein, 7 aa, Artificial Sequence
  Synthetic Construct
LAEAHAR

SEQ ID NO: 11018 - protein, 7 aa, Artificial Sequence
  Synthetic Construct
PMSNSER

SEQ ID NO: 11019 - protein, 7 aa, Artificial Sequence
  Synthetic Construct
HVTSLND

SEQ ID NO: 11020 - protein, 7 aa, Artificial Sequence
  Synthetic Construct
GAPHVSR

SEQ ID NO: 11021 - protein, 7 aa, Artificial Sequence
  Synthetic Construct
NTNGNSA

SEQ ID NO: 11022 - protein, 7 aa, Artificial Sequence
  Synthetic Construct
NELTGML

SEQ ID NO: 11023 - protein, 7 aa, Artificial Sequence
  Synthetic Construct
SSLLPAA

SEQ ID NO: 11024 - protein, 7 aa, Artificial Sequence
  Synthetic Construct
PVGQSLT

SEQ ID NO: 11025 - protein, 7 aa, Artificial Sequence
  Synthetic Construct
LTAAKGL

SEQ ID NO: 11026 - protein, 7 aa, Artificial Sequence
  Synthetic Construct
LIGRLTS

SEQ ID NO: 11027 - protein, 7 aa, Artificial Sequence
  Synthetic Construct
AKHNDNI

SEQ ID NO: 11028 - protein, 7 aa, Artificial Sequence
  Synthetic Construct
LRSGDEM

SEQ ID NO: 11029 - protein, 7 aa, Artificial Sequence
  Synthetic Construct
PQNSTTA

SEQ ID NO: 11030 - protein, 7 aa, Artificial Sequence
  Synthetic Construct
LATGPLF

SEQ ID NO: 11031 - protein, 7 aa, Artificial Sequence
  Synthetic Construct
ASAVSQK

SEQ ID NO: 11032 - protein, 7 aa, Artificial Sequence
  Synthetic Construct
APVSSAL

SEQ ID NO: 11033 - protein, 7 aa, Artificial Sequence
  Synthetic Construct
TMPSLDS

SEQ ID NO: 11034 - protein, 7 aa, Artificial Sequence
  Synthetic Construct
HMNFPNP

SEQ ID NO: 11035 - protein, 7 aa, Artificial Sequence
  Synthetic Construct
ASARMDA

SEQ ID NO: 11036 - protein, 7 aa, Artificial Sequence
  Synthetic Construct
TVIVGGR

SEQ ID NO: 11037 - protein, 7 aa, Artificial Sequence
  Synthetic Construct
SSQSQTV

SEQ ID NO: 11038 - protein, 7 aa, Artificial Sequence
  Synthetic Construct
INTTSQK

SEQ ID NO: 11039 - protein, 7 aa, Artificial Sequence
  Synthetic Construct
AGARVTE

SEQ ID NO: 11040 - protein, 7 aa, Artificial Sequence
  Synthetic Construct
PAPHSGS

SEQ ID NO: 11041 - protein, 7 aa, Artificial Sequence
  Synthetic Construct
LNVMYNP

SEQ ID NO: 11042 - protein, 7 aa, Artificial Sequence
  Synthetic Construct
GHAQTLY

SEQ ID NO: 11043 - protein, 7 aa, Artificial Sequence
  Synthetic Construct
TPNLSTH

SEQ ID NO: 11044 - protein, 7 aa, Artificial Sequence
  Synthetic Construct
SAERTNV

SEQ ID NO: 11045 - protein, 7 aa, Artificial Sequence
  Synthetic Construct
NNLRPVY

SEQ ID NO: 11046 - protein, 7 aa, Artificial Sequence
  Synthetic Construct
NQQSAYT

SEQ ID NO: 11047 - protein, 7 aa, Artificial Sequence
  Synthetic Construct
VVDGKTQ

SEQ ID NO: 11048 - protein, 7 aa, Artificial Sequence
  Synthetic Construct
PLPQQLD

SEQ ID NO: 11049 - protein, 7 aa, Artificial Sequence
  Synthetic Construct
VAEIVQL

SEQ ID NO: 11050 - protein, 7 aa, Artificial Sequence
  Synthetic Construct
DRNTTVR

SEQ ID NO: 11051 - protein, 7 aa, Artificial Sequence
  Synthetic Construct
NMMKTGM

SEQ ID NO: 11052 - protein, 7 aa, Artificial Sequence
  Synthetic Construct
VQFNTSK

SEQ ID NO: 11053 - protein, 7 aa, Artificial Sequence
  Synthetic Construct
PGNASIR

SEQ ID NO: 11054 - protein, 7 aa, Artificial Sequence
  Synthetic Construct
LGGILSA

SEQ ID NO: 11055 - protein, 7 aa, Artificial Sequence
  Synthetic Construct
QTDHSHL

SEQ ID NO: 11056 - protein, 7 aa, Artificial Sequence
  Synthetic Construct
TLHAEFS

SEQ ID NO: 11057 - protein, 7 aa, Artificial Sequence
  Synthetic Construct
LSDRLNA

SEQ ID NO: 11058 - protein, 7 aa, Artificial Sequence
  Synthetic Construct
LNERIGG

SEQ ID NO: 11059 - protein, 7 aa, Artificial Sequence
  Synthetic Construct
TLNSTAS

SEQ ID NO: 11060 - protein, 7 aa, Artificial Sequence
  Synthetic Construct
SGRVVAQ

SEQ ID NO: 11061 - protein, 7 aa, Artificial Sequence
  Synthetic Construct
NNRTTNN

SEQ ID NO: 11062 - protein, 7 aa, Artificial Sequence
  Synthetic Construct
NVPSSTY

SEQ ID NO: 11063 - protein, 7 aa, Artificial Sequence
  Synthetic Construct
VPSTALK

SEQ ID NO: 11064 - protein, 7 aa, Artificial Sequence
  Synthetic Construct
PPNTQSL

SEQ ID NO: 11065 - protein, 7 aa, Artificial Sequence
  Synthetic Construct
TNTTRAM

SEQ ID NO: 11066 - protein, 7 aa, Artificial Sequence
  Synthetic Construct
SNRTVRE

SEQ ID NO: 11067 - protein, 7 aa, Artificial Sequence
  Synthetic Construct
ASTQIMR

SEQ ID NO: 11068 - protein, 7 aa, Artificial Sequence
  Synthetic Construct
TVISSSR

SEQ ID NO: 11069 - protein, 7 aa, Artificial Sequence
  Synthetic Construct
VYSPQGT

SEQ ID NO: 11070 - protein, 7 aa, Artificial Sequence
  Synthetic Construct
GSPTQSM

SEQ ID NO: 11071 - protein, 7 aa, Artificial Sequence
  Synthetic Construct
AVSSEAR

SEQ ID NO: 11072 - protein, 7 aa, Artificial Sequence
  Synthetic Construct
GSVATLT

SEQ ID NO: 11073 - protein, 7 aa, Artificial Sequence
  Synthetic Construct
SANTGTG

SEQ ID NO: 11074 - protein, 7 aa, Artificial Sequence
  Synthetic Construct
IVQGTSM

SEQ ID NO: 11075 - protein, 7 aa, Artificial Sequence
  Synthetic Construct
TPSLGVL

SEQ ID NO: 11076 - protein, 7 aa, Artificial Sequence
  Synthetic Construct
PNMMGSS

SEQ ID NO: 11077 - protein, 7 aa, Artificial Sequence
  Synthetic Construct
LTQSPAP

SEQ ID NO: 11078 - protein, 7 aa, Artificial Sequence
  Synthetic Construct
KGSNSTL

SEQ ID NO: 11079 - protein, 7 aa, Artificial Sequence
  Synthetic Construct
PMAAAPR

SEQ ID NO: 11080 - protein, 7 aa, Artificial Sequence
  Synthetic Construct
VTTGPSR

SEQ ID NO: 11081 - protein, 7 aa, Artificial Sequence
  Synthetic Construct
VVSPLSY

SEQ ID NO: 11082 - protein, 7 aa, Artificial Sequence
  Synthetic Construct
VTGSVQK

SEQ ID NO: 11083 - protein, 7 aa, Artificial Sequence
  Synthetic Construct
GGTTVQT

SEQ ID NO: 11084 - protein, 7 aa, Artificial Sequence
  Synthetic Construct
NSAQINM

SEQ ID NO: 11085 - protein, 7 aa, Artificial Sequence
  Synthetic Construct
PGTQKPT

SEQ ID NO: 11086 - protein, 7 aa, Artificial Sequence
  Synthetic Construct
GKASHYP

SEQ ID NO: 11087 - protein, 7 aa, Artificial Sequence
  Synthetic Construct
YNSVPSA

SEQ ID NO: 11088 - protein, 7 aa, Artificial Sequence
  Synthetic Construct
VYERVSH

SEQ ID NO: 11089 - protein, 7 aa, Artificial Sequence
  Synthetic Construct
DVNNRSM

SEQ ID NO: 11090 - protein, 7 aa, Artificial Sequence
  Synthetic Construct
PHAVSML

SEQ ID NO: 11091 - protein, 7 aa, Artificial Sequence
  Synthetic Construct
GMPAPLG

SEQ ID NO: 11092 - protein, 7 aa, Artificial Sequence
  Synthetic Construct
QLQINPA

SEQ ID NO: 11093 - protein, 7 aa, Artificial Sequence
  Synthetic Construct
TMDLSPP

SEQ ID NO: 11094 - protein, 7 aa, Artificial Sequence
  Synthetic Construct
TTDLHAK

SEQ ID NO: 11095 - protein, 7 aa, Artificial Sequence
  Synthetic Construct
HHTTQTT

SEQ ID NO: 11096 - protein, 7 aa, Artificial Sequence
  Synthetic Construct
PSSNSTN

SEQ ID NO: 11097 - protein, 7 aa, Artificial Sequence
  Synthetic Construct
TRYNVDP

SEQ ID NO: 11098 - protein, 7 aa, Artificial Sequence
  Synthetic Construct
SVVSLSP

SEQ ID NO: 11099 - protein, 7 aa, Artificial Sequence
  Synthetic Construct
EKVDQLR

SEQ ID NO: 11100 - protein, 7 aa, Artificial Sequence
  Synthetic Construct
SDSRQTL

SEQ ID NO: 11101 - protein, 7 aa, Artificial Sequence
  Synthetic Construct
TYPATSD

SEQ ID NO: 11102 - protein, 7 aa, Artificial Sequence
  Synthetic Construct
SMNVGSA

SEQ ID NO: 11103 - protein, 7 aa, Artificial Sequence
  Synthetic Construct
LESSNAI

SEQ ID NO: 11104 - protein, 7 aa, Artificial Sequence
  Synthetic Construct
SPTNHAP

SEQ ID NO: 11105 - protein, 7 aa, Artificial Sequence
  Synthetic Construct
AHEGMVK

SEQ ID NO: 11106 - protein, 7 aa, Artificial Sequence
  Synthetic Construct
VDTLLSK

SEQ ID NO: 11107 - protein, 7 aa, Artificial Sequence
  Synthetic Construct
TAGQLTW

SEQ ID NO: 11108 - protein, 7 aa, Artificial Sequence
  Synthetic Construct
MGMDGQI

SEQ ID NO: 11109 - protein, 7 aa, Artificial Sequence
  Synthetic Construct
ELENGRR

SEQ ID NO: 11110 - protein, 7 aa, Artificial Sequence
  Synthetic Construct
LDLSVSR

SEQ ID NO: 11111 - protein, 7 aa, Artificial Sequence
  Synthetic Construct
SQHPNMT

SEQ ID NO: 11112 - protein, 7 aa, Artificial Sequence
  Synthetic Construct
YHEVSEH

SEQ ID NO: 11113 - protein, 7 aa, Artificial Sequence
  Synthetic Construct
MRSPPPT

SEQ ID NO: 11114 - protein, 7 aa, Artificial Sequence
  Synthetic Construct
GSGSSTI

SEQ ID NO: 11115 - protein, 7 aa, Artificial Sequence
  Synthetic Construct
GGDAGRW

SEQ ID NO: 11116 - protein, 7 aa, Artificial Sequence
  Synthetic Construct
KAEAMVI

SEQ ID NO: 11117 - protein, 7 aa, Artificial Sequence
  Synthetic Construct
ANKDLGV

SEQ ID NO: 11118 - protein, 7 aa, Artificial Sequence
  Synthetic Construct
TSSENRT

SEQ ID NO: 11119 - protein, 7 aa, Artificial Sequence
  Synthetic Construct
GPDRTAA

SEQ ID NO: 11120 - protein, 7 aa, Artificial Sequence
  Synthetic Construct
GSTVVHL

SEQ ID NO: 11121 - protein, 7 aa, Artificial Sequence
  Synthetic Construct
TAVVVPQ

SEQ ID NO: 11122 - protein, 7 aa, Artificial Sequence
  Synthetic Construct
AVNIANA

SEQ ID NO: 11123 - protein, 7 aa, Artificial Sequence
  Synthetic Construct
LLSQSGV

SEQ ID NO: 11124 - protein, 7 aa, Artificial Sequence
  Synthetic Construct
HTGEGKL

SEQ ID NO: 11125 - protein, 7 aa, Artificial Sequence
  Synthetic Construct
SNGNNIR

SEQ ID NO: 11126 - protein, 7 aa, Artificial Sequence
  Synthetic Construct
EVTLMHK

SEQ ID NO: 11127 - protein, 7 aa, Artificial Sequence
  Synthetic Construct
LTTTGSN

SEQ ID NO: 11128 - protein, 7 aa, Artificial Sequence
  Synthetic Construct
DISGKIA

SEQ ID NO: 11129 - protein, 7 aa, Artificial Sequence
  Synthetic Construct
ISPNVYS

SEQ ID NO: 11130 - protein, 7 aa, Artificial Sequence
  Synthetic Construct
YNKLVDG

SEQ ID NO: 11131 - protein, 7 aa, Artificial Sequence
  Synthetic Construct
FHTHPTS

SEQ ID NO: 11132 - protein, 7 aa, Artificial Sequence
  Synthetic Construct
PTLEATS

SEQ ID NO: 11133 - protein, 7 aa, Artificial Sequence
  Synthetic Construct
ELGRNGP

SEQ ID NO: 11134 - protein, 7 aa, Artificial Sequence
  Synthetic Construct
VDKVERL

SEQ ID NO: 11135 - protein, 7 aa, Artificial Sequence
  Synthetic Construct
TTTMTPR

SEQ ID NO: 11136 - protein, 7 aa, Artificial Sequence
  Synthetic Construct
LQQIPTP

SEQ ID NO: 11137 - protein, 7 aa, Artificial Sequence
  Synthetic Construct
TDSNSLQ

SEQ ID NO: 11138 - protein, 7 aa, Artificial Sequence
  Synthetic Construct
DDRSVRF

SEQ ID NO: 11139 - protein, 7 aa, Artificial Sequence
  Synthetic Construct
LATQNAS

SEQ ID NO: 11140 - protein, 7 aa, Artificial Sequence
  Synthetic Construct
VGTHIHS

SEQ ID NO: 11141 - protein, 7 aa, Artificial Sequence
  Synthetic Construct
SERSSVK

SEQ ID NO: 11142 - protein, 7 aa, Artificial Sequence
  Synthetic Construct
GYAHSMI

SEQ ID NO: 11143 - protein, 7 aa, Artificial Sequence
  Synthetic Construct
PLSGGVR

SEQ ID NO: 11144 - protein, 7 aa, Artificial Sequence
  Synthetic Construct
LTYVASS

SEQ ID NO: 11145 - protein, 7 aa, Artificial Sequence
  Synthetic Construct
VDKTLSR

SEQ ID NO: 11146 - protein, 7 aa, Artificial Sequence
  Synthetic Construct
PNLVGVP

SEQ ID NO: 11147 - protein, 7 aa, Artificial Sequence
  Synthetic Construct
TKIDTVR

SEQ ID NO: 11148 - protein, 7 aa, Artificial Sequence
  Synthetic Construct
SGGTQAR

SEQ ID NO: 11149 - protein, 7 aa, Artificial Sequence
  Synthetic Construct
HSTPLVS

SEQ ID NO: 11150 - protein, 7 aa, Artificial Sequence
  Synthetic Construct
HSGTNLR

SEQ ID NO: 11151 - protein, 7 aa, Artificial Sequence
  Synthetic Construct
AQPRLVT

SEQ ID NO: 11152 - protein, 7 aa, Artificial Sequence
  Synthetic Construct
PLGAHGS

SEQ ID NO: 11153 - protein, 7 aa, Artificial Sequence
  Synthetic Construct
ISDASVL

SEQ ID NO: 11154 - protein, 7 aa, Artificial Sequence
  Synthetic Construct
MSVGVKT

SEQ ID NO: 11155 - protein, 7 aa, Artificial Sequence
  Synthetic Construct
NIAEGLS

SEQ ID NO: 11156 - protein, 7 aa, Artificial Sequence
  Synthetic Construct
SSNSDGI

SEQ ID NO: 11157 - protein, 7 aa, Artificial Sequence
  Synthetic Construct
VGQTTNS

SEQ ID NO: 11158 - protein, 7 aa, Artificial Sequence
  Synthetic Construct
ESKRPFL

SEQ ID NO: 11159 - protein, 7 aa, Artificial Sequence
  Synthetic Construct
SQENSRT

SEQ ID NO: 11160 - protein, 7 aa, Artificial Sequence
  Synthetic Construct
NTGTDHP

SEQ ID NO: 11161 - protein, 7 aa, Artificial Sequence
  Synthetic Construct
GNWVKDI

SEQ ID NO: 11162 - protein, 7 aa, Artificial Sequence
  Synthetic Construct
RLTETVT

SEQ ID NO: 11163 - protein, 7 aa, Artificial Sequence
  Synthetic Construct
GEIGVLY

SEQ ID NO: 11164 - protein, 7 aa, Artificial Sequence
  Synthetic Construct
LAPEPLK

SEQ ID NO: 11165 - protein, 7 aa, Artificial Sequence
  Synthetic Construct
NKLPPAL

SEQ ID NO: 11166 - protein, 7 aa, Artificial Sequence
  Synthetic Construct
NIGTRDA

SEQ ID NO: 11167 - protein, 7 aa, Artificial Sequence
  Synthetic Construct
TVRELQP

SEQ ID NO: 11168 - protein, 7 aa, Artificial Sequence
  Synthetic Construct
ENHGTTS

SEQ ID NO: 11169 - protein, 7 aa, Artificial Sequence
  Synthetic Construct
HTDRNYV

SEQ ID NO: 11170 - protein, 7 aa, Artificial Sequence
  Synthetic Construct
TVGPTSH

SEQ ID NO: 11171 - protein, 7 aa, Artificial Sequence
  Synthetic Construct
GLVKDHP

SEQ ID NO: 11172 - protein, 7 aa, Artificial Sequence
  Synthetic Construct
INALTNG

SEQ ID NO: 11173 - protein, 7 aa, Artificial Sequence
  Synthetic Construct
PLDSNRD

SEQ ID NO: 11174 - protein, 7 aa, Artificial Sequence
  Synthetic Construct
LKVTKID

SEQ ID NO: 11175 - protein, 7 aa, Artificial Sequence
  Synthetic Construct
HNSNPGL

SEQ ID NO: 11176 - protein, 7 aa, Artificial Sequence
  Synthetic Construct
TTVILKT

SEQ ID NO: 11177 - protein, 7 aa, Artificial Sequence
  Synthetic Construct
LGKGMTA

SEQ ID NO: 11178 - protein, 7 aa, Artificial Sequence
  Synthetic Construct
FSISDLK

SEQ ID NO: 11179 - protein, 7 aa, Artificial Sequence
  Synthetic Construct
STDTHLP

SEQ ID NO: 11180 - protein, 7 aa, Artificial Sequence
  Synthetic Construct
LNAVKNV

SEQ ID NO: 11181 - protein, 7 aa, Artificial Sequence
  Synthetic Construct
RSTPNTI

SEQ ID NO: 11182 - protein, 7 aa, Artificial Sequence
  Synthetic Construct
LSIKLQN

SEQ ID NO: 11183 - protein, 7 aa, Artificial Sequence
  Synthetic Construct
SLAITSS

SEQ ID NO: 11184 - protein, 7 aa, Artificial Sequence
  Synthetic Construct
RQDITIA

SEQ ID NO: 11185 - protein, 7 aa, Artificial Sequence
  Synthetic Construct
GNATPRS

SEQ ID NO: 11186 - protein, 7 aa, Artificial Sequence
  Synthetic Construct
SLVGTTS

SEQ ID NO: 11187 - protein, 7 aa, Artificial Sequence
  Synthetic Construct
WQTQDKE

SEQ ID NO: 11188 - protein, 7 aa, Artificial Sequence
  Synthetic Construct
TPNVPSP

SEQ ID NO: 11189 - protein, 7 aa, Artificial Sequence
  Synthetic Construct
INTISPK

SEQ ID NO: 11190 - protein, 7 aa, Artificial Sequence
  Synthetic Construct
PLGTSNT

SEQ ID NO: 11191 - protein, 7 aa, Artificial Sequence
  Synthetic Construct
SQVNGGK

SEQ ID NO: 11192 - protein, 7 aa, Artificial Sequence
  Synthetic Construct
PINDKVM

SEQ ID NO: 11193 - protein, 7 aa, Artificial Sequence
  Synthetic Construct
NVSSSIL

SEQ ID NO: 11194 - protein, 7 aa, Artificial Sequence
  Synthetic Construct
QANWTAS

SEQ ID NO: 11195 - protein, 7 aa, Artificial Sequence
  Synthetic Construct
RPENHSS

SEQ ID NO: 11196 - protein, 7 aa, Artificial Sequence
  Synthetic Construct
TRNLDVH

SEQ ID NO: 11197 - protein, 7 aa, Artificial Sequence
  Synthetic Construct
INSSFSK

SEQ ID NO: 11198 - protein, 7 aa, Artificial Sequence
  Synthetic Construct
SIQGSQR

SEQ ID NO: 11199 - protein, 7 aa, Artificial Sequence
  Synthetic Construct
VVAVGQF

SEQ ID NO: 11200 - protein, 7 aa, Artificial Sequence
  Synthetic Construct
VNKVRDV

SEQ ID NO: 11201 - protein, 7 aa, Artificial Sequence
  Synthetic Construct
KPNAQIQ

SEQ ID NO: 11202 - protein, 7 aa, Artificial Sequence
  Synthetic Construct
MSIGTGS

SEQ ID NO: 11203 - protein, 7 aa, Artificial Sequence
  Synthetic Construct
GLQATYS

SEQ ID NO: 11204 - protein, 7 aa, Artificial Sequence
  Synthetic Construct
QTLSASS

SEQ ID NO: 11205 - protein, 7 aa, Artificial Sequence
  Synthetic Construct
DPPNKFP

SEQ ID NO: 11206 - protein, 7 aa, Artificial Sequence
  Synthetic Construct
RISTLGL

SEQ ID NO: 11207 - protein, 7 aa, Artificial Sequence
  Synthetic Construct
NSDRSVS

SEQ ID NO: 11208 - protein, 7 aa, Artificial Sequence
  Synthetic Construct
YNLRLGG

SEQ ID NO: 11209 - protein, 7 aa, Artificial Sequence
  Synthetic Construct
VQDRAMT

SEQ ID NO: 11210 - protein, 7 aa, Artificial Sequence
  Synthetic Construct
SSSTLPR

SEQ ID NO: 11211 - protein, 7 aa, Artificial Sequence
  Synthetic Construct
GGVQTDS

SEQ ID NO: 11212 - protein, 7 aa, Artificial Sequence
  Synthetic Construct
LLSNNTR

SEQ ID NO: 11213 - protein, 7 aa, Artificial Sequence
  Synthetic Construct
YHAAQAV

SEQ ID NO: 11214 - protein, 7 aa, Artificial Sequence
  Synthetic Construct
MSGVGSS

SEQ ID NO: 11215 - protein, 7 aa, Artificial Sequence
  Synthetic Construct
LTGQVLV

SEQ ID NO: 11216 - protein, 7 aa, Artificial Sequence
  Synthetic Construct
AVNRLPI

SEQ ID NO: 11217 - protein, 7 aa, Artificial Sequence
  Synthetic Construct
SSQMPLR

SEQ ID NO: 11218 - protein, 7 aa, Artificial Sequence
  Synthetic Construct
SSNIADS

SEQ ID NO: 11219 - protein, 7 aa, Artificial Sequence
  Synthetic Construct
VVTPQIS

SEQ ID NO: 11220 - protein, 7 aa, Artificial Sequence
  Synthetic Construct
DSKKMSW

SEQ ID NO: 11221 - protein, 7 aa, Artificial Sequence
  Synthetic Construct
ETYKTTL

SEQ ID NO: 11222 - protein, 7 aa, Artificial Sequence
  Synthetic Construct
LTMGNSL

SEQ ID NO: 11223 - protein, 7 aa, Artificial Sequence
  Synthetic Construct
FKVSIQQ

SEQ ID NO: 11224 - protein, 7 aa, Artificial Sequence
  Synthetic Construct
DGHAHLP

SEQ ID NO: 11225 - protein, 7 aa, Artificial Sequence
  Synthetic Construct
TAVSLSN

SEQ ID NO: 11226 - protein, 7 aa, Artificial Sequence
  Synthetic Construct
SQNQMQT

SEQ ID NO: 11227 - protein, 7 aa, Artificial Sequence
  Synthetic Construct
QSVTTQH

SEQ ID NO: 11228 - protein, 7 aa, Artificial Sequence
  Synthetic Construct
LSTALTV

SEQ ID NO: 11229 - protein, 7 aa, Artificial Sequence
  Synthetic Construct
LANAVTK

SEQ ID NO: 11230 - protein, 7 aa, Artificial Sequence
  Synthetic Construct
TGHVHEN

SEQ ID NO: 11231 - protein, 7 aa, Artificial Sequence
  Synthetic Construct
SISDTAS

SEQ ID NO: 11232 - protein, 7 aa, Artificial Sequence
  Synthetic Construct
PVVQSVG

SEQ ID NO: 11233 - protein, 7 aa, Artificial Sequence
  Synthetic Construct
QHLSTVN

SEQ ID NO: 11234 - protein, 7 aa, Artificial Sequence
  Synthetic Construct
LSHNTTH

SEQ ID NO: 11235 - protein, 7 aa, Artificial Sequence
  Synthetic Construct
PSNFSNS

SEQ ID NO: 11236 - protein, 7 aa, Artificial Sequence
  Synthetic Construct
FDKSVPS

SEQ ID NO: 11237 - protein, 7 aa, Artificial Sequence
  Synthetic Construct
TQATEKD

SEQ ID NO: 11238 - protein, 7 aa, Artificial Sequence
  Synthetic Construct
LSAKASQ

SEQ ID NO: 11239 - protein, 7 aa, Artificial Sequence
  Synthetic Construct
SVQPAVS

SEQ ID NO: 11240 - protein, 7 aa, Artificial Sequence
  Synthetic Construct
SLMHGTP

SEQ ID NO: 11241 - protein, 7 aa, Artificial Sequence
  Synthetic Construct
PTIRTNT

SEQ ID NO: 11242 - protein, 7 aa, Artificial Sequence
  Synthetic Construct
NDSLKVN

SEQ ID NO: 11243 - protein, 7 aa, Artificial Sequence
  Synthetic Construct
STQPVNR

SEQ ID NO: 11244 - protein, 7 aa, Artificial Sequence
  Synthetic Construct
SSDKHNP

SEQ ID NO: 11245 - protein, 7 aa, Artificial Sequence
  Synthetic Construct
FLENAKI

SEQ ID NO: 11246 - protein, 7 aa, Artificial Sequence
  Synthetic Construct
VSTGTLK

SEQ ID NO: 11247 - protein, 7 aa, Artificial Sequence
  Synthetic Construct
RDASLST

SEQ ID NO: 11248 - protein, 7 aa, Artificial Sequence
  Synthetic Construct
KGTEIKL

SEQ ID NO: 11249 - protein, 7 aa, Artificial Sequence
  Synthetic Construct
IMNQLGD

SEQ ID NO: 11250 - protein, 7 aa, Artificial Sequence
  Synthetic Construct
PSNNTQI

SEQ ID NO: 11251 - protein, 7 aa, Artificial Sequence
  Synthetic Construct
TSSSITT

SEQ ID NO: 11252 - protein, 7 aa, Artificial Sequence
  Synthetic Construct
RDLNAHN

SEQ ID NO: 11253 - protein, 7 aa, Artificial Sequence
  Synthetic Construct
TGFARSE

SEQ ID NO: 11254 - protein, 7 aa, Artificial Sequence
  Synthetic Construct
LEQLAPK

SEQ ID NO: 11255 - protein, 7 aa, Artificial Sequence
  Synthetic Construct
AAMQSER

SEQ ID NO: 11256 - protein, 7 aa, Artificial Sequence
  Synthetic Construct
QLNYEAH

SEQ ID NO: 11257 - protein, 7 aa, Artificial Sequence
  Synthetic Construct
ANPGSLL

SEQ ID NO: 11258 - protein, 7 aa, Artificial Sequence
  Synthetic Construct
LRHIETP

SEQ ID NO: 11259 - protein, 7 aa, Artificial Sequence
  Synthetic Construct
LPQNSAK

SEQ ID NO: 11260 - protein, 7 aa, Artificial Sequence
  Synthetic Construct
AGSPISR

SEQ ID NO: 11261 - protein, 7 aa, Artificial Sequence
  Synthetic Construct
RATNVEV

SEQ ID NO: 11262 - protein, 7 aa, Artificial Sequence
  Synthetic Construct
PQPNNRG

SEQ ID NO: 11263 - protein, 7 aa, Artificial Sequence
  Synthetic Construct
SPSTPHL

SEQ ID NO: 11264 - protein, 7 aa, Artificial Sequence
  Synthetic Construct
LSNTLTN

SEQ ID NO: 11265 - protein, 7 aa, Artificial Sequence
  Synthetic Construct
SNREGLM

SEQ ID NO: 11266 - protein, 7 aa, Artificial Sequence
  Synthetic Construct
VAHSPPS

SEQ ID NO: 11267 - protein, 7 aa, Artificial Sequence
  Synthetic Construct
SVKNMLT

SEQ ID NO: 11268 - protein, 7 aa, Artificial Sequence
  Synthetic Construct
GLSTGLA

SEQ ID NO: 11269 - protein, 7 aa, Artificial Sequence
  Synthetic Construct
AMSRPEL

SEQ ID NO: 11270 - protein, 7 aa, Artificial Sequence
  Synthetic Construct
AMDLKLQ

SEQ ID NO: 11271 - protein, 7 aa, Artificial Sequence
  Synthetic Construct
AVAGPTK

SEQ ID NO: 11272 - protein, 7 aa, Artificial Sequence
  Synthetic Construct
PTLGSRT

SEQ ID NO: 11273 - protein, 7 aa, Artificial Sequence
  Synthetic Construct
SENPIDP

SEQ ID NO: 11274 - protein, 7 aa, Artificial Sequence
  Synthetic Construct
TNNSPGT

SEQ ID NO: 11275 - protein, 7 aa, Artificial Sequence
  Synthetic Construct
HTSPTSL

SEQ ID NO: 11276 - protein, 7 aa, Artificial Sequence
  Synthetic Construct
NNAGISM

SEQ ID NO: 11277 - protein, 7 aa, Artificial Sequence
  Synthetic Construct
LVYSNNT

SEQ ID NO: 11278 - protein, 7 aa, Artificial Sequence
  Synthetic Construct
PASQSTT

SEQ ID NO: 11279 - protein, 7 aa, Artificial Sequence
  Synthetic Construct
VQVGHPL

SEQ ID NO: 11280 - protein, 7 aa, Artificial Sequence
  Synthetic Construct
DASYTGT

SEQ ID NO: 11281 - protein, 7 aa, Artificial Sequence
  Synthetic Construct
GITTEAR

SEQ ID NO: 11282 - protein, 7 aa, Artificial Sequence
  Synthetic Construct
SMPQHAI

SEQ ID NO: 11283 - protein, 7 aa, Artificial Sequence
  Synthetic Construct
LQSALQN

SEQ ID NO: 11284 - protein, 7 aa, Artificial Sequence
  Synthetic Construct
KSSDSTS

SEQ ID NO: 11285 - protein, 7 aa, Artificial Sequence
  Synthetic Construct
KSPAGAL

SEQ ID NO: 11286 - protein, 7 aa, Artificial Sequence
  Synthetic Construct
TEMSLTS

SEQ ID NO: 11287 - protein, 7 aa, Artificial Sequence
  Synthetic Construct
LNSETFP

SEQ ID NO: 11288 - protein, 7 aa, Artificial Sequence
  Synthetic Construct
SALSQQY

SEQ ID NO: 11289 - protein, 7 aa, Artificial Sequence
  Synthetic Construct
RSVANVP

SEQ ID NO: 11290 - protein, 7 aa, Artificial Sequence
  Synthetic Construct
SSGATLQ

SEQ ID NO: 11291 - protein, 7 aa, Artificial Sequence
  Synthetic Construct
LNGGAAS

SEQ ID NO: 11292 - protein, 7 aa, Artificial Sequence
  Synthetic Construct
SHQTTPT

SEQ ID NO: 11293 - protein, 7 aa, Artificial Sequence
  Synthetic Construct
YENSSSL

SEQ ID NO: 11294 - protein, 7 aa, Artificial Sequence
  Synthetic Construct
IQTSAHT

SEQ ID NO: 11295 - protein, 7 aa, Artificial Sequence
  Synthetic Construct
REIQKMS

SEQ ID NO: 11296 - protein, 7 aa, Artificial Sequence
  Synthetic Construct
SAGMISH

SEQ ID NO: 11297 - protein, 7 aa, Artificial Sequence
  Synthetic Construct
MRSTDSE

SEQ ID NO: 11298 - protein, 7 aa, Artificial Sequence
  Synthetic Construct
SHPQGDS

SEQ ID NO: 11299 - protein, 7 aa, Artificial Sequence
  Synthetic Construct
LIDTKIS

SEQ ID NO: 11300 - protein, 7 aa, Artificial Sequence
  Synthetic Construct
THLKDLL

SEQ ID NO: 11301 - protein, 7 aa, Artificial Sequence
  Synthetic Construct
GTSSVLI

SEQ ID NO: 11302 - protein, 7 aa, Artificial Sequence
  Synthetic Construct
PLVTNEP

SEQ ID NO: 11303 - protein, 7 aa, Artificial Sequence
  Synthetic Construct
RDLSHNS

SEQ ID NO: 11304 - protein, 7 aa, Artificial Sequence
  Synthetic Construct
YDNEHRP

SEQ ID NO: 11305 - protein, 7 aa, Artificial Sequence
  Synthetic Construct
VGSHTMT

SEQ ID NO: 11306 - protein, 7 aa, Artificial Sequence
  Synthetic Construct
GHTSVSL

SEQ ID NO: 11307 - protein, 7 aa, Artificial Sequence
  Synthetic Construct
LDLKNQR

SEQ ID NO: 11308 - protein, 7 aa, Artificial Sequence
  Synthetic Construct
PVAKITS

SEQ ID NO: 11309 - protein, 7 aa, Artificial Sequence
  Synthetic Construct
LENGKPK

SEQ ID NO: 11310 - protein, 7 aa, Artificial Sequence
  Synthetic Construct
DLARATL

SEQ ID NO: 11311 - protein, 7 aa, Artificial Sequence
  Synthetic Construct
KVRDDKP

SEQ ID NO: 11312 - protein, 7 aa, Artificial Sequence
  Synthetic Construct
HNVAITP

SEQ ID NO: 11313 - protein, 7 aa, Artificial Sequence
  Synthetic Construct
TFNATYA

SEQ ID NO: 11314 - protein, 7 aa, Artificial Sequence
  Synthetic Construct
GSQGTIR

SEQ ID NO: 11315 - protein, 7 aa, Artificial Sequence
  Synthetic Construct
SLGHDAR

SEQ ID NO: 11316 - protein, 7 aa, Artificial Sequence
  Synthetic Construct
RSGPDSS

SEQ ID NO: 11317 - protein, 7 aa, Artificial Sequence
  Synthetic Construct
AMNLQNL

SEQ ID NO: 11318 - protein, 7 aa, Artificial Sequence
  Synthetic Construct
LRAGPGV

SEQ ID NO: 11319 - protein, 7 aa, Artificial Sequence
  Synthetic Construct
TVMSSSS

SEQ ID NO: 11320 - protein, 7 aa, Artificial Sequence
  Synthetic Construct
HTSPVGY

SEQ ID NO: 11321 - protein, 7 aa, Artificial Sequence
  Synthetic Construct
WTSQATA

SEQ ID NO: 11322 - protein, 7 aa, Artificial Sequence
  Synthetic Construct
TMNSVPR

SEQ ID NO: 11323 - protein, 7 aa, Artificial Sequence
  Synthetic Construct
VNGGMVN

SEQ ID NO: 11324 - protein, 7 aa, Artificial Sequence
  Synthetic Construct
TNARMNT

SEQ ID NO: 11325 - protein, 7 aa, Artificial Sequence
  Synthetic Construct
ISGNMHS

SEQ ID NO: 11326 - protein, 7 aa, Artificial Sequence
  Synthetic Construct
SVGGASF

SEQ ID NO: 11327 - protein, 7 aa, Artificial Sequence
  Synthetic Construct
TSESPYK

SEQ ID NO: 11328 - protein, 7 aa, Artificial Sequence
  Synthetic Construct
GHFGTMS

SEQ ID NO: 11329 - protein, 7 aa, Artificial Sequence
  Synthetic Construct
LTTSGLK

SEQ ID NO: 11330 - protein, 7 aa, Artificial Sequence
  Synthetic Construct
RINSSTY

SEQ ID NO: 11331 - protein, 7 aa, Artificial Sequence
  Synthetic Construct
LTGSSLT

SEQ ID NO: 11332 - protein, 7 aa, Artificial Sequence
  Synthetic Construct
PIRGTIY

SEQ ID NO: 11333 - protein, 7 aa, Artificial Sequence
  Synthetic Construct
TTSNNTH

SEQ ID NO: 11334 - protein, 7 aa, Artificial Sequence
  Synthetic Construct
QVTTNLD

SEQ ID NO: 11335 - protein, 7 aa, Artificial Sequence
  Synthetic Construct
ALDSSEP

SEQ ID NO: 11336 - protein, 7 aa, Artificial Sequence
  Synthetic Construct
YPKNVAW

SEQ ID NO: 11337 - protein, 7 aa, Artificial Sequence
  Synthetic Construct
STTGRNL

SEQ ID NO: 11338 - protein, 7 aa, Artificial Sequence
  Synthetic Construct
TKLMQSN

SEQ ID NO: 11339 - protein, 7 aa, Artificial Sequence
  Synthetic Construct
NSYGDAA

SEQ ID NO: 11340 - protein, 7 aa, Artificial Sequence
  Synthetic Construct
EHTGAPA

SEQ ID NO: 11341 - protein, 7 aa, Artificial Sequence
  Synthetic Construct
LRTETAN

SEQ ID NO: 11342 - protein, 7 aa, Artificial Sequence
  Synthetic Construct
VLDVNTL

SEQ ID NO: 11343 - protein, 7 aa, Artificial Sequence
  Synthetic Construct
DRGNDKL

SEQ ID NO: 11344 - protein, 7 aa, Artificial Sequence
  Synthetic Construct
SFTNSTH

SEQ ID NO: 11345 - protein, 7 aa, Artificial Sequence
  Synthetic Construct
LAHSSLS

SEQ ID NO: 11346 - protein, 7 aa, Artificial Sequence
  Synthetic Construct
RLVDPIP

SEQ ID NO: 11347 - protein, 7 aa, Artificial Sequence
  Synthetic Construct
WGDKETF

SEQ ID NO: 11348 - protein, 7 aa, Artificial Sequence
  Synthetic Construct
RDDNLST

SEQ ID NO: 11349 - protein, 7 aa, Artificial Sequence
  Synthetic Construct
SKQLIDT

SEQ ID NO: 11350 - protein, 7 aa, Artificial Sequence
  Synthetic Construct
FQNQTVG

SEQ ID NO: 11351 - protein, 7 aa, Artificial Sequence
  Synthetic Construct
VFSSDSL

SEQ ID NO: 11352 - protein, 7 aa, Artificial Sequence
  Synthetic Construct
YAQQLPV

SEQ ID NO: 11353 - protein, 7 aa, Artificial Sequence
  Synthetic Construct
IVTGTTQ

SEQ ID NO: 11354 - protein, 7 aa, Artificial Sequence
  Synthetic Construct
SKITESN

SEQ ID NO: 11355 - protein, 7 aa, Artificial Sequence
  Synthetic Construct
IAGQVGA

SEQ ID NO: 11356 - protein, 7 aa, Artificial Sequence
  Synthetic Construct
GYSQTPH

SEQ ID NO: 11357 - protein, 7 aa, Artificial Sequence
  Synthetic Construct
GLALRPD

SEQ ID NO: 11358 - protein, 7 aa, Artificial Sequence
  Synthetic Construct
NAVSNNT

SEQ ID NO: 11359 - protein, 7 aa, Artificial Sequence
  Synthetic Construct
NQSTLPT

SEQ ID NO: 11360 - protein, 7 aa, Artificial Sequence
  Synthetic Construct
TSIPDKP

SEQ ID NO: 11361 - protein, 7 aa, Artificial Sequence
  Synthetic Construct
GSSTASL

SEQ ID NO: 11362 - protein, 7 aa, Artificial Sequence
  Synthetic Construct
RIIGTAT

SEQ ID NO: 11363 - protein, 7 aa, Artificial Sequence
  Synthetic Construct
SLNGGRT

SEQ ID NO: 11364 - protein, 7 aa, Artificial Sequence
  Synthetic Construct
PVKTVGI

SEQ ID NO: 11365 - protein, 7 aa, Artificial Sequence
  Synthetic Construct
QPSAIPN

SEQ ID NO: 11366 - protein, 7 aa, Artificial Sequence
  Synthetic Construct
FASSVSA

SEQ ID NO: 11367 - protein, 7 aa, Artificial Sequence
  Synthetic Construct
EGNLTKL

SEQ ID NO: 11368 - protein, 7 aa, Artificial Sequence
  Synthetic Construct
LGTRTTS

SEQ ID NO: 11369 - protein, 7 aa, Artificial Sequence
  Synthetic Construct
THRDFSP

SEQ ID NO: 11370 - protein, 7 aa, Artificial Sequence
  Synthetic Construct
TGVSTGV

SEQ ID NO: 11371 - protein, 7 aa, Artificial Sequence
  Synthetic Construct
VPNNSQR

SEQ ID NO: 11372 - protein, 7 aa, Artificial Sequence
  Synthetic Construct
MPSGVPV

SEQ ID NO: 11373 - protein, 7 aa, Artificial Sequence
  Synthetic Construct
NALPRPN

SEQ ID NO: 11374 - protein, 7 aa, Artificial Sequence
  Synthetic Construct
RTDHSQI

SEQ ID NO: 11375 - protein, 7 aa, Artificial Sequence
  Synthetic Construct
QTLKSAY

SEQ ID NO: 11376 - protein, 7 aa, Artificial Sequence
  Synthetic Construct
KEEHTRG

SEQ ID NO: 11377 - protein, 7 aa, Artificial Sequence
  Synthetic Construct
LPAAPRY

SEQ ID NO: 11378 - protein, 7 aa, Artificial Sequence
  Synthetic Construct
LDKAHFA

SEQ ID NO: 11379 - protein, 7 aa, Artificial Sequence
  Synthetic Construct
HAIDAVK

SEQ ID NO: 11380 - protein, 7 aa, Artificial Sequence
  Synthetic Construct
PILTAVP

SEQ ID NO: 11381 - protein, 7 aa, Artificial Sequence
  Synthetic Construct
TVQQSAM

SEQ ID NO: 11382 - protein, 7 aa, Artificial Sequence
  Synthetic Construct
SEGIGGR

SEQ ID NO: 11383 - protein, 7 aa, Artificial Sequence
  Synthetic Construct
MGSTVTR

SEQ ID NO: 11384 - protein, 7 aa, Artificial Sequence
  Synthetic Construct
SVRSPTK

SEQ ID NO: 11385 - protein, 7 aa, Artificial Sequence
  Synthetic Construct
TTRDVTT

SEQ ID NO: 11386 - protein, 7 aa, Artificial Sequence
  Synthetic Construct
SAAGKTY

SEQ ID NO: 11387 - protein, 7 aa, Artificial Sequence
  Synthetic Construct
TTPSTVR

SEQ ID NO: 11388 - protein, 7 aa, Artificial Sequence
  Synthetic Construct
VALTTTV

SEQ ID NO: 11389 - protein, 7 aa, Artificial Sequence
  Synthetic Construct
DTQLPLS

SEQ ID NO: 11390 - protein, 7 aa, Artificial Sequence
  Synthetic Construct
NAVSNPL

SEQ ID NO: 11391 - protein, 7 aa, Artificial Sequence
  Synthetic Construct
MELKYQR

SEQ ID NO: 11392 - protein, 7 aa, Artificial Sequence
  Synthetic Construct
NSLHGHA

SEQ ID NO: 11393 - protein, 7 aa, Artificial Sequence
  Synthetic Construct
HSPSLSD

SEQ ID NO: 11394 - protein, 7 aa, Artificial Sequence
  Synthetic Construct
GSVTSLG

SEQ ID NO: 11395 - protein, 7 aa, Artificial Sequence
  Synthetic Construct
REVSSTT

SEQ ID NO: 11396 - protein, 7 aa, Artificial Sequence
  Synthetic Construct
GKATLDT

SEQ ID NO: 11397 - protein, 7 aa, Artificial Sequence
  Synthetic Construct
LNPPLNN

SEQ ID NO: 11398 - protein, 7 aa, Artificial Sequence
  Synthetic Construct
TSGHSPS

SEQ ID NO: 11399 - protein, 7 aa, Artificial Sequence
  Synthetic Construct
DVTATAP

SEQ ID NO: 11400 - protein, 7 aa, Artificial Sequence
  Synthetic Construct
HQNTGSV

SEQ ID NO: 11401 - protein, 7 aa, Artificial Sequence
  Synthetic Construct
DLTHTFD

SEQ ID NO: 11402 - protein, 7 aa, Artificial Sequence
  Synthetic Construct
YLPNKER

SEQ ID NO: 11403 - protein, 7 aa, Artificial Sequence
  Synthetic Construct
VDGTYTV

SEQ ID NO: 11404 - protein, 7 aa, Artificial Sequence
  Synthetic Construct
YLTSGGY

SEQ ID NO: 11405 - protein, 7 aa, Artificial Sequence
  Synthetic Construct
ASLVVVA

SEQ ID NO: 11406 - protein, 7 aa, Artificial Sequence
  Synthetic Construct
FDANSKI

SEQ ID NO: 11407 - protein, 7 aa, Artificial Sequence
  Synthetic Construct
YLTESPG

SEQ ID NO: 11408 - protein, 7 aa, Artificial Sequence
  Synthetic Construct
RNASLDP

SEQ ID NO: 11409 - protein, 7 aa, Artificial Sequence
  Synthetic Construct
AGSPRAG

SEQ ID NO: 11410 - protein, 7 aa, Artificial Sequence
  Synthetic Construct
RVEKLTP

SEQ ID NO: 11411 - protein, 7 aa, Artificial Sequence
  Synthetic Construct
RTTGDNT

SEQ ID NO: 11412 - protein, 7 aa, Artificial Sequence
  Synthetic Construct
PAATSGF

SEQ ID NO: 11413 - protein, 7 aa, Artificial Sequence
  Synthetic Construct
ILTIHTH

SEQ ID NO: 11414 - protein, 7 aa, Artificial Sequence
  Synthetic Construct
INISSHV

SEQ ID NO: 11415 - protein, 7 aa, Artificial Sequence
  Synthetic Construct
PSGSARS

SEQ ID NO: 11416 - protein, 7 aa, Artificial Sequence
  Synthetic Construct
STMPTRL

SEQ ID NO: 11417 - protein, 7 aa, Artificial Sequence
  Synthetic Construct
LYASAGV

SEQ ID NO: 11418 - protein, 7 aa, Artificial Sequence
  Synthetic Construct
LVQTGLL

SEQ ID NO: 11419 - protein, 7 aa, Artificial Sequence
  Synthetic Construct
VSLNRTE

SEQ ID NO: 11420 - protein, 7 aa, Artificial Sequence
  Synthetic Construct
GGRESSL

SEQ ID NO: 11421 - protein, 7 aa, Artificial Sequence
  Synthetic Construct
VERMPRM

SEQ ID NO: 11422 - protein, 7 aa, Artificial Sequence
  Synthetic Construct
PQIGIPD

SEQ ID NO: 11423 - protein, 7 aa, Artificial Sequence
  Synthetic Construct
ATVKSST

SEQ ID NO: 11424 - protein, 7 aa, Artificial Sequence
  Synthetic Construct
GGNVQAI

SEQ ID NO: 11425 - protein, 7 aa, Artificial Sequence
  Synthetic Construct
TIVNVTS

SEQ ID NO: 11426 - protein, 7 aa, Artificial Sequence
  Synthetic Construct
GDPAQSS

SEQ ID NO: 11427 - protein, 7 aa, Artificial Sequence
  Synthetic Construct
TKNTDFQ

SEQ ID NO: 11428 - protein, 7 aa, Artificial Sequence
  Synthetic Construct
RHTDAVI

SEQ ID NO: 11429 - protein, 7 aa, Artificial Sequence
  Synthetic Construct
SVHTAVR

SEQ ID NO: 11430 - protein, 7 aa, Artificial Sequence
  Synthetic Construct
ITSLMSG

SEQ ID NO: 11431 - protein, 7 aa, Artificial Sequence
  Synthetic Construct
DHNQISL

SEQ ID NO: 11432 - protein, 7 aa, Artificial Sequence
  Synthetic Construct
QGQSALK

SEQ ID NO: 11433 - protein, 7 aa, Artificial Sequence
  Synthetic Construct
NNATRYT

SEQ ID NO: 11434 - protein, 7 aa, Artificial Sequence
  Synthetic Construct
SRNTTSW

SEQ ID NO: 11435 - protein, 7 aa, Artificial Sequence
  Synthetic Construct
PSNSKLI

SEQ ID NO: 11436 - protein, 7 aa, Artificial Sequence
  Synthetic Construct
KTVSLND

SEQ ID NO: 11437 - protein, 7 aa, Artificial Sequence
  Synthetic Construct
TPLPRVS

SEQ ID NO: 11438 - protein, 7 aa, Artificial Sequence
  Synthetic Construct
QTIASAL

SEQ ID NO: 11439 - protein, 7 aa, Artificial Sequence
  Synthetic Construct
PIMKTTV

SEQ ID NO: 11440 - protein, 7 aa, Artificial Sequence
  Synthetic Construct
SAVIQGH

SEQ ID NO: 11441 - protein, 7 aa, Artificial Sequence
  Synthetic Construct
PLYGTMS

SEQ ID NO: 11442 - protein, 7 aa, Artificial Sequence
  Synthetic Construct
ANRTKDY

SEQ ID NO: 11443 - protein, 7 aa, Artificial Sequence
  Synthetic Construct
VIPQTER

SEQ ID NO: 11444 - protein, 7 aa, Artificial Sequence
  Synthetic Construct
IVNGHIR

SEQ ID NO: 11445 - protein, 7 aa, Artificial Sequence
  Synthetic Construct
SRPNETT

SEQ ID NO: 11446 - protein, 7 aa, Artificial Sequence
  Synthetic Construct
GYTPVSR

SEQ ID NO: 11447 - protein, 7 aa, Artificial Sequence
  Synthetic Construct
PLQRTIG

SEQ ID NO: 11448 - protein, 7 aa, Artificial Sequence
  Synthetic Construct
STGSPTI

SEQ ID NO: 11449 - protein, 7 aa, Artificial Sequence
  Synthetic Construct
STMTGLI

SEQ ID NO: 11450 - protein, 7 aa, Artificial Sequence
  Synthetic Construct
IHAVGAE

SEQ ID NO: 11451 - protein, 7 aa, Artificial Sequence
  Synthetic Construct
TANVSEL

SEQ ID NO: 11452 - protein, 7 aa, Artificial Sequence
  Synthetic Construct
NKSDMPH

SEQ ID NO: 11453 - protein, 7 aa, Artificial Sequence
  Synthetic Construct
SNYNTHD

SEQ ID NO: 11454 - protein, 7 aa, Artificial Sequence
  Synthetic Construct
PSVTHHP

SEQ ID NO: 11455 - protein, 7 aa, Artificial Sequence
  Synthetic Construct
NLSLKPL

SEQ ID NO: 11456 - protein, 7 aa, Artificial Sequence
  Synthetic Construct
LYSNKSN

SEQ ID NO: 11457 - protein, 7 aa, Artificial Sequence
  Synthetic Construct
DNGLVHR

SEQ ID NO: 11458 - protein, 7 aa, Artificial Sequence
  Synthetic Construct
MGTLTIS

SEQ ID NO: 11459 - protein, 7 aa, Artificial Sequence
  Synthetic Construct
TFQSDER

SEQ ID NO: 11460 - protein, 7 aa, Artificial Sequence
  Synthetic Construct
IVTGAYR

SEQ ID NO: 11461 - protein, 7 aa, Artificial Sequence
  Synthetic Construct
TVVNPSS

SEQ ID NO: 11462 - protein, 7 aa, Artificial Sequence
  Synthetic Construct
DNNVRHT

SEQ ID NO: 11463 - protein, 7 aa, Artificial Sequence
  Synthetic Construct
DRSQNSL

SEQ ID NO: 11464 - protein, 7 aa, Artificial Sequence
  Synthetic Construct
HPPVPAS

SEQ ID NO: 11465 - protein, 7 aa, Artificial Sequence
  Synthetic Construct
KYITPSS

SEQ ID NO: 11466 - protein, 7 aa, Artificial Sequence
  Synthetic Construct
VPDKQAM

SEQ ID NO: 11467 - protein, 7 aa, Artificial Sequence
  Synthetic Construct
VIAKTEY

SEQ ID NO: 11468 - protein, 7 aa, Artificial Sequence
  Synthetic Construct
GGQAEAR

SEQ ID NO: 11469 - protein, 7 aa, Artificial Sequence
  Synthetic Construct
QPVLNQP

SEQ ID NO: 11470 - protein, 7 aa, Artificial Sequence
  Synthetic Construct
NNTNENL

SEQ ID NO: 11471 - protein, 7 aa, Artificial Sequence
  Synthetic Construct
TNLSLSS

SEQ ID NO: 11472 - protein, 7 aa, Artificial Sequence
  Synthetic Construct
GQSSDER

SEQ ID NO: 11473 - protein, 7 aa, Artificial Sequence
  Synthetic Construct
THATTFA

SEQ ID NO: 11474 - protein, 7 aa, Artificial Sequence
  Synthetic Construct
TSQQDRS

SEQ ID NO: 11475 - protein, 7 aa, Artificial Sequence
  Synthetic Construct
ALLHREA

SEQ ID NO: 11476 - protein, 7 aa, Artificial Sequence
  Synthetic Construct
NPSVTAL

SEQ ID NO: 11477 - protein, 7 aa, Artificial Sequence
  Synthetic Construct
VANLNSR

SEQ ID NO: 11478 - protein, 7 aa, Artificial Sequence
  Synthetic Construct
TMLLEPK

SEQ ID NO: 11479 - protein, 7 aa, Artificial Sequence
  Synthetic Construct
NVRPSTY

SEQ ID NO: 11480 - protein, 7 aa, Artificial Sequence
  Synthetic Construct
VIHITNT

SEQ ID NO: 11481 - protein, 7 aa, Artificial Sequence
  Synthetic Construct
SNPSLLT

SEQ ID NO: 11482 - protein, 7 aa, Artificial Sequence
  Synthetic Construct
YQDNARL

SEQ ID NO: 11483 - protein, 7 aa, Artificial Sequence
  Synthetic Construct
IQGLTSH

SEQ ID NO: 11484 - protein, 7 aa, Artificial Sequence
  Synthetic Construct
TYNQGKQ

SEQ ID NO: 11485 - protein, 7 aa, Artificial Sequence
  Synthetic Construct
APTGMKH

SEQ ID NO: 11486 - protein, 7 aa, Artificial Sequence
  Synthetic Construct
MSGELIR

SEQ ID NO: 11487 - protein, 7 aa, Artificial Sequence
  Synthetic Construct
RLNTSHL

SEQ ID NO: 11488 - protein, 7 aa, Artificial Sequence
  Synthetic Construct
ATALAAG

SEQ ID NO: 11489 - protein, 7 aa, Artificial Sequence
  Synthetic Construct
PISGLKS

SEQ ID NO: 11490 - protein, 7 aa, Artificial Sequence
  Synthetic Construct
ERTFNPA

SEQ ID NO: 11491 - protein, 7 aa, Artificial Sequence
  Synthetic Construct
MSNISSV

SEQ ID NO: 11492 - protein, 7 aa, Artificial Sequence
  Synthetic Construct
RDARLSP

SEQ ID NO: 11493 - protein, 7 aa, Artificial Sequence
  Synthetic Construct
DHYVNTR

SEQ ID NO: 11494 - protein, 7 aa, Artificial Sequence
  Synthetic Construct
PGTAVRL

SEQ ID NO: 11495 - protein, 7 aa, Artificial Sequence
  Synthetic Construct
DKGTLSE

SEQ ID NO: 11496 - protein, 7 aa, Artificial Sequence
  Synthetic Construct
SIPRTDN

SEQ ID NO: 11497 - protein, 7 aa, Artificial Sequence
  Synthetic Construct
EPVLHTV

SEQ ID NO: 11498 - protein, 7 aa, Artificial Sequence
  Synthetic Construct
DRAILNS

SEQ ID NO: 11499 - protein, 7 aa, Artificial Sequence
  Synthetic Construct
EIGSLRQ

SEQ ID NO: 11500 - protein, 7 aa, Artificial Sequence
  Synthetic Construct
AFVGATP

SEQ ID NO: 11501 - protein, 7 aa, Artificial Sequence
  Synthetic Construct
FVQNKDA

SEQ ID NO: 11502 - protein, 7 aa, Artificial Sequence
  Synthetic Construct
RDKAGPT

SEQ ID NO: 11503 - protein, 7 aa, Artificial Sequence
  Synthetic Construct
LLPTAHN

SEQ ID NO: 11504 - protein, 7 aa, Artificial Sequence
  Synthetic Construct
PNGITST

SEQ ID NO: 11505 - protein, 7 aa, Artificial Sequence
  Synthetic Construct
SGVTKGS

SEQ ID NO: 11506 - protein, 7 aa, Artificial Sequence
  Synthetic Construct
MNSTISH

SEQ ID NO: 11507 - protein, 7 aa, Artificial Sequence
  Synthetic Construct
YKSDVGS

SEQ ID NO: 11508 - protein, 7 aa, Artificial Sequence
  Synthetic Construct
PVTRVNL

SEQ ID NO: 11509 - protein, 7 aa, Artificial Sequence
  Synthetic Construct
RNVADGL

SEQ ID NO: 11510 - protein, 7 aa, Artificial Sequence
  Synthetic Construct
ASATSIT

SEQ ID NO: 11511 - protein, 7 aa, Artificial Sequence
  Synthetic Construct
SGTASNV

SEQ ID NO: 11512 - protein, 7 aa, Artificial Sequence
  Synthetic Construct
RQDLGST

SEQ ID NO: 11513 - protein, 7 aa, Artificial Sequence
  Synthetic Construct
DSALISK

SEQ ID NO: 11514 - protein, 7 aa, Artificial Sequence
  Synthetic Construct
NNGLNSA

SEQ ID NO: 11515 - protein, 7 aa, Artificial Sequence
  Synthetic Construct
AASERRM

SEQ ID NO: 11516 - protein, 7 aa, Artificial Sequence
  Synthetic Construct
RHSAVPE

SEQ ID NO: 11517 - protein, 7 aa, Artificial Sequence
  Synthetic Construct
YQDTKGQ

SEQ ID NO: 11518 - protein, 7 aa, Artificial Sequence
  Synthetic Construct
KTGSLPV

SEQ ID NO: 11519 - protein, 7 aa, Artificial Sequence
  Synthetic Construct
IARSVSM

SEQ ID NO: 11520 - protein, 7 aa, Artificial Sequence
  Synthetic Construct
PSSKLPL

SEQ ID NO: 11521 - protein, 7 aa, Artificial Sequence
  Synthetic Construct
INDQRIS

SEQ ID NO: 11522 - protein, 7 aa, Artificial Sequence
  Synthetic Construct
GISEKTS

SEQ ID NO: 11523 - protein, 7 aa, Artificial Sequence
  Synthetic Construct
TSAYTSV

SEQ ID NO: 11524 - protein, 7 aa, Artificial Sequence
  Synthetic Construct
GTLHSSA

SEQ ID NO: 11525 - protein, 7 aa, Artificial Sequence
  Synthetic Construct
APRDAAS

SEQ ID NO: 11526 - protein, 7 aa, Artificial Sequence
  Synthetic Construct
NNTAMSL

SEQ ID NO: 11527 - protein, 7 aa, Artificial Sequence
  Synthetic Construct
ILRVADA

SEQ ID NO: 11528 - protein, 7 aa, Artificial Sequence
  Synthetic Construct
ASVAGAS

SEQ ID NO: 11529 - protein, 7 aa, Artificial Sequence
  Synthetic Construct
SVLNGSK

SEQ ID NO: 11530 - protein, 7 aa, Artificial Sequence
  Synthetic Construct
IYQTASA

SEQ ID NO: 11531 - protein, 7 aa, Artificial Sequence
  Synthetic Construct
TSERTQF

SEQ ID NO: 11532 - protein, 7 aa, Artificial Sequence
  Synthetic Construct
STVALTS

SEQ ID NO: 11533 - protein, 7 aa, Artificial Sequence
  Synthetic Construct
GNTVINA

SEQ ID NO: 11534 - protein, 7 aa, Artificial Sequence
  Synthetic Construct
PLGSIVT

SEQ ID NO: 11535 - protein, 7 aa, Artificial Sequence
  Synthetic Construct
LRMSDSF

SEQ ID NO: 11536 - protein, 7 aa, Artificial Sequence
  Synthetic Construct
TSESGTL

SEQ ID NO: 11537 - protein, 7 aa, Artificial Sequence
  Synthetic Construct
EATRPVR

SEQ ID NO: 11538 - protein, 7 aa, Artificial Sequence
  Synthetic Construct
NKQFLAD

SEQ ID NO: 11539 - protein, 7 aa, Artificial Sequence
  Synthetic Construct
LTIRDNV

SEQ ID NO: 11540 - protein, 7 aa, Artificial Sequence
  Synthetic Construct
VGSGLAK

SEQ ID NO: 11541 - protein, 7 aa, Artificial Sequence
  Synthetic Construct
QNATNLM

SEQ ID NO: 11542 - protein, 7 aa, Artificial Sequence
  Synthetic Construct
SMYAGHE

SEQ ID NO: 11543 - protein, 7 aa, Artificial Sequence
  Synthetic Construct
MVNSEKA

SEQ ID NO: 11544 - protein, 7 aa, Artificial Sequence
  Synthetic Construct
RMSMRSD

SEQ ID NO: 11545 - protein, 7 aa, Artificial Sequence
  Synthetic Construct
SSSGLNK

SEQ ID NO: 11546 - protein, 7 aa, Artificial Sequence
  Synthetic Construct
QSSVLTP

SEQ ID NO: 11547 - protein, 7 aa, Artificial Sequence
  Synthetic Construct
TPNLETS

SEQ ID NO: 11548 - protein, 7 aa, Artificial Sequence
  Synthetic Construct
MRGTLSM

SEQ ID NO: 11549 - protein, 7 aa, Artificial Sequence
  Synthetic Construct
DHGASLP

SEQ ID NO: 11550 - protein, 7 aa, Artificial Sequence
  Synthetic Construct
SHLATPK

SEQ ID NO: 11551 - protein, 7 aa, Artificial Sequence
  Synthetic Construct
SDASHRQ

SEQ ID NO: 11552 - protein, 7 aa, Artificial Sequence
  Synthetic Construct
TGTERLS

SEQ ID NO: 11553 - protein, 7 aa, Artificial Sequence
  Synthetic Construct
AVGHVGP

SEQ ID NO: 11554 - protein, 7 aa, Artificial Sequence
  Synthetic Construct
QSQQGVK

SEQ ID NO: 11555 - protein, 7 aa, Artificial Sequence
  Synthetic Construct
NLTISNR

SEQ ID NO: 11556 - protein, 7 aa, Artificial Sequence
  Synthetic Construct
VSSGYET

SEQ ID NO: 11557 - protein, 7 aa, Artificial Sequence
  Synthetic Construct
SISPPRT

SEQ ID NO: 11558 - protein, 7 aa, Artificial Sequence
  Synthetic Construct
PYNQSPS

SEQ ID NO: 11559 - protein, 7 aa, Artificial Sequence
  Synthetic Construct
TMSYNTN

SEQ ID NO: 11560 - protein, 7 aa, Artificial Sequence
  Synthetic Construct
GAYNTVS

SEQ ID NO: 11561 - protein, 7 aa, Artificial Sequence
  Synthetic Construct
SKVTPPL

SEQ ID NO: 11562 - protein, 7 aa, Artificial Sequence
  Synthetic Construct
RFRENDH

SEQ ID NO: 11563 - protein, 7 aa, Artificial Sequence
  Synthetic Construct
LDTGQPT

SEQ ID NO: 11564 - protein, 7 aa, Artificial Sequence
  Synthetic Construct
LPSTPQN

SEQ ID NO: 11565 - protein, 7 aa, Artificial Sequence
  Synthetic Construct
TLSYVTS

SEQ ID NO: 11566 - protein, 7 aa, Artificial Sequence
  Synthetic Construct
STTVLPV

SEQ ID NO: 11567 - protein, 7 aa, Artificial Sequence
  Synthetic Construct
MTHTLLS

SEQ ID NO: 11568 - protein, 7 aa, Artificial Sequence
  Synthetic Construct
STYNKTF

SEQ ID NO: 11569 - protein, 7 aa, Artificial Sequence
  Synthetic Construct
ATSSHTL

SEQ ID NO: 11570 - protein, 7 aa, Artificial Sequence
  Synthetic Construct
RLNGTEP

SEQ ID NO: 11571 - protein, 7 aa, Artificial Sequence
  Synthetic Construct
QANTPTK

SEQ ID NO: 11572 - protein, 7 aa, Artificial Sequence
  Synthetic Construct
SAVINSS

SEQ ID NO: 11573 - protein, 7 aa, Artificial Sequence
  Synthetic Construct
NHGNEVK

SEQ ID NO: 11574 - protein, 7 aa, Artificial Sequence
  Synthetic Construct
KHLSHDP

SEQ ID NO: 11575 - protein, 7 aa, Artificial Sequence
  Synthetic Construct
LGSGRMA

SEQ ID NO: 11576 - protein, 7 aa, Artificial Sequence
  Synthetic Construct
SNQITIV

SEQ ID NO: 11577 - protein, 7 aa, Artificial Sequence
  Synthetic Construct
GGRGVGM

SEQ ID NO: 11578 - protein, 7 aa, Artificial Sequence
  Synthetic Construct
FVTESKS

SEQ ID NO: 11579 - protein, 7 aa, Artificial Sequence
  Synthetic Construct
NSVHNDL

SEQ ID NO: 11580 - protein, 7 aa, Artificial Sequence
  Synthetic Construct
SPQQSRY

SEQ ID NO: 11581 - protein, 7 aa, Artificial Sequence
  Synthetic Construct
TQPNHDS

SEQ ID NO: 11582 - protein, 7 aa, Artificial Sequence
  Synthetic Construct
TRLNEVT

SEQ ID NO: 11583 - protein, 7 aa, Artificial Sequence
  Synthetic Construct
TAQRTNV

SEQ ID NO: 11584 - protein, 7 aa, Artificial Sequence
  Synthetic Construct
PGRSPTT

SEQ ID NO: 11585 - protein, 7 aa, Artificial Sequence
  Synthetic Construct
AYSVVRG

SEQ ID NO: 11586 - protein, 7 aa, Artificial Sequence
  Synthetic Construct
VGPVLSR

SEQ ID NO: 11587 - protein, 7 aa, Artificial Sequence
  Synthetic Construct
TKMGTPN

SEQ ID NO: 11588 - protein, 7 aa, Artificial Sequence
  Synthetic Construct
TTPNLNP

SEQ ID NO: 11589 - protein, 7 aa, Artificial Sequence
  Synthetic Construct
TSGTDGI

SEQ ID NO: 11590 - protein, 7 aa, Artificial Sequence
  Synthetic Construct
PMPNMPS

SEQ ID NO: 11591 - protein, 7 aa, Artificial Sequence
  Synthetic Construct
ADALSNR

SEQ ID NO: 11592 - protein, 7 aa, Artificial Sequence
  Synthetic Construct
LQTSSHT

SEQ ID NO: 11593 - protein, 7 aa, Artificial Sequence
  Synthetic Construct
TSMQGVY

SEQ ID NO: 11594 - protein, 7 aa, Artificial Sequence
  Synthetic Construct
QTTVLNK

SEQ ID NO: 11595 - protein, 7 aa, Artificial Sequence
  Synthetic Construct
IIPVNST

SEQ ID NO: 11596 - protein, 7 aa, Artificial Sequence
  Synthetic Construct
IATVTSS

SEQ ID NO: 11597 - protein, 7 aa, Artificial Sequence
  Synthetic Construct
LETPGRM

SEQ ID NO: 11598 - protein, 7 aa, Artificial Sequence
  Synthetic Construct
IATSVGS

SEQ ID NO: 11599 - protein, 7 aa, Artificial Sequence
  Synthetic Construct
VREHEAL

SEQ ID NO: 11600 - protein, 7 aa, Artificial Sequence
  Synthetic Construct
PLTNVQG

SEQ ID NO: 11601 - protein, 7 aa, Artificial Sequence
  Synthetic Construct
RDMVQTM

SEQ ID NO: 11602 - protein, 7 aa, Artificial Sequence
  Synthetic Construct
RLGFATN

SEQ ID NO: 11603 - protein, 7 aa, Artificial Sequence
  Synthetic Construct
MSQVTTE

SEQ ID NO: 11604 - protein, 7 aa, Artificial Sequence
  Synthetic Construct
SVLPNAI

SEQ ID NO: 11605 - protein, 7 aa, Artificial Sequence
  Synthetic Construct
KFSPTLA

SEQ ID NO: 11606 - protein, 7 aa, Artificial Sequence
  Synthetic Construct
NIGNMVL

SEQ ID NO: 11607 - protein, 7 aa, Artificial Sequence
  Synthetic Construct
SLLTVLS

SEQ ID NO: 11608 - protein, 7 aa, Artificial Sequence
  Synthetic Construct
NSNPSML

SEQ ID NO: 11609 - protein, 7 aa, Artificial Sequence
  Synthetic Construct
ITAAVRD

SEQ ID NO: 11610 - protein, 7 aa, Artificial Sequence
  Synthetic Construct
AYTSNDR

SEQ ID NO: 11611 - protein, 7 aa, Artificial Sequence
  Synthetic Construct
NSVGSMK

SEQ ID NO: 11612 - protein, 7 aa, Artificial Sequence
  Synthetic Construct
RLDTTWV

SEQ ID NO: 11613 - protein, 7 aa, Artificial Sequence
  Synthetic Construct
IAEAGGR

SEQ ID NO: 11614 - protein, 7 aa, Artificial Sequence
  Synthetic Construct
SKTNLQL

SEQ ID NO: 11615 - protein, 7 aa, Artificial Sequence
  Synthetic Construct
FSKDDAV

SEQ ID NO: 11616 - protein, 7 aa, Artificial Sequence
  Synthetic Construct
LTSHSLT

SEQ ID NO: 11617 - protein, 7 aa, Artificial Sequence
  Synthetic Construct
HVQLQYP

SEQ ID NO: 11618 - protein, 7 aa, Artificial Sequence
  Synthetic Construct
NHNQPSA

SEQ ID NO: 11619 - protein, 7 aa, Artificial Sequence
  Synthetic Construct
TEGARSL

SEQ ID NO: 11620 - protein, 7 aa, Artificial Sequence
  Synthetic Construct
NQSDSKV

SEQ ID NO: 11621 - protein, 7 aa, Artificial Sequence
  Synthetic Construct
VSLPLAP

SEQ ID NO: 11622 - protein, 7 aa, Artificial Sequence
  Synthetic Construct
NNTNLSR

SEQ ID NO: 11623 - protein, 7 aa, Artificial Sequence
  Synthetic Construct
YSNSNNH

SEQ ID NO: 11624 - protein, 7 aa, Artificial Sequence
  Synthetic Construct
GLETRLH

SEQ ID NO: 11625 - protein, 7 aa, Artificial Sequence
  Synthetic Construct
LTTTESK

SEQ ID NO: 11626 - protein, 7 aa, Artificial Sequence
  Synthetic Construct
MGARMPL

SEQ ID NO: 11627 - protein, 7 aa, Artificial Sequence
  Synthetic Construct
SHDHMLI

SEQ ID NO: 11628 - protein, 7 aa, Artificial Sequence
  Synthetic Construct
RTEGSDN

SEQ ID NO: 11629 - protein, 7 aa, Artificial Sequence
  Synthetic Construct
NFQRDGP

SEQ ID NO: 11630 - protein, 7 aa, Artificial Sequence
  Synthetic Construct
LSNINPH

SEQ ID NO: 11631 - protein, 7 aa, Artificial Sequence
  Synthetic Construct
SSNHTSR

SEQ ID NO: 11632 - protein, 7 aa, Artificial Sequence
  Synthetic Construct
MHVNASP

SEQ ID NO: 11633 - protein, 7 aa, Artificial Sequence
  Synthetic Construct
WDSLAAP

SEQ ID NO: 11634 - protein, 7 aa, Artificial Sequence
  Synthetic Construct
LDGAHNA

SEQ ID NO: 11635 - protein, 7 aa, Artificial Sequence
  Synthetic Construct
SIRSPPP

SEQ ID NO: 11636 - protein, 7 aa, Artificial Sequence
  Synthetic Construct
NGTLKGL

SEQ ID NO: 11637 - protein, 7 aa, Artificial Sequence
  Synthetic Construct
FYQEQSL

SEQ ID NO: 11638 - protein, 7 aa, Artificial Sequence
  Synthetic Construct
YDQKSLA

SEQ ID NO: 11639 - protein, 7 aa, Artificial Sequence
  Synthetic Construct
LSTNRTF

SEQ ID NO: 11640 - protein, 7 aa, Artificial Sequence
  Synthetic Construct
KQTQDSS

SEQ ID NO: 11641 - protein, 7 aa, Artificial Sequence
  Synthetic Construct
YERGPQM

SEQ ID NO: 11642 - protein, 7 aa, Artificial Sequence
  Synthetic Construct
THANSVR

SEQ ID NO: 11643 - protein, 7 aa, Artificial Sequence
  Synthetic Construct
SMNTNAS

SEQ ID NO: 11644 - protein, 7 aa, Artificial Sequence
  Synthetic Construct
LDNEKGR

SEQ ID NO: 11645 - protein, 7 aa, Artificial Sequence
  Synthetic Construct
LGQLLQS

SEQ ID NO: 11646 - protein, 7 aa, Artificial Sequence
  Synthetic Construct
MRMPVNM

SEQ ID NO: 11647 - protein, 7 aa, Artificial Sequence
  Synthetic Construct
GTSNLPS

SEQ ID NO: 11648 - protein, 7 aa, Artificial Sequence
  Synthetic Construct
EGEMKSP

SEQ ID NO: 11649 - protein, 7 aa, Artificial Sequence
  Synthetic Construct
QLGHDNR

SEQ ID NO: 11650 - protein, 7 aa, Artificial Sequence
  Synthetic Construct
LDDSAGR

SEQ ID NO: 11651 - protein, 7 aa, Artificial Sequence
  Synthetic Construct
TGAGNGR

SEQ ID NO: 11652 - protein, 7 aa, Artificial Sequence
  Synthetic Construct
NTGAAMM

SEQ ID NO: 11653 - protein, 7 aa, Artificial Sequence
  Synthetic Construct
MGANTSV

SEQ ID NO: 11654 - protein, 7 aa, Artificial Sequence
  Synthetic Construct
PSTHGGS

SEQ ID NO: 11655 - protein, 7 aa, Artificial Sequence
  Synthetic Construct
MPQSQPN

SEQ ID NO: 11656 - protein, 7 aa, Artificial Sequence
  Synthetic Construct
STQARLT

SEQ ID NO: 11657 - protein, 7 aa, Artificial Sequence
  Synthetic Construct
SEYLLNP

SEQ ID NO: 11658 - protein, 7 aa, Artificial Sequence
  Synthetic Construct
TTGPGLN

SEQ ID NO: 11659 - protein, 7 aa, Artificial Sequence
  Synthetic Construct
PGSSVSY

SEQ ID NO: 11660 - protein, 7 aa, Artificial Sequence
  Synthetic Construct
YFGSAQE

SEQ ID NO: 11661 - protein, 7 aa, Artificial Sequence
  Synthetic Construct
AVINNAT

SEQ ID NO: 11662 - protein, 7 aa, Artificial Sequence
  Synthetic Construct
VAMQDKK

SEQ ID NO: 11663 - protein, 7 aa, Artificial Sequence
  Synthetic Construct
ADNMNIK

SEQ ID NO: 11664 - protein, 7 aa, Artificial Sequence
  Synthetic Construct
GRATTDS

SEQ ID NO: 11665 - protein, 7 aa, Artificial Sequence
  Synthetic Construct
MNLHLKG

SEQ ID NO: 11666 - protein, 7 aa, Artificial Sequence
  Synthetic Construct
SNQIRDS

SEQ ID NO: 11667 - protein, 7 aa, Artificial Sequence
  Synthetic Construct
VNGQSTP

SEQ ID NO: 11668 - protein, 7 aa, Artificial Sequence
  Synthetic Construct
ILPQLNS

SEQ ID NO: 11669 - protein, 7 aa, Artificial Sequence
  Synthetic Construct
VQDSLHF

SEQ ID NO: 11670 - protein, 7 aa, Artificial Sequence
  Synthetic Construct
DVSNRNN

SEQ ID NO: 11671 - protein, 7 aa, Artificial Sequence
  Synthetic Construct
DASHGSS

SEQ ID NO: 11672 - protein, 7 aa, Artificial Sequence
  Synthetic Construct
RASAHPP

SEQ ID NO: 11673 - protein, 7 aa, Artificial Sequence
  Synthetic Construct
PSLRALD

SEQ ID NO: 11674 - protein, 7 aa, Artificial Sequence
  Synthetic Construct
DKTPPVA

SEQ ID NO: 11675 - protein, 7 aa, Artificial Sequence
  Synthetic Construct
LNDVTTR

SEQ ID NO: 11676 - protein, 7 aa, Artificial Sequence
  Synthetic Construct
GASNAQA

SEQ ID NO: 11677 - protein, 7 aa, Artificial Sequence
  Synthetic Construct
NGSRDAL

SEQ ID NO: 11678 - protein, 7 aa, Artificial Sequence
  Synthetic Construct
YGVERMS

SEQ ID NO: 11679 - protein, 7 aa, Artificial Sequence
  Synthetic Construct
AKVASSF

SEQ ID NO: 11680 - protein, 7 aa, Artificial Sequence
  Synthetic Construct
HKQILLD

SEQ ID NO: 11681 - protein, 7 aa, Artificial Sequence
  Synthetic Construct
DRANDRI

SEQ ID NO: 11682 - protein, 7 aa, Artificial Sequence
  Synthetic Construct
KMSTTML

SEQ ID NO: 11683 - protein, 7 aa, Artificial Sequence
  Synthetic Construct
GGENGVI

SEQ ID NO: 11684 - protein, 7 aa, Artificial Sequence
  Synthetic Construct
VTQTLIS

SEQ ID NO: 11685 - protein, 7 aa, Artificial Sequence
  Synthetic Construct
LYTKALI

SEQ ID NO: 11686 - protein, 7 aa, Artificial Sequence
  Synthetic Construct
TLPGHNR

SEQ ID NO: 11687 - protein, 7 aa, Artificial Sequence
  Synthetic Construct
SKSGLVG

SEQ ID NO: 11688 - protein, 7 aa, Artificial Sequence
  Synthetic Construct
LTLKDTS

SEQ ID NO: 11689 - protein, 7 aa, Artificial Sequence
  Synthetic Construct
WNGTGVS

SEQ ID NO: 11690 - protein, 7 aa, Artificial Sequence
  Synthetic Construct
LVQNNTM

SEQ ID NO: 11691 - protein, 7 aa, Artificial Sequence
  Synthetic Construct
LADRGSA

SEQ ID NO: 11692 - protein, 7 aa, Artificial Sequence
  Synthetic Construct
LASTGAN

SEQ ID NO: 11693 - protein, 7 aa, Artificial Sequence
  Synthetic Construct
LGRNDTL

SEQ ID NO: 11694 - protein, 7 aa, Artificial Sequence
  Synthetic Construct
RSTNGEA

SEQ ID NO: 11695 - protein, 7 aa, Artificial Sequence
  Synthetic Construct
GATYQRT

SEQ ID NO: 11696 - protein, 7 aa, Artificial Sequence
  Synthetic Construct
GKSQLLM

SEQ ID NO: 11697 - protein, 7 aa, Artificial Sequence
  Synthetic Construct
NTATFSS

SEQ ID NO: 11698 - protein, 7 aa, Artificial Sequence
  Synthetic Construct
YSTTISP

SEQ ID NO: 11699 - protein, 7 aa, Artificial Sequence
  Synthetic Construct
PRHSVQD

SEQ ID NO: 11700 - protein, 7 aa, Artificial Sequence
  Synthetic Construct
NNNTKMN

SEQ ID NO: 11701 - protein, 7 aa, Artificial Sequence
  Synthetic Construct
LTGHHTK

SEQ ID NO: 11702 - protein, 7 aa, Artificial Sequence
  Synthetic Construct
NVSSGQR

SEQ ID NO: 11703 - protein, 7 aa, Artificial Sequence
  Synthetic Construct
SLQDARL

SEQ ID NO: 11704 - protein, 7 aa, Artificial Sequence
  Synthetic Construct
LNRDGSV

SEQ ID NO: 11705 - protein, 7 aa, Artificial Sequence
  Synthetic Construct
NSTENST

SEQ ID NO: 11706 - protein, 7 aa, Artificial Sequence
  Synthetic Construct
SLVAQPV

SEQ ID NO: 11707 - protein, 7 aa, Artificial Sequence
  Synthetic Construct
HAATVSH

SEQ ID NO: 11708 - protein, 7 aa, Artificial Sequence
  Synthetic Construct
NVSGARL

SEQ ID NO: 11709 - protein, 7 aa, Artificial Sequence
  Synthetic Construct
RADKFDY

SEQ ID NO: 11710 - protein, 7 aa, Artificial Sequence
  Synthetic Construct
SQPDVTY

SEQ ID NO: 11711 - protein, 7 aa, Artificial Sequence
  Synthetic Construct
VLTQQTH

SEQ ID NO: 11712 - protein, 7 aa, Artificial Sequence
  Synthetic Construct
TDNSTTR

SEQ ID NO: 11713 - protein, 7 aa, Artificial Sequence
  Synthetic Construct
YNTRYDA

SEQ ID NO: 11714 - protein, 7 aa, Artificial Sequence
  Synthetic Construct
SANDARV

SEQ ID NO: 11715 - protein, 7 aa, Artificial Sequence
  Synthetic Construct
ILTPDLR

SEQ ID NO: 11716 - protein, 7 aa, Artificial Sequence
  Synthetic Construct
PNVGASS

SEQ ID NO: 11717 - protein, 7 aa, Artificial Sequence
  Synthetic Construct
LSASHTI

SEQ ID NO: 11718 - protein, 7 aa, Artificial Sequence
  Synthetic Construct
TKVLIEK

SEQ ID NO: 11719 - protein, 7 aa, Artificial Sequence
  Synthetic Construct
MNTLIPA

SEQ ID NO: 11720 - protein, 7 aa, Artificial Sequence
  Synthetic Construct
SSNVVTT

SEQ ID NO: 11721 - protein, 7 aa, Artificial Sequence
  Synthetic Construct
MNVRPTT

SEQ ID NO: 11722 - protein, 7 aa, Artificial Sequence
  Synthetic Construct
DTGLNNR

SEQ ID NO: 11723 - protein, 7 aa, Artificial Sequence
  Synthetic Construct
TLNRDHM

SEQ ID NO: 11724 - protein, 7 aa, Artificial Sequence
  Synthetic Construct
LLLSHHA

SEQ ID NO: 11725 - protein, 7 aa, Artificial Sequence
  Synthetic Construct
NPAMATF

SEQ ID NO: 11726 - protein, 7 aa, Artificial Sequence
  Synthetic Construct
ISQRIYA

SEQ ID NO: 11727 - protein, 7 aa, Artificial Sequence
  Synthetic Construct
TTGVAGS

SEQ ID NO: 11728 - protein, 7 aa, Artificial Sequence
  Synthetic Construct
FGTFPTP

SEQ ID NO: 11729 - protein, 7 aa, Artificial Sequence
  Synthetic Construct
RGSDFDS

SEQ ID NO: 11730 - protein, 7 aa, Artificial Sequence
  Synthetic Construct
SKASLDS

SEQ ID NO: 11731 - protein, 7 aa, Artificial Sequence
  Synthetic Construct
LLNSHSA

SEQ ID NO: 11732 - protein, 7 aa, Artificial Sequence
  Synthetic Construct
ASIHKDI

SEQ ID NO: 11733 - protein, 7 aa, Artificial Sequence
  Synthetic Construct
SDPGKFM

SEQ ID NO: 11734 - protein, 7 aa, Artificial Sequence
  Synthetic Construct
GTSSAQR

SEQ ID NO: 11735 - protein, 7 aa, Artificial Sequence
  Synthetic Construct
STNSKLE

SEQ ID NO: 11736 - protein, 7 aa, Artificial Sequence
  Synthetic Construct
NLQTVPN

SEQ ID NO: 11737 - protein, 7 aa, Artificial Sequence
  Synthetic Construct
VVTHLNA

SEQ ID NO: 11738 - protein, 7 aa, Artificial Sequence
  Synthetic Construct
LSTSNNF

SEQ ID NO: 11739 - protein, 7 aa, Artificial Sequence
  Synthetic Construct
NNSGHIS

SEQ ID NO: 11740 - protein, 7 aa, Artificial Sequence
  Synthetic Construct
AYQVNSD

SEQ ID NO: 11741 - protein, 7 aa, Artificial Sequence
  Synthetic Construct
QQNYLNH

SEQ ID NO: 11742 - protein, 7 aa, Artificial Sequence
  Synthetic Construct
FATTNTG

SEQ ID NO: 11743 - protein, 7 aa, Artificial Sequence
  Synthetic Construct
LANKIAN

SEQ ID NO: 11744 - protein, 7 aa, Artificial Sequence
  Synthetic Construct
QSFQREV

SEQ ID NO: 11745 - protein, 7 aa, Artificial Sequence
  Synthetic Construct
LHISEPR

SEQ ID NO: 11746 - protein, 7 aa, Artificial Sequence
  Synthetic Construct
RVGEREQ

SEQ ID NO: 11747 - protein, 7 aa, Artificial Sequence
  Synthetic Construct
VNIIQAS

SEQ ID NO: 11748 - protein, 7 aa, Artificial Sequence
  Synthetic Construct
GVGLHNK

SEQ ID NO: 11749 - protein, 7 aa, Artificial Sequence
  Synthetic Construct
NNPAIPI

SEQ ID NO: 11750 - protein, 7 aa, Artificial Sequence
  Synthetic Construct
RLSSQAV

SEQ ID NO: 11751 - protein, 7 aa, Artificial Sequence
  Synthetic Construct
HSNELRP

SEQ ID NO: 11752 - protein, 7 aa, Artificial Sequence
  Synthetic Construct
SLGPTTN

SEQ ID NO: 11753 - protein, 7 aa, Artificial Sequence
  Synthetic Construct
GNQTNRS

SEQ ID NO: 11754 - protein, 7 aa, Artificial Sequence
  Synthetic Construct
SNPVGNP

SEQ ID NO: 11755 - protein, 7 aa, Artificial Sequence
  Synthetic Construct
QVPPLVP

SEQ ID NO: 11756 - protein, 7 aa, Artificial Sequence
  Synthetic Construct
LSTPPTQ

SEQ ID NO: 11757 - protein, 7 aa, Artificial Sequence
  Synthetic Construct
VGTEPLS

SEQ ID NO: 11758 - protein, 7 aa, Artificial Sequence
  Synthetic Construct
RPDATSH

SEQ ID NO: 11759 - protein, 7 aa, Artificial Sequence
  Synthetic Construct
VEKQMLN

SEQ ID NO: 11760 - protein, 7 aa, Artificial Sequence
  Synthetic Construct
FKSAQAT

SEQ ID NO: 11761 - protein, 7 aa, Artificial Sequence
  Synthetic Construct
WALSTDG

SEQ ID NO: 11762 - protein, 7 aa, Artificial Sequence
  Synthetic Construct
LAGLATN

SEQ ID NO: 11763 - protein, 7 aa, Artificial Sequence
  Synthetic Construct
TLTAGTP

SEQ ID NO: 11764 - protein, 7 aa, Artificial Sequence
  Synthetic Construct
IPVTSRM

SEQ ID NO: 11765 - protein, 7 aa, Artificial Sequence
  Synthetic Construct
GTDYPRS

SEQ ID NO: 11766 - protein, 7 aa, Artificial Sequence
  Synthetic Construct
VTEHSKL

SEQ ID NO: 11767 - protein, 7 aa, Artificial Sequence
  Synthetic Construct
NMSMPVK

SEQ ID NO: 11768 - protein, 7 aa, Artificial Sequence
  Synthetic Construct
SVGVGMS

SEQ ID NO: 11769 - protein, 7 aa, Artificial Sequence
  Synthetic Construct
PRTDNEG

SEQ ID NO: 11770 - protein, 7 aa, Artificial Sequence
  Synthetic Construct
FSNPDRT

SEQ ID NO: 11771 - protein, 7 aa, Artificial Sequence
  Synthetic Construct
MHLVPTT

SEQ ID NO: 11772 - protein, 7 aa, Artificial Sequence
  Synthetic Construct
NAPPVSS

SEQ ID NO: 11773 - protein, 7 aa, Artificial Sequence
  Synthetic Construct
SNLPTLA

SEQ ID NO: 11774 - protein, 7 aa, Artificial Sequence
  Synthetic Construct
IMQGMTT

SEQ ID NO: 11775 - protein, 7 aa, Artificial Sequence
  Synthetic Construct
SRETTSP

SEQ ID NO: 11776 - protein, 7 aa, Artificial Sequence
  Synthetic Construct
NPTSFST

SEQ ID NO: 11777 - protein, 7 aa, Artificial Sequence
  Synthetic Construct
NLQHGST

SEQ ID NO: 11778 - protein, 7 aa, Artificial Sequence
  Synthetic Construct
NFHSGHT

SEQ ID NO: 11779 - protein, 7 aa, Artificial Sequence
  Synthetic Construct
TESVYAR

SEQ ID NO: 11780 - protein, 7 aa, Artificial Sequence
  Synthetic Construct
TKSEIPN

SEQ ID NO: 11781 - protein, 7 aa, Artificial Sequence
  Synthetic Construct
TSLADMR

SEQ ID NO: 11782 - protein, 7 aa, Artificial Sequence
  Synthetic Construct
RLKADIT

SEQ ID NO: 11783 - protein, 7 aa, Artificial Sequence
  Synthetic Construct
LNMNVLA

SEQ ID NO: 11784 - protein, 7 aa, Artificial Sequence
  Synthetic Construct
SLRPISV

SEQ ID NO: 11785 - protein, 7 aa, Artificial Sequence
  Synthetic Construct
LSVQLVE

SEQ ID NO: 11786 - protein, 7 aa, Artificial Sequence
  Synthetic Construct
SFEGVLP

SEQ ID NO: 11787 - protein, 7 aa, Artificial Sequence
  Synthetic Construct
IIVGLQP

SEQ ID NO: 11788 - protein, 7 aa, Artificial Sequence
  Synthetic Construct
VSSYERL

SEQ ID NO: 11789 - protein, 7 aa, Artificial Sequence
  Synthetic Construct
RTNDAIV

SEQ ID NO: 11790 - protein, 7 aa, Artificial Sequence
  Synthetic Construct
FSEHREL

SEQ ID NO: 11791 - protein, 7 aa, Artificial Sequence
  Synthetic Construct
KEATANT

SEQ ID NO: 11792 - protein, 7 aa, Artificial Sequence
  Synthetic Construct
LRASITV

SEQ ID NO: 11793 - protein, 7 aa, Artificial Sequence
  Synthetic Construct
WLGITEA

SEQ ID NO: 11794 - protein, 7 aa, Artificial Sequence
  Synthetic Construct
SSQKAAE

SEQ ID NO: 11795 - protein, 7 aa, Artificial Sequence
  Synthetic Construct
GSTPGLA

SEQ ID NO: 11796 - protein, 7 aa, Artificial Sequence
  Synthetic Construct
KGNANDL

SEQ ID NO: 11797 - protein, 7 aa, Artificial Sequence
  Synthetic Construct
TSAPLKL

SEQ ID NO: 11798 - protein, 7 aa, Artificial Sequence
  Synthetic Construct
PVQTNGH

SEQ ID NO: 11799 - protein, 7 aa, Artificial Sequence
  Synthetic Construct
RPAVDSA

SEQ ID NO: 11800 - protein, 7 aa, Artificial Sequence
  Synthetic Construct
TTLSQNR

SEQ ID NO: 11801 - protein, 7 aa, Artificial Sequence
  Synthetic Construct
VMTVGSL

SEQ ID NO: 11802 - protein, 7 aa, Artificial Sequence
  Synthetic Construct
ALNKENW

SEQ ID NO: 11803 - protein, 7 aa, Artificial Sequence
  Synthetic Construct
HHHLTGN

SEQ ID NO: 11804 - protein, 7 aa, Artificial Sequence
  Synthetic Construct
GMRTVNI

SEQ ID NO: 11805 - protein, 7 aa, Artificial Sequence
  Synthetic Construct
TLNSSVA

SEQ ID NO: 11806 - protein, 7 aa, Artificial Sequence
  Synthetic Construct
SASTILV

SEQ ID NO: 11807 - protein, 7 aa, Artificial Sequence
  Synthetic Construct
EMIRPRA

SEQ ID NO: 11808 - protein, 7 aa, Artificial Sequence
  Synthetic Construct
MSAASYK

SEQ ID NO: 11809 - protein, 7 aa, Artificial Sequence
  Synthetic Construct
HFTTGSV

SEQ ID NO: 11810 - protein, 7 aa, Artificial Sequence
  Synthetic Construct
ASHTIGL

SEQ ID NO: 11811 - protein, 7 aa, Artificial Sequence
  Synthetic Construct
SREHQLY

SEQ ID NO: 11812 - protein, 7 aa, Artificial Sequence
  Synthetic Construct
AGTTAPL

SEQ ID NO: 11813 - protein, 7 aa, Artificial Sequence
  Synthetic Construct
GKVSGAM

SEQ ID NO: 11814 - protein, 7 aa, Artificial Sequence
  Synthetic Construct
KLSGMSV

SEQ ID NO: 11815 - protein, 7 aa, Artificial Sequence
  Synthetic Construct
VLPKDDA

SEQ ID NO: 11816 - protein, 7 aa, Artificial Sequence
  Synthetic Construct
LAGILTT

SEQ ID NO: 11817 - protein, 7 aa, Artificial Sequence
  Synthetic Construct
VVPGAQT

SEQ ID NO: 11818 - protein, 7 aa, Artificial Sequence
  Synthetic Construct
GQHSYAH

SEQ ID NO: 11819 - protein, 7 aa, Artificial Sequence
  Synthetic Construct
HHLSTSI

SEQ ID NO: 11820 - protein, 7 aa, Artificial Sequence
  Synthetic Construct
TLIPPNP

SEQ ID NO: 11821 - protein, 7 aa, Artificial Sequence
  Synthetic Construct
EMHNPRA

SEQ ID NO: 11822 - protein, 7 aa, Artificial Sequence
  Synthetic Construct
IENPPRG

SEQ ID NO: 11823 - protein, 7 aa, Artificial Sequence
  Synthetic Construct
GQFSDAR

SEQ ID NO: 11824 - protein, 7 aa, Artificial Sequence
  Synthetic Construct
AEASASR

SEQ ID NO: 11825 - protein, 7 aa, Artificial Sequence
  Synthetic Construct
LVKGDAR

SEQ ID NO: 11826 - protein, 7 aa, Artificial Sequence
  Synthetic Construct
QGHTHGN

SEQ ID NO: 11827 - protein, 7 aa, Artificial Sequence
  Synthetic Construct
QKPTSTF

SEQ ID NO: 11828 - protein, 7 aa, Artificial Sequence
  Synthetic Construct
KLAALGA

SEQ ID NO: 11829 - protein, 7 aa, Artificial Sequence
  Synthetic Construct
SSVDQMK

SEQ ID NO: 11830 - protein, 7 aa, Artificial Sequence
  Synthetic Construct
GIVTAPL

SEQ ID NO: 11831 - protein, 7 aa, Artificial Sequence
  Synthetic Construct
LLKMPSP

SEQ ID NO: 11832 - protein, 7 aa, Artificial Sequence
  Synthetic Construct
NVAHTVR

SEQ ID NO: 11833 - protein, 7 aa, Artificial Sequence
  Synthetic Construct
LMSTNVS

SEQ ID NO: 11834 - protein, 7 aa, Artificial Sequence
  Synthetic Construct
LSNNNAL

SEQ ID NO: 11835 - protein, 7 aa, Artificial Sequence
  Synthetic Construct
LLIGPTG

SEQ ID NO: 11836 - protein, 7 aa, Artificial Sequence
  Synthetic Construct
VRNTMIS

SEQ ID NO: 11837 - protein, 7 aa, Artificial Sequence
  Synthetic Construct
GATGHLT

SEQ ID NO: 11838 - protein, 7 aa, Artificial Sequence
  Synthetic Construct
MTVGNLG

SEQ ID NO: 11839 - protein, 7 aa, Artificial Sequence
  Synthetic Construct
SNGLNGL

SEQ ID NO: 11840 - protein, 7 aa, Artificial Sequence
  Synthetic Construct
RNENESR

SEQ ID NO: 11841 - protein, 7 aa, Artificial Sequence
  Synthetic Construct
GNARDAS

SEQ ID NO: 11842 - protein, 7 aa, Artificial Sequence
  Synthetic Construct
ISKLLLS

SEQ ID NO: 11843 - protein, 7 aa, Artificial Sequence
  Synthetic Construct
NDTTNMS

SEQ ID NO: 11844 - protein, 7 aa, Artificial Sequence
  Synthetic Construct
GLEANKS

SEQ ID NO: 11845 - protein, 7 aa, Artificial Sequence
  Synthetic Construct
HYSTVGV

SEQ ID NO: 11846 - protein, 7 aa, Artificial Sequence
  Synthetic Construct
PTISVLP

SEQ ID NO: 11847 - protein, 7 aa, Artificial Sequence
  Synthetic Construct
VQTIGHE

SEQ ID NO: 11848 - protein, 7 aa, Artificial Sequence
  Synthetic Construct
KPETASD

SEQ ID NO: 11849 - protein, 7 aa, Artificial Sequence
  Synthetic Construct
TNTPTSR

SEQ ID NO: 11850 - protein, 7 aa, Artificial Sequence
  Synthetic Construct
SLTLSSH

SEQ ID NO: 11851 - protein, 7 aa, Artificial Sequence
  Synthetic Construct
HYHSIQA

SEQ ID NO: 11852 - protein, 7 aa, Artificial Sequence
  Synthetic Construct
YHGENER

SEQ ID NO: 11853 - protein, 7 aa, Artificial Sequence
  Synthetic Construct
LPHTARV

SEQ ID NO: 11854 - protein, 7 aa, Artificial Sequence
  Synthetic Construct
TREGSTG

SEQ ID NO: 11855 - protein, 7 aa, Artificial Sequence
  Synthetic Construct
VDRRAML

SEQ ID NO: 11856 - protein, 7 aa, Artificial Sequence
  Synthetic Construct
TSVSAVM

SEQ ID NO: 11857 - protein, 7 aa, Artificial Sequence
  Synthetic Construct
SQKLTEK

SEQ ID NO: 11858 - protein, 7 aa, Artificial Sequence
  Synthetic Construct
RLPSLSV

SEQ ID NO: 11859 - protein, 7 aa, Artificial Sequence
  Synthetic Construct
SVSEGSR

SEQ ID NO: 11860 - protein, 7 aa, Artificial Sequence
  Synthetic Construct
SIPSVSA

SEQ ID NO: 11861 - protein, 7 aa, Artificial Sequence
  Synthetic Construct
TTNNAKS

SEQ ID NO: 11862 - protein, 7 aa, Artificial Sequence
  Synthetic Construct
ASGEAST

SEQ ID NO: 11863 - protein, 7 aa, Artificial Sequence
  Synthetic Construct
DNNSSIA

SEQ ID NO: 11864 - protein, 7 aa, Artificial Sequence
  Synthetic Construct
VHDNSKL

SEQ ID NO: 11865 - protein, 7 aa, Artificial Sequence
  Synthetic Construct
STLAGSE

SEQ ID NO: 11866 - protein, 7 aa, Artificial Sequence
  Synthetic Construct
PEKSHSS

SEQ ID NO: 11867 - protein, 7 aa, Artificial Sequence
  Synthetic Construct
QMLRASV

SEQ ID NO: 11868 - protein, 7 aa, Artificial Sequence
  Synthetic Construct
ALSNNIT

SEQ ID NO: 11869 - protein, 7 aa, Artificial Sequence
  Synthetic Construct
SLANQLP

SEQ ID NO: 11870 - protein, 7 aa, Artificial Sequence
  Synthetic Construct
EQSRLQT

SEQ ID NO: 11871 - protein, 7 aa, Artificial Sequence
  Synthetic Construct
NLSQNVM

SEQ ID NO: 11872 - protein, 7 aa, Artificial Sequence
  Synthetic Construct
SHKLSSS

SEQ ID NO: 11873 - protein, 7 aa, Artificial Sequence
  Synthetic Construct
PTNTKTA

SEQ ID NO: 11874 - protein, 7 aa, Artificial Sequence
  Synthetic Construct
MNPATVA

SEQ ID NO: 11875 - protein, 7 aa, Artificial Sequence
  Synthetic Construct
KIERTNF

SEQ ID NO: 11876 - protein, 7 aa, Artificial Sequence
  Synthetic Construct
TSPTYKL

SEQ ID NO: 11877 - protein, 7 aa, Artificial Sequence
  Synthetic Construct
RSDHIDY

SEQ ID NO: 11878 - protein, 7 aa, Artificial Sequence
  Synthetic Construct
TLGLNTN

SEQ ID NO: 11879 - protein, 7 aa, Artificial Sequence
  Synthetic Construct
PLSNHGT

SEQ ID NO: 11880 - protein, 7 aa, Artificial Sequence
  Synthetic Construct
AVSRLPM

SEQ ID NO: 11881 - protein, 7 aa, Artificial Sequence
  Synthetic Construct
LLTESKM

SEQ ID NO: 11882 - protein, 7 aa, Artificial Sequence
  Synthetic Construct
HMRTDTA

SEQ ID NO: 11883 - protein, 7 aa, Artificial Sequence
  Synthetic Construct
SLTVNAA

SEQ ID NO: 11884 - protein, 7 aa, Artificial Sequence
  Synthetic Construct
NPNGVTV

SEQ ID NO: 11885 - protein, 7 aa, Artificial Sequence
  Synthetic Construct
TTKLPTL

SEQ ID NO: 11886 - protein, 7 aa, Artificial Sequence
  Synthetic Construct
NSTSKQL

SEQ ID NO: 11887 - protein, 7 aa, Artificial Sequence
  Synthetic Construct
TLGSSNT

SEQ ID NO: 11888 - protein, 7 aa, Artificial Sequence
  Synthetic Construct
PRATDPQ

SEQ ID NO: 11889 - protein, 7 aa, Artificial Sequence
  Synthetic Construct
SLLNKTT

SEQ ID NO: 11890 - protein, 7 aa, Artificial Sequence
  Synthetic Construct
QKSDGSP

SEQ ID NO: 11891 - protein, 7 aa, Artificial Sequence
  Synthetic Construct
TVSGFTK

SEQ ID NO: 11892 - protein, 7 aa, Artificial Sequence
  Synthetic Construct
TVLVKST

SEQ ID NO: 11893 - protein, 7 aa, Artificial Sequence
  Synthetic Construct
GAHISNP

SEQ ID NO: 11894 - protein, 7 aa, Artificial Sequence
  Synthetic Construct
EPSIPRP

SEQ ID NO: 11895 - protein, 7 aa, Artificial Sequence
  Synthetic Construct
GTVQARQ

SEQ ID NO: 11896 - protein, 7 aa, Artificial Sequence
  Synthetic Construct
NNHNYVD

SEQ ID NO: 11897 - protein, 7 aa, Artificial Sequence
  Synthetic Construct
RTASVSL

SEQ ID NO: 11898 - protein, 7 aa, Artificial Sequence
  Synthetic Construct
ISMDNHR

SEQ ID NO: 11899 - protein, 7 aa, Artificial Sequence
  Synthetic Construct
SDGHNHS

SEQ ID NO: 11900 - protein, 7 aa, Artificial Sequence
  Synthetic Construct
SAGSGIG

SEQ ID NO: 11901 - protein, 7 aa, Artificial Sequence
  Synthetic Construct
KATLSEK

SEQ ID NO: 11902 - protein, 7 aa, Artificial Sequence
  Synthetic Construct
IHAGGQR

SEQ ID NO: 11903 - protein, 7 aa, Artificial Sequence
  Synthetic Construct
LTPSSAN

SEQ ID NO: 11904 - protein, 7 aa, Artificial Sequence
  Synthetic Construct
DGKAYNH

SEQ ID NO: 11905 - protein, 7 aa, Artificial Sequence
  Synthetic Construct
WSAQTMN

SEQ ID NO: 11906 - protein, 7 aa, Artificial Sequence
  Synthetic Construct
NSTRIIV

SEQ ID NO: 11907 - protein, 7 aa, Artificial Sequence
  Synthetic Construct
KNSSMLL

SEQ ID NO: 11908 - protein, 7 aa, Artificial Sequence
  Synthetic Construct
RQVSGTS

SEQ ID NO: 11909 - protein, 7 aa, Artificial Sequence
  Synthetic Construct
PVTGNSD

SEQ ID NO: 11910 - protein, 7 aa, Artificial Sequence
  Synthetic Construct
MYPDRHS

SEQ ID NO: 11911 - protein, 7 aa, Artificial Sequence
  Synthetic Construct
TYQIGAV

SEQ ID NO: 11912 - protein, 7 aa, Artificial Sequence
  Synthetic Construct
KTGSLSA

SEQ ID NO: 11913 - protein, 7 aa, Artificial Sequence
  Synthetic Construct
IIPASSP

SEQ ID NO: 11914 - protein, 7 aa, Artificial Sequence
  Synthetic Construct
DNQGTKH

SEQ ID NO: 11915 - protein, 7 aa, Artificial Sequence
  Synthetic Construct
SYKESPS

SEQ ID NO: 11916 - protein, 7 aa, Artificial Sequence
  Synthetic Construct
AIISNNR

SEQ ID NO: 11917 - protein, 7 aa, Artificial Sequence
  Synthetic Construct
TDQIRTY

SEQ ID NO: 11918 - protein, 7 aa, Artificial Sequence
  Synthetic Construct
HSATNID

SEQ ID NO: 11919 - protein, 7 aa, Artificial Sequence
  Synthetic Construct
GTVNISA

SEQ ID NO: 11920 - protein, 7 aa, Artificial Sequence
  Synthetic Construct
AVVPAMQ

SEQ ID NO: 11921 - protein, 7 aa, Artificial Sequence
  Synthetic Construct
IPRSDPS

SEQ ID NO: 11922 - protein, 7 aa, Artificial Sequence
  Synthetic Construct
TKYTLQS

SEQ ID NO: 11923 - protein, 7 aa, Artificial Sequence
  Synthetic Construct
SLRETSI

SEQ ID NO: 11924 - protein, 7 aa, Artificial Sequence
  Synthetic Construct
EGDNKRL

SEQ ID NO: 11925 - protein, 7 aa, Artificial Sequence
  Synthetic Construct
IVSSTSS

SEQ ID NO: 11926 - protein, 7 aa, Artificial Sequence
  Synthetic Construct
LVNSGAH

SEQ ID NO: 11927 - protein, 7 aa, Artificial Sequence
  Synthetic Construct
RTSDNQT

SEQ ID NO: 11928 - protein, 7 aa, Artificial Sequence
  Synthetic Construct
PDGKSLA

SEQ ID NO: 11929 - protein, 7 aa, Artificial Sequence
  Synthetic Construct
HKNMLET

SEQ ID NO: 11930 - protein, 7 aa, Artificial Sequence
  Synthetic Construct
LSPGVTA

SEQ ID NO: 11931 - protein, 7 aa, Artificial Sequence
  Synthetic Construct
TNHTRNT

SEQ ID NO: 11932 - protein, 7 aa, Artificial Sequence
  Synthetic Construct
LGDSERN

SEQ ID NO: 11933 - protein, 7 aa, Artificial Sequence
  Synthetic Construct
LLKIEQM

SEQ ID NO: 11934 - protein, 7 aa, Artificial Sequence
  Synthetic Construct
SHLKEHP

SEQ ID NO: 11935 - protein, 7 aa, Artificial Sequence
  Synthetic Construct
PIDNRQY

SEQ ID NO: 11936 - protein, 7 aa, Artificial Sequence
  Synthetic Construct
DMHSGVK

SEQ ID NO: 11937 - protein, 7 aa, Artificial Sequence
  Synthetic Construct
PSSPIPN

SEQ ID NO: 11938 - protein, 7 aa, Artificial Sequence
  Synthetic Construct
LSSTLDD

SEQ ID NO: 11939 - protein, 7 aa, Artificial Sequence
  Synthetic Construct
PNTAHSS

SEQ ID NO: 11940 - protein, 7 aa, Artificial Sequence
  Synthetic Construct
ATRVDVI

SEQ ID NO: 11941 - protein, 7 aa, Artificial Sequence
  Synthetic Construct
STNVTTV

SEQ ID NO: 11942 - protein, 7 aa, Artificial Sequence
  Synthetic Construct
YGNNSFS

SEQ ID NO: 11943 - protein, 7 aa, Artificial Sequence
  Synthetic Construct
PTAKPMY

SEQ ID NO: 11944 - protein, 7 aa, Artificial Sequence
  Synthetic Construct
LPNLPTI

SEQ ID NO: 11945 - protein, 7 aa, Artificial Sequence
  Synthetic Construct
TRLPNIS

SEQ ID NO: 11946 - protein, 7 aa, Artificial Sequence
  Synthetic Construct
HKHSTQG

SEQ ID NO: 11947 - protein, 7 aa, Artificial Sequence
  Synthetic Construct
NGTNGFT

SEQ ID NO: 11948 - protein, 7 aa, Artificial Sequence
  Synthetic Construct
STDAIRF

SEQ ID NO: 11949 - protein, 7 aa, Artificial Sequence
  Synthetic Construct
LVRDHTA

SEQ ID NO: 11950 - protein, 7 aa, Artificial Sequence
  Synthetic Construct
ISLGYSK

SEQ ID NO: 11951 - protein, 7 aa, Artificial Sequence
  Synthetic Construct
LFGSSHT

SEQ ID NO: 11952 - protein, 7 aa, Artificial Sequence
  Synthetic Construct
STITPRL

SEQ ID NO: 11953 - protein, 7 aa, Artificial Sequence
  Synthetic Construct
QITNGLR

SEQ ID NO: 11954 - protein, 7 aa, Artificial Sequence
  Synthetic Construct
TTEYNIR

SEQ ID NO: 11955 - protein, 7 aa, Artificial Sequence
  Synthetic Construct
TDLGRGT

SEQ ID NO: 11956 - protein, 7 aa, Artificial Sequence
  Synthetic Construct
ERSPTIL

SEQ ID NO: 11957 - protein, 7 aa, Artificial Sequence
  Synthetic Construct
HGDSART

SEQ ID NO: 11958 - protein, 7 aa, Artificial Sequence
  Synthetic Construct
LSVPNQQ

SEQ ID NO: 11959 - protein, 7 aa, Artificial Sequence
  Synthetic Construct
SDGPVPR

SEQ ID NO: 11960 - protein, 7 aa, Artificial Sequence
  Synthetic Construct
NMNHIAS

SEQ ID NO: 11961 - protein, 7 aa, Artificial Sequence
  Synthetic Construct
VPNSPQR

SEQ ID NO: 11962 - protein, 7 aa, Artificial Sequence
  Synthetic Construct
DRMASSR

SEQ ID NO: 11963 - protein, 7 aa, Artificial Sequence
  Synthetic Construct
LLSNSSQ

SEQ ID NO: 11964 - protein, 7 aa, Artificial Sequence
  Synthetic Construct
ETAVLNH

SEQ ID NO: 11965 - protein, 7 aa, Artificial Sequence
  Synthetic Construct
EQRTPSP

SEQ ID NO: 11966 - protein, 7 aa, Artificial Sequence
  Synthetic Construct
QHLNGSI

SEQ ID NO: 11967 - protein, 7 aa, Artificial Sequence
  Synthetic Construct
SVLQVEG

SEQ ID NO: 11968 - protein, 7 aa, Artificial Sequence
  Synthetic Construct
FLSGTTK

SEQ ID NO: 11969 - protein, 7 aa, Artificial Sequence
  Synthetic Construct
GNPNDRQ

SEQ ID NO: 11970 - protein, 7 aa, Artificial Sequence
  Synthetic Construct
TDKAVQI

SEQ ID NO: 11971 - protein, 7 aa, Artificial Sequence
  Synthetic Construct
EKYTGSP

SEQ ID NO: 11972 - protein, 7 aa, Artificial Sequence
  Synthetic Construct
LAGSRNL

SEQ ID NO: 11973 - protein, 7 aa, Artificial Sequence
  Synthetic Construct
MIPSTNF

SEQ ID NO: 11974 - protein, 7 aa, Artificial Sequence
  Synthetic Construct
PLTGSSA

SEQ ID NO: 11975 - protein, 7 aa, Artificial Sequence
  Synthetic Construct
SVSNAFS

SEQ ID NO: 11976 - protein, 7 aa, Artificial Sequence
  Synthetic Construct
QGGQALR

SEQ ID NO: 11977 - protein, 7 aa, Artificial Sequence
  Synthetic Construct
HPGQTLS

SEQ ID NO: 11978 - protein, 7 aa, Artificial Sequence
  Synthetic Construct
KEYNTYS

SEQ ID NO: 11979 - protein, 7 aa, Artificial Sequence
  Synthetic Construct
THTAQPS

SEQ ID NO: 11980 - protein, 7 aa, Artificial Sequence
  Synthetic Construct
MTPQVPR

SEQ ID NO: 11981 - protein, 7 aa, Artificial Sequence
  Synthetic Construct
TRVSSLA

SEQ ID NO: 11982 - protein, 7 aa, Artificial Sequence
  Synthetic Construct
HADLKIV

SEQ ID NO: 11983 - protein, 7 aa, Artificial Sequence
  Synthetic Construct
NRNTDTV

SEQ ID NO: 11984 - protein, 7 aa, Artificial Sequence
  Synthetic Construct
AHKDNHL

SEQ ID NO: 11985 - protein, 7 aa, Artificial Sequence
  Synthetic Construct
SVPVPAA

SEQ ID NO: 11986 - protein, 7 aa, Artificial Sequence
  Synthetic Construct
QTNSALM

SEQ ID NO: 11987 - protein, 7 aa, Artificial Sequence
  Synthetic Construct
LGRDTAY

SEQ ID NO: 11988 - protein, 7 aa, Artificial Sequence
  Synthetic Construct
SSVALVV

SEQ ID NO: 11989 - protein, 7 aa, Artificial Sequence
  Synthetic Construct
MNAATTQ

SEQ ID NO: 11990 - protein, 7 aa, Artificial Sequence
  Synthetic Construct
MVSTAKD

SEQ ID NO: 11991 - protein, 7 aa, Artificial Sequence
  Synthetic Construct
LGQMYSP

SEQ ID NO: 11992 - protein, 7 aa, Artificial Sequence
  Synthetic Construct
DSKEKPN

SEQ ID NO: 11993 - protein, 7 aa, Artificial Sequence
  Synthetic Construct
SPPVQGL

SEQ ID NO: 11994 - protein, 7 aa, Artificial Sequence
  Synthetic Construct
TASDRLP

SEQ ID NO: 11995 - protein, 7 aa, Artificial Sequence
  Synthetic Construct
IYSPTTV

SEQ ID NO: 11996 - protein, 7 aa, Artificial Sequence
  Synthetic Construct
SQSKELR

SEQ ID NO: 11997 - protein, 7 aa, Artificial Sequence
  Synthetic Construct
GALNGGV

SEQ ID NO: 11998 - protein, 7 aa, Artificial Sequence
  Synthetic Construct
TIINSSK

SEQ ID NO: 11999 - protein, 7 aa, Artificial Sequence
  Synthetic Construct
PVSAQPV

SEQ ID NO: 12000 - protein, 7 aa, Artificial Sequence
  Synthetic Construct
SNEAVTN

SEQ ID NO: 12001 - protein, 7 aa, Artificial Sequence
  Synthetic Construct
ASMQMNR

SEQ ID NO: 12002 - protein, 7 aa, Artificial Sequence
  Synthetic Construct
SVGKSEL

SEQ ID NO: 12003 - protein, 7 aa, Artificial Sequence
  Synthetic Construct
SQVNPSS

SEQ ID NO: 12004 - protein, 7 aa, Artificial Sequence
  Synthetic Construct
ITTDQPF

SEQ ID NO: 12005 - protein, 7 aa, Artificial Sequence
  Synthetic Construct
NNGSGSY

SEQ ID NO: 12006 - protein, 7 aa, Artificial Sequence
  Synthetic Construct
TLARSSV

SEQ ID NO: 12007 - protein, 7 aa, Artificial Sequence
  Synthetic Construct
NASTMTR

SEQ ID NO: 12008 - protein, 7 aa, Artificial Sequence
  Synthetic Construct
TNQVRYV

SEQ ID NO: 12009 - protein, 7 aa, Artificial Sequence
  Synthetic Construct
STQSPNR

SEQ ID NO: 12010 - protein, 7 aa, Artificial Sequence
  Synthetic Construct
DTGARGL

SEQ ID NO: 12011 - protein, 7 aa, Artificial Sequence
  Synthetic Construct
PGSHVVA

SEQ ID NO: 12012 - protein, 7 aa, Artificial Sequence
  Synthetic Construct
ANGIETK

SEQ ID NO: 12013 - protein, 7 aa, Artificial Sequence
  Synthetic Construct
AHGQVQE

SEQ ID NO: 12014 - protein, 7 aa, Artificial Sequence
  Synthetic Construct
ALSHDLS

SEQ ID NO: 12015 - protein, 7 aa, Artificial Sequence
  Synthetic Construct
LGSSLTA

SEQ ID NO: 12016 - protein, 7 aa, Artificial Sequence
  Synthetic Construct
GNNTAKL

SEQ ID NO: 12017 - protein, 7 aa, Artificial Sequence
  Synthetic Construct
NYAQSAL

SEQ ID NO: 12018 - protein, 7 aa, Artificial Sequence
  Synthetic Construct
DSQSKTF

SEQ ID NO: 12019 - protein, 7 aa, Artificial Sequence
  Synthetic Construct
TNHVKFT

SEQ ID NO: 12020 - protein, 7 aa, Artificial Sequence
  Synthetic Construct
STPTHGL

SEQ ID NO: 12021 - protein, 7 aa, Artificial Sequence
  Synthetic Construct
SVGLTMV

SEQ ID NO: 12022 - protein, 7 aa, Artificial Sequence
  Synthetic Construct
IPKGSGA

SEQ ID NO: 12023 - protein, 7 aa, Artificial Sequence
  Synthetic Construct
TAQARVL

SEQ ID NO: 12024 - protein, 7 aa, Artificial Sequence
  Synthetic Construct
WHAGSVG

SEQ ID NO: 12025 - protein, 7 aa, Artificial Sequence
  Synthetic Construct
SQSLLVE

SEQ ID NO: 12026 - protein, 7 aa, Artificial Sequence
  Synthetic Construct
NNSGPLK

SEQ ID NO: 12027 - protein, 7 aa, Artificial Sequence
  Synthetic Construct
RDNAIEH

SEQ ID NO: 12028 - protein, 7 aa, Artificial Sequence
  Synthetic Construct
TMSNITR

SEQ ID NO: 12029 - protein, 7 aa, Artificial Sequence
  Synthetic Construct
LSTLSQM

SEQ ID NO: 12030 - protein, 7 aa, Artificial Sequence
  Synthetic Construct
VMQNYGS

SEQ ID NO: 12031 - protein, 7 aa, Artificial Sequence
  Synthetic Construct
THSAQQN

SEQ ID NO: 12032 - protein, 7 aa, Artificial Sequence
  Synthetic Construct
SVPPNRN

SEQ ID NO: 12033 - protein, 7 aa, Artificial Sequence
  Synthetic Construct
SVAASPR

SEQ ID NO: 12034 - protein, 7 aa, Artificial Sequence
  Synthetic Construct
NNTSTLH

SEQ ID NO: 12035 - protein, 7 aa, Artificial Sequence
  Synthetic Construct
NLSDHMP

SEQ ID NO: 12036 - protein, 7 aa, Artificial Sequence
  Synthetic Construct
GLYATTS

SEQ ID NO: 12037 - protein, 7 aa, Artificial Sequence
  Synthetic Construct
RNGGANV

SEQ ID NO: 12038 - protein, 7 aa, Artificial Sequence
  Synthetic Construct
FHNLTLS

SEQ ID NO: 12039 - protein, 7 aa, Artificial Sequence
  Synthetic Construct
WKSPAAI

SEQ ID NO: 12040 - protein, 7 aa, Artificial Sequence
  Synthetic Construct
PKGLSGE

SEQ ID NO: 12041 - protein, 7 aa, Artificial Sequence
  Synthetic Construct
SHYQLHP

SEQ ID NO: 12042 - protein, 7 aa, Artificial Sequence
  Synthetic Construct
TTFRSAP

SEQ ID NO: 12043 - protein, 7 aa, Artificial Sequence
  Synthetic Construct
YDATHSA

SEQ ID NO: 12044 - protein, 7 aa, Artificial Sequence
  Synthetic Construct
NQSGPLK

SEQ ID NO: 12045 - protein, 7 aa, Artificial Sequence
  Synthetic Construct
HTNMTSM

SEQ ID NO: 12046 - protein, 7 aa, Artificial Sequence
  Synthetic Construct
HMKSQLP

SEQ ID NO: 12047 - protein, 7 aa, Artificial Sequence
  Synthetic Construct
KLPTMAN

SEQ ID NO: 12048 - protein, 7 aa, Artificial Sequence
  Synthetic Construct
VGTNANH

SEQ ID NO: 12049 - protein, 7 aa, Artificial Sequence
  Synthetic Construct
LKTDPFL

SEQ ID NO: 12050 - protein, 7 aa, Artificial Sequence
  Synthetic Construct
HLQQNLT

SEQ ID NO: 12051 - protein, 7 aa, Artificial Sequence
  Synthetic Construct
TQNKNSH

SEQ ID NO: 12052 - protein, 7 aa, Artificial Sequence
  Synthetic Construct
PNAQSQR

SEQ ID NO: 12053 - protein, 7 aa, Artificial Sequence
  Synthetic Construct
GSGHSTL

SEQ ID NO: 12054 - protein, 7 aa, Artificial Sequence
  Synthetic Construct
LTGRLEK

SEQ ID NO: 12055 - protein, 7 aa, Artificial Sequence
  Synthetic Construct
PSRNASL

SEQ ID NO: 12056 - protein, 7 aa, Artificial Sequence
  Synthetic Construct
VFRTSDL

SEQ ID NO: 12057 - protein, 7 aa, Artificial Sequence
  Synthetic Construct
IASTYSS

SEQ ID NO: 12058 - protein, 7 aa, Artificial Sequence
  Synthetic Construct
TINHATS

SEQ ID NO: 12059 - protein, 7 aa, Artificial Sequence
  Synthetic Construct
AMNNRAH

SEQ ID NO: 12060 - protein, 7 aa, Artificial Sequence
  Synthetic Construct
SHHEQVS

SEQ ID NO: 12061 - protein, 7 aa, Artificial Sequence
  Synthetic Construct
SGVTSKL

SEQ ID NO: 12062 - protein, 7 aa, Artificial Sequence
  Synthetic Construct
VFTNDVP

SEQ ID NO: 12063 - protein, 7 aa, Artificial Sequence
  Synthetic Construct
AAVLVAP

SEQ ID NO: 12064 - protein, 7 aa, Artificial Sequence
  Synthetic Construct
PTAGRYL

SEQ ID NO: 12065 - protein, 7 aa, Artificial Sequence
  Synthetic Construct
HLNSQNM

SEQ ID NO: 12066 - protein, 7 aa, Artificial Sequence
  Synthetic Construct
PNPNVGR

SEQ ID NO: 12067 - protein, 7 aa, Artificial Sequence
  Synthetic Construct
ASENLRS

SEQ ID NO: 12068 - protein, 7 aa, Artificial Sequence
  Synthetic Construct
NSPMRTA

SEQ ID NO: 12069 - protein, 7 aa, Artificial Sequence
  Synthetic Construct
VAGTNQP

SEQ ID NO: 12070 - protein, 7 aa, Artificial Sequence
  Synthetic Construct
GSESSMR

SEQ ID NO: 12071 - protein, 7 aa, Artificial Sequence
  Synthetic Construct
TLASASR

SEQ ID NO: 12072 - protein, 7 aa, Artificial Sequence
  Synthetic Construct
ISQSWTA

SEQ ID NO: 12073 - protein, 7 aa, Artificial Sequence
  Synthetic Construct
SGDSRST

SEQ ID NO: 12074 - protein, 7 aa, Artificial Sequence
  Synthetic Construct
PNIKTDL

SEQ ID NO: 12075 - protein, 7 aa, Artificial Sequence
  Synthetic Construct
WQATDTA

SEQ ID NO: 12076 - protein, 7 aa, Artificial Sequence
  Synthetic Construct
NNNVVTY

SEQ ID NO: 12077 - protein, 7 aa, Artificial Sequence
  Synthetic Construct
KAISTAN

SEQ ID NO: 12078 - protein, 7 aa, Artificial Sequence
  Synthetic Construct
RQEVSGN

SEQ ID NO: 12079 - protein, 7 aa, Artificial Sequence
  Synthetic Construct
WQDLNVV

SEQ ID NO: 12080 - protein, 7 aa, Artificial Sequence
  Synthetic Construct
SRSDNPL

SEQ ID NO: 12081 - protein, 7 aa, Artificial Sequence
  Synthetic Construct
IGSSTKP

SEQ ID NO: 12082 - protein, 7 aa, Artificial Sequence
  Synthetic Construct
SPIINTS

SEQ ID NO: 12083 - protein, 7 aa, Artificial Sequence
  Synthetic Construct
DKDTAAP

SEQ ID NO: 12084 - protein, 7 aa, Artificial Sequence
  Synthetic Construct
SKVDSSY

SEQ ID NO: 12085 - protein, 7 aa, Artificial Sequence
  Synthetic Construct
TLTRGTP

SEQ ID NO: 12086 - protein, 7 aa, Artificial Sequence
  Synthetic Construct
TRTSPIQ

SEQ ID NO: 12087 - protein, 7 aa, Artificial Sequence
  Synthetic Construct
LTSATTN

SEQ ID NO: 12088 - protein, 7 aa, Artificial Sequence
  Synthetic Construct
TINIHSA

SEQ ID NO: 12089 - protein, 7 aa, Artificial Sequence
  Synthetic Construct
SFSPENR

SEQ ID NO: 12090 - protein, 7 aa, Artificial Sequence
  Synthetic Construct
GMALGTG

SEQ ID NO: 12091 - protein, 7 aa, Artificial Sequence
  Synthetic Construct
YNGTQGR

SEQ ID NO: 12092 - protein, 7 aa, Artificial Sequence
  Synthetic Construct
NKLLEHP

SEQ ID NO: 12093 - protein, 7 aa, Artificial Sequence
  Synthetic Construct
YVNNVAP

SEQ ID NO: 12094 - protein, 7 aa, Artificial Sequence
  Synthetic Construct
YSVVHDK

SEQ ID NO: 12095 - protein, 7 aa, Artificial Sequence
  Synthetic Construct
GLETRHM

SEQ ID NO: 12096 - protein, 7 aa, Artificial Sequence
  Synthetic Construct
APNLMAD

SEQ ID NO: 12097 - protein, 7 aa, Artificial Sequence
  Synthetic Construct
NSNGMAP

SEQ ID NO: 12098 - protein, 7 aa, Artificial Sequence
  Synthetic Construct
SLNYSQN

SEQ ID NO: 12099 - protein, 7 aa, Artificial Sequence
  Synthetic Construct
TEYANGR

SEQ ID NO: 12100 - protein, 7 aa, Artificial Sequence
  Synthetic Construct
PLGHVRS

SEQ ID NO: 12101 - protein, 7 aa, Artificial Sequence
  Synthetic Construct
LRDSPGL

SEQ ID NO: 12102 - protein, 7 aa, Artificial Sequence
  Synthetic Construct
VIRSNTH

SEQ ID NO: 12103 - protein, 7 aa, Artificial Sequence
  Synthetic Construct
ASVSNLS

SEQ ID NO: 12104 - protein, 7 aa, Artificial Sequence
  Synthetic Construct
WAQRTSQ

SEQ ID NO: 12105 - protein, 7 aa, Artificial Sequence
  Synthetic Construct
NDKGMSR

SEQ ID NO: 12106 - protein, 7 aa, Artificial Sequence
  Synthetic Construct
QNDTRNY

SEQ ID NO: 12107 - protein, 7 aa, Artificial Sequence
  Synthetic Construct
GEVAGRL

SEQ ID NO: 12108 - protein, 7 aa, Artificial Sequence
  Synthetic Construct
TTTNTVS

SEQ ID NO: 12109 - protein, 7 aa, Artificial Sequence
  Synthetic Construct
PVMSNKD

SEQ ID NO: 12110 - protein, 7 aa, Artificial Sequence
  Synthetic Construct
NGGTTFI

SEQ ID NO: 12111 - protein, 7 aa, Artificial Sequence
  Synthetic Construct
VLKTTAI

SEQ ID NO: 12112 - protein, 7 aa, Artificial Sequence
  Synthetic Construct
PHGVGSA

SEQ ID NO: 12113 - protein, 7 aa, Artificial Sequence
  Synthetic Construct
SNAHPLA

SEQ ID NO: 12114 - protein, 7 aa, Artificial Sequence
  Synthetic Construct
KSTSLDP

SEQ ID NO: 12115 - protein, 7 aa, Artificial Sequence
  Synthetic Construct
FNKTNDM

SEQ ID NO: 12116 - protein, 7 aa, Artificial Sequence
  Synthetic Construct
HQTSELR

SEQ ID NO: 12117 - protein, 7 aa, Artificial Sequence
  Synthetic Construct
WAKVLDK

SEQ ID NO: 12118 - protein, 7 aa, Artificial Sequence
  Synthetic Construct
MSSNNKS

SEQ ID NO: 12119 - protein, 7 aa, Artificial Sequence
  Synthetic Construct
DGTHLKL

SEQ ID NO: 12120 - protein, 7 aa, Artificial Sequence
  Synthetic Construct
TVISDQR

SEQ ID NO: 12121 - protein, 7 aa, Artificial Sequence
  Synthetic Construct
MHSQLLP

SEQ ID NO: 12122 - protein, 7 aa, Artificial Sequence
  Synthetic Construct
SSYGTAA

SEQ ID NO: 12123 - protein, 7 aa, Artificial Sequence
  Synthetic Construct
VLSTMAV

SEQ ID NO: 12124 - protein, 7 aa, Artificial Sequence
  Synthetic Construct
SASNFAS

SEQ ID NO: 12125 - protein, 7 aa, Artificial Sequence
  Synthetic Construct
SKAGLSD

SEQ ID NO: 12126 - protein, 7 aa, Artificial Sequence
  Synthetic Construct
INRIVSG

SEQ ID NO: 12127 - protein, 7 aa, Artificial Sequence
  Synthetic Construct
KLDTPGK

SEQ ID NO: 12128 - protein, 7 aa, Artificial Sequence
  Synthetic Construct
MDRIVKM

SEQ ID NO: 12129 - protein, 7 aa, Artificial Sequence
  Synthetic Construct
RERSTDA

SEQ ID NO: 12130 - protein, 7 aa, Artificial Sequence
  Synthetic Construct
LRDSTGH

SEQ ID NO: 12131 - protein, 7 aa, Artificial Sequence
  Synthetic Construct
MRGQGVH

SEQ ID NO: 12132 - protein, 7 aa, Artificial Sequence
  Synthetic Construct
SAQMISP

SEQ ID NO: 12133 - protein, 7 aa, Artificial Sequence
  Synthetic Construct
WTNGVAK

SEQ ID NO: 12134 - protein, 7 aa, Artificial Sequence
  Synthetic Construct
TAISIQV

SEQ ID NO: 12135 - protein, 7 aa, Artificial Sequence
  Synthetic Construct
PSGSQSH

SEQ ID NO: 12136 - protein, 7 aa, Artificial Sequence
  Synthetic Construct
NRLTPGS

SEQ ID NO: 12137 - protein, 7 aa, Artificial Sequence
  Synthetic Construct
IALEHRN

SEQ ID NO: 12138 - protein, 7 aa, Artificial Sequence
  Synthetic Construct
PARTPPQ

SEQ ID NO: 12139 - protein, 7 aa, Artificial Sequence
  Synthetic Construct
MGKSNGV

SEQ ID NO: 12140 - protein, 7 aa, Artificial Sequence
  Synthetic Construct
PIVRSTS

SEQ ID NO: 12141 - protein, 7 aa, Artificial Sequence
  Synthetic Construct
VTQLSPR

SEQ ID NO: 12142 - protein, 7 aa, Artificial Sequence
  Synthetic Construct
KALLPLT

SEQ ID NO: 12143 - protein, 7 aa, Artificial Sequence
  Synthetic Construct
SGNSRLQ

SEQ ID NO: 12144 - protein, 7 aa, Artificial Sequence
  Synthetic Construct
RNQSAPL

SEQ ID NO: 12145 - protein, 7 aa, Artificial Sequence
  Synthetic Construct
NLQNMIQ

SEQ ID NO: 12146 - protein, 7 aa, Artificial Sequence
  Synthetic Construct
SSYDKSL

SEQ ID NO: 12147 - protein, 7 aa, Artificial Sequence
  Synthetic Construct
VLANQQI

SEQ ID NO: 12148 - protein, 7 aa, Artificial Sequence
  Synthetic Construct
RTTNEPT

SEQ ID NO: 12149 - protein, 7 aa, Artificial Sequence
  Synthetic Construct
IVSNQMS

SEQ ID NO: 12150 - protein, 7 aa, Artificial Sequence
  Synthetic Construct
NATHANV

SEQ ID NO: 12151 - protein, 7 aa, Artificial Sequence
  Synthetic Construct
KGNEPLR

SEQ ID NO: 12152 - protein, 7 aa, Artificial Sequence
  Synthetic Construct
LGTYLSP

SEQ ID NO: 12153 - protein, 7 aa, Artificial Sequence
  Synthetic Construct
TNVLPLP

SEQ ID NO: 12154 - protein, 7 aa, Artificial Sequence
  Synthetic Construct
KLSHEPS

SEQ ID NO: 12155 - protein, 7 aa, Artificial Sequence
  Synthetic Construct
FDKQNPT

SEQ ID NO: 12156 - protein, 7 aa, Artificial Sequence
  Synthetic Construct
FGGRYEK

SEQ ID NO: 12157 - protein, 7 aa, Artificial Sequence
  Synthetic Construct
TVQNHTN

SEQ ID NO: 12158 - protein, 7 aa, Artificial Sequence
  Synthetic Construct
PLKPMQT

SEQ ID NO: 12159 - protein, 7 aa, Artificial Sequence
  Synthetic Construct
QGETNHR

SEQ ID NO: 12160 - protein, 7 aa, Artificial Sequence
  Synthetic Construct
AHSNMVN

SEQ ID NO: 12161 - protein, 7 aa, Artificial Sequence
  Synthetic Construct
VSASSNK

SEQ ID NO: 12162 - protein, 7 aa, Artificial Sequence
  Synthetic Construct
TNQSKNF

SEQ ID NO: 12163 - protein, 7 aa, Artificial Sequence
  Synthetic Construct
KMKDMSI

SEQ ID NO: 12164 - protein, 7 aa, Artificial Sequence
  Synthetic Construct
HPSGSTL

SEQ ID NO: 12165 - protein, 7 aa, Artificial Sequence
  Synthetic Construct
IKDTVSG

SEQ ID NO: 12166 - protein, 7 aa, Artificial Sequence
  Synthetic Construct
MNTLTNV

SEQ ID NO: 12167 - protein, 7 aa, Artificial Sequence
  Synthetic Construct
TDSAPHP

SEQ ID NO: 12168 - protein, 7 aa, Artificial Sequence
  Synthetic Construct
PRPVSNG

SEQ ID NO: 12169 - protein, 7 aa, Artificial Sequence
  Synthetic Construct
SVDRRPQ

SEQ ID NO: 12170 - protein, 7 aa, Artificial Sequence
  Synthetic Construct
MDSPIRN

SEQ ID NO: 12171 - protein, 7 aa, Artificial Sequence
  Synthetic Construct
ATRMSIP

SEQ ID NO: 12172 - protein, 7 aa, Artificial Sequence
  Synthetic Construct
NVPTSLP

SEQ ID NO: 12173 - protein, 7 aa, Artificial Sequence
  Synthetic Construct
SLRIESK

SEQ ID NO: 12174 - protein, 7 aa, Artificial Sequence
  Synthetic Construct
NSGNTLG

SEQ ID NO: 12175 - protein, 7 aa, Artificial Sequence
  Synthetic Construct
RLDHASI

SEQ ID NO: 12176 - protein, 7 aa, Artificial Sequence
  Synthetic Construct
SHLVVSA

SEQ ID NO: 12177 - protein, 7 aa, Artificial Sequence
  Synthetic Construct
PASPRSH

SEQ ID NO: 12178 - protein, 7 aa, Artificial Sequence
  Synthetic Construct
NHTLVPP

SEQ ID NO: 12179 - protein, 7 aa, Artificial Sequence
  Synthetic Construct
MQMTGTA

SEQ ID NO: 12180 - protein, 7 aa, Artificial Sequence
  Synthetic Construct
NTQANPR

SEQ ID NO: 12181 - protein, 7 aa, Artificial Sequence
  Synthetic Construct
TRDLNAI

SEQ ID NO: 12182 - protein, 7 aa, Artificial Sequence
  Synthetic Construct
TDASSPF

SEQ ID NO: 12183 - protein, 7 aa, Artificial Sequence
  Synthetic Construct
ADQRQPK

SEQ ID NO: 12184 - protein, 7 aa, Artificial Sequence
  Synthetic Construct
AVNPNYA

SEQ ID NO: 12185 - protein, 7 aa, Artificial Sequence
  Synthetic Construct
LTATNVR

SEQ ID NO: 12186 - protein, 7 aa, Artificial Sequence
  Synthetic Construct
LTASTYS

SEQ ID NO: 12187 - protein, 7 aa, Artificial Sequence
  Synthetic Construct
GSRDNSV

SEQ ID NO: 12188 - protein, 7 aa, Artificial Sequence
  Synthetic Construct
TDTQNRL

SEQ ID NO: 12189 - protein, 7 aa, Artificial Sequence
  Synthetic Construct
NSTVNTG

SEQ ID NO: 12190 - protein, 7 aa, Artificial Sequence
  Synthetic Construct
LSHAMRS

SEQ ID NO: 12191 - protein, 7 aa, Artificial Sequence
  Synthetic Construct
RLPMTTM

SEQ ID NO: 12192 - protein, 7 aa, Artificial Sequence
  Synthetic Construct
LYHESQT

SEQ ID NO: 12193 - protein, 7 aa, Artificial Sequence
  Synthetic Construct
ILHQSST

SEQ ID NO: 12194 - protein, 7 aa, Artificial Sequence
  Synthetic Construct
TSLATQT

SEQ ID NO: 12195 - protein, 7 aa, Artificial Sequence
  Synthetic Construct
RTPTLTV

SEQ ID NO: 12196 - protein, 7 aa, Artificial Sequence
  Synthetic Construct
ATRESRT

SEQ ID NO: 12197 - protein, 7 aa, Artificial Sequence
  Synthetic Construct
LSESLRI

SEQ ID NO: 12198 - protein, 7 aa, Artificial Sequence
  Synthetic Construct
SVTGGMV

SEQ ID NO: 12199 - protein, 7 aa, Artificial Sequence
  Synthetic Construct
PRTSDSN

SEQ ID NO: 12200 - protein, 7 aa, Artificial Sequence
  Synthetic Construct
VHSTVTS

SEQ ID NO: 12201 - protein, 7 aa, Artificial Sequence
  Synthetic Construct
GTNMNHL

SEQ ID NO: 12202 - protein, 7 aa, Artificial Sequence
  Synthetic Construct
MKAELYA

SEQ ID NO: 12203 - protein, 7 aa, Artificial Sequence
  Synthetic Construct
LRSPSVD

SEQ ID NO: 12204 - protein, 7 aa, Artificial Sequence
  Synthetic Construct
TNSPQFP

SEQ ID NO: 12205 - protein, 7 aa, Artificial Sequence
  Synthetic Construct
NNSLRSN

SEQ ID NO: 12206 - protein, 7 aa, Artificial Sequence
  Synthetic Construct
DSHMGKY

SEQ ID NO: 12207 - protein, 7 aa, Artificial Sequence
  Synthetic Construct
VNSMTPR

SEQ ID NO: 12208 - protein, 7 aa, Artificial Sequence
  Synthetic Construct
LAPISLN

SEQ ID NO: 12209 - protein, 7 aa, Artificial Sequence
  Synthetic Construct
NMPSIMQ

SEQ ID NO: 12210 - protein, 7 aa, Artificial Sequence
  Synthetic Construct
GNMIKVA

SEQ ID NO: 12211 - protein, 7 aa, Artificial Sequence
  Synthetic Construct
TGVSLQV

SEQ ID NO: 12212 - protein, 7 aa, Artificial Sequence
  Synthetic Construct
PQFNTAS

SEQ ID NO: 12213 - protein, 7 aa, Artificial Sequence
  Synthetic Construct
TEAYRNT

SEQ ID NO: 12214 - protein, 7 aa, Artificial Sequence
  Synthetic Construct
LMKADTV

SEQ ID NO: 12215 - protein, 7 aa, Artificial Sequence
  Synthetic Construct
NHKEFML

SEQ ID NO: 12216 - protein, 7 aa, Artificial Sequence
  Synthetic Construct
LNGTLTV

SEQ ID NO: 12217 - protein, 7 aa, Artificial Sequence
  Synthetic Construct
TAKILTM

SEQ ID NO: 12218 - protein, 7 aa, Artificial Sequence
  Synthetic Construct
LRDSLPV

SEQ ID NO: 12219 - protein, 7 aa, Artificial Sequence
  Synthetic Construct
LKGGDSW

SEQ ID NO: 12220 - protein, 7 aa, Artificial Sequence
  Synthetic Construct
KTVDIMG

SEQ ID NO: 12221 - protein, 7 aa, Artificial Sequence
  Synthetic Construct
LNMGQMK

SEQ ID NO: 12222 - protein, 7 aa, Artificial Sequence
  Synthetic Construct
SVPSLDR

SEQ ID NO: 12223 - protein, 7 aa, Artificial Sequence
  Synthetic Construct
QLLGTSK

SEQ ID NO: 12224 - protein, 7 aa, Artificial Sequence
  Synthetic Construct
MNPKHGL

SEQ ID NO: 12225 - protein, 7 aa, Artificial Sequence
  Synthetic Construct
SPEGSLK

SEQ ID NO: 12226 - protein, 7 aa, Artificial Sequence
  Synthetic Construct
ANMPNSR

SEQ ID NO: 12227 - protein, 7 aa, Artificial Sequence
  Synthetic Construct
AYISSGV

SEQ ID NO: 12228 - protein, 7 aa, Artificial Sequence
  Synthetic Construct
ERGSQAN

SEQ ID NO: 12229 - protein, 7 aa, Artificial Sequence
  Synthetic Construct
GHDRLSP

SEQ ID NO: 12230 - protein, 7 aa, Artificial Sequence
  Synthetic Construct
TSNVTGT

SEQ ID NO: 12231 - protein, 7 aa, Artificial Sequence
  Synthetic Construct
LTHNVGV

SEQ ID NO: 12232 - protein, 7 aa, Artificial Sequence
  Synthetic Construct
REDGVAK

SEQ ID NO: 12233 - protein, 7 aa, Artificial Sequence
  Synthetic Construct
PADGYKL

SEQ ID NO: 12234 - protein, 7 aa, Artificial Sequence
  Synthetic Construct
QLDATRA

SEQ ID NO: 12235 - protein, 7 aa, Artificial Sequence
  Synthetic Construct
VTGMTTR

SEQ ID NO: 12236 - protein, 7 aa, Artificial Sequence
  Synthetic Construct
SDSRTYE

SEQ ID NO: 12237 - protein, 7 aa, Artificial Sequence
  Synthetic Construct
VEPLKPD

SEQ ID NO: 12238 - protein, 7 aa, Artificial Sequence
  Synthetic Construct
GVLASNR

SEQ ID NO: 12239 - protein, 7 aa, Artificial Sequence
  Synthetic Construct
MGERMSI

SEQ ID NO: 12240 - protein, 7 aa, Artificial Sequence
  Synthetic Construct
FTKTEDL

SEQ ID NO: 12241 - protein, 7 aa, Artificial Sequence
  Synthetic Construct
VKNTELL

SEQ ID NO: 12242 - protein, 7 aa, Artificial Sequence
  Synthetic Construct
TVTSTVV

SEQ ID NO: 12243 - protein, 7 aa, Artificial Sequence
  Synthetic Construct
AKYGDPT

SEQ ID NO: 12244 - protein, 7 aa, Artificial Sequence
  Synthetic Construct
TSDRLLG

SEQ ID NO: 12245 - protein, 7 aa, Artificial Sequence
  Synthetic Construct
AVGNTKM

SEQ ID NO: 12246 - protein, 7 aa, Artificial Sequence
  Synthetic Construct
QTYNKMD

SEQ ID NO: 12247 - protein, 7 aa, Artificial Sequence
  Synthetic Construct
AWASQSS

SEQ ID NO: 12248 - protein, 7 aa, Artificial Sequence
  Synthetic Construct
NAFLTGG

SEQ ID NO: 12249 - protein, 7 aa, Artificial Sequence
  Synthetic Construct
SIGDKYT

SEQ ID NO: 12250 - protein, 7 aa, Artificial Sequence
  Synthetic Construct
SNHHHTG

SEQ ID NO: 12251 - protein, 7 aa, Artificial Sequence
  Synthetic Construct
ITNKPMT

SEQ ID NO: 12252 - protein, 7 aa, Artificial Sequence
  Synthetic Construct
LSGQVSN

SEQ ID NO: 12253 - protein, 7 aa, Artificial Sequence
  Synthetic Construct
NSMSGHL

SEQ ID NO: 12254 - protein, 7 aa, Artificial Sequence
  Synthetic Construct
PAVHGYA

SEQ ID NO: 12255 - protein, 7 aa, Artificial Sequence
  Synthetic Construct
LMRTKQP

SEQ ID NO: 12256 - protein, 7 aa, Artificial Sequence
  Synthetic Construct
SSLAVNK

SEQ ID NO: 12257 - protein, 7 aa, Artificial Sequence
  Synthetic Construct
NTQSEPR

SEQ ID NO: 12258 - protein, 7 aa, Artificial Sequence
  Synthetic Construct
DHLVSVP

SEQ ID NO: 12259 - protein, 7 aa, Artificial Sequence
  Synthetic Construct
WATSTHD

SEQ ID NO: 12260 - protein, 7 aa, Artificial Sequence
  Synthetic Construct
PQQQPIG

SEQ ID NO: 12261 - protein, 7 aa, Artificial Sequence
  Synthetic Construct
SLSTHSD

SEQ ID NO: 12262 - protein, 7 aa, Artificial Sequence
  Synthetic Construct
GSMAARS

SEQ ID NO: 12263 - protein, 7 aa, Artificial Sequence
  Synthetic Construct
APGMTAR

SEQ ID NO: 12264 - protein, 7 aa, Artificial Sequence
  Synthetic Construct
VLANMTA

SEQ ID NO: 12265 - protein, 7 aa, Artificial Sequence
  Synthetic Construct
LTKQESA

SEQ ID NO: 12266 - protein, 7 aa, Artificial Sequence
  Synthetic Construct
GANSGGV

SEQ ID NO: 12267 - protein, 7 aa, Artificial Sequence
  Synthetic Construct
QSEPKRP

SEQ ID NO: 12268 - protein, 7 aa, Artificial Sequence
  Synthetic Construct
VHGERSV

SEQ ID NO: 12269 - protein, 7 aa, Artificial Sequence
  Synthetic Construct
AHQTAAS

SEQ ID NO: 12270 - protein, 7 aa, Artificial Sequence
  Synthetic Construct
VREMQTA

SEQ ID NO: 12271 - protein, 7 aa, Artificial Sequence
  Synthetic Construct
VAPSALH

SEQ ID NO: 12272 - protein, 7 aa, Artificial Sequence
  Synthetic Construct
SVGHHNM

SEQ ID NO: 12273 - protein, 7 aa, Artificial Sequence
  Synthetic Construct
FLTQGDV

SEQ ID NO: 12274 - protein, 7 aa, Artificial Sequence
  Synthetic Construct
FSTQFQH

SEQ ID NO: 12275 - protein, 7 aa, Artificial Sequence
  Synthetic Construct
QNTTRSN

SEQ ID NO: 12276 - protein, 7 aa, Artificial Sequence
  Synthetic Construct
PAVTSIA

SEQ ID NO: 12277 - protein, 7 aa, Artificial Sequence
  Synthetic Construct
ASTNTYV

SEQ ID NO: 12278 - protein, 7 aa, Artificial Sequence
  Synthetic Construct
STATPTS

SEQ ID NO: 12279 - protein, 7 aa, Artificial Sequence
  Synthetic Construct
HFNRTSP

SEQ ID NO: 12280 - protein, 7 aa, Artificial Sequence
  Synthetic Construct
SVAGMLP

SEQ ID NO: 12281 - protein, 7 aa, Artificial Sequence
  Synthetic Construct
PMSSESS

SEQ ID NO: 12282 - protein, 7 aa, Artificial Sequence
  Synthetic Construct
SLASTTV

SEQ ID NO: 12283 - protein, 7 aa, Artificial Sequence
  Synthetic Construct
TSTPAQV

SEQ ID NO: 12284 - protein, 7 aa, Artificial Sequence
  Synthetic Construct
SLTAQQP

SEQ ID NO: 12285 - protein, 7 aa, Artificial Sequence
  Synthetic Construct
SGRVPVA

SEQ ID NO: 12286 - protein, 7 aa, Artificial Sequence
  Synthetic Construct
LDAAKSL

SEQ ID NO: 12287 - protein, 7 aa, Artificial Sequence
  Synthetic Construct
NFANKNV

SEQ ID NO: 12288 - protein, 7 aa, Artificial Sequence
  Synthetic Construct
GPASVTP

SEQ ID NO: 12289 - protein, 7 aa, Artificial Sequence
  Synthetic Construct
YSREATN

SEQ ID NO: 12290 - protein, 7 aa, Artificial Sequence
  Synthetic Construct
TGSSFAM

SEQ ID NO: 12291 - protein, 7 aa, Artificial Sequence
  Synthetic Construct
GIKGDPV

SEQ ID NO: 12292 - protein, 7 aa, Artificial Sequence
  Synthetic Construct
VTSTSHA

SEQ ID NO: 12293 - protein, 7 aa, Artificial Sequence
  Synthetic Construct
TSQNNLR

SEQ ID NO: 12294 - protein, 7 aa, Artificial Sequence
  Synthetic Construct
MRQEGLS

SEQ ID NO: 12295 - protein, 7 aa, Artificial Sequence
  Synthetic Construct
LNLNAIA

SEQ ID NO: 12296 - protein, 7 aa, Artificial Sequence
  Synthetic Construct
SKNEGPT

SEQ ID NO: 12297 - protein, 7 aa, Artificial Sequence
  Synthetic Construct
DSRSTTN

SEQ ID NO: 12298 - protein, 7 aa, Artificial Sequence
  Synthetic Construct
STGDALR

SEQ ID NO: 12299 - protein, 7 aa, Artificial Sequence
  Synthetic Construct
INKPGTP

SEQ ID NO: 12300 - protein, 7 aa, Artificial Sequence
  Synthetic Construct
VSAPLNI

SEQ ID NO: 12301 - protein, 7 aa, Artificial Sequence
  Synthetic Construct
VSLGSLA

SEQ ID NO: 12302 - protein, 7 aa, Artificial Sequence
  Synthetic Construct
LNHINEK

SEQ ID NO: 12303 - protein, 7 aa, Artificial Sequence
  Synthetic Construct
KSVTILS

SEQ ID NO: 12304 - protein, 7 aa, Artificial Sequence
  Synthetic Construct
SNVSSLV

SEQ ID NO: 12305 - protein, 7 aa, Artificial Sequence
  Synthetic Construct
FSQTVGG

SEQ ID NO: 12306 - protein, 7 aa, Artificial Sequence
  Synthetic Construct
RPSITHD

SEQ ID NO: 12307 - protein, 7 aa, Artificial Sequence
  Synthetic Construct
RQESTTL

SEQ ID NO: 12308 - protein, 7 aa, Artificial Sequence
  Synthetic Construct
GPYVTPQ

SEQ ID NO: 12309 - protein, 7 aa, Artificial Sequence
  Synthetic Construct
NGLVTTA

SEQ ID NO: 12310 - protein, 7 aa, Artificial Sequence
  Synthetic Construct
HAGNVPG

SEQ ID NO: 12311 - protein, 7 aa, Artificial Sequence
  Synthetic Construct
PMGNNLV

SEQ ID NO: 12312 - protein, 7 aa, Artificial Sequence
  Synthetic Construct
VYNDRSH

SEQ ID NO: 12313 - protein, 7 aa, Artificial Sequence
  Synthetic Construct
THKESGY

SEQ ID NO: 12314 - protein, 7 aa, Artificial Sequence
  Synthetic Construct
GMNSVLL

SEQ ID NO: 12315 - protein, 7 aa, Artificial Sequence
  Synthetic Construct
YLENQYS

SEQ ID NO: 12316 - protein, 7 aa, Artificial Sequence
  Synthetic Construct
SITSRPN

SEQ ID NO: 12317 - protein, 7 aa, Artificial Sequence
  Synthetic Construct
SHQNTAR

SEQ ID NO: 12318 - protein, 7 aa, Artificial Sequence
  Synthetic Construct
RLVQSAE

SEQ ID NO: 12319 - protein, 7 aa, Artificial Sequence
  Synthetic Construct
YPKSATN

SEQ ID NO: 12320 - protein, 7 aa, Artificial Sequence
  Synthetic Construct
INSSPPL

SEQ ID NO: 12321 - protein, 7 aa, Artificial Sequence
  Synthetic Construct
TQNLAGG

SEQ ID NO: 12322 - protein, 7 aa, Artificial Sequence
  Synthetic Construct
FQVAKDR

SEQ ID NO: 12323 - protein, 7 aa, Artificial Sequence
  Synthetic Construct
RLSGNQN

SEQ ID NO: 12324 - protein, 7 aa, Artificial Sequence
  Synthetic Construct
TTDRVSH

SEQ ID NO: 12325 - protein, 7 aa, Artificial Sequence
  Synthetic Construct
TATVTAR

SEQ ID NO: 12326 - protein, 7 aa, Artificial Sequence
  Synthetic Construct
LSMMSDK

SEQ ID NO: 12327 - protein, 7 aa, Artificial Sequence
  Synthetic Construct
TLIQTSP

SEQ ID NO: 12328 - protein, 7 aa, Artificial Sequence
  Synthetic Construct
PMHITNA

SEQ ID NO: 12329 - protein, 7 aa, Artificial Sequence
  Synthetic Construct
TVGQPAH

SEQ ID NO: 12330 - protein, 7 aa, Artificial Sequence
  Synthetic Construct
EDKDVRL

SEQ ID NO: 12331 - protein, 7 aa, Artificial Sequence
  Synthetic Construct
MKVAQPM

SEQ ID NO: 12332 - protein, 7 aa, Artificial Sequence
  Synthetic Construct
VGVPNLP

SEQ ID NO: 12333 - protein, 7 aa, Artificial Sequence
  Synthetic Construct
APLSSDP

SEQ ID NO: 12334 - protein, 7 aa, Artificial Sequence
  Synthetic Construct
FLHASVD

SEQ ID NO: 12335 - protein, 7 aa, Artificial Sequence
  Synthetic Construct
PTVGTYI

SEQ ID NO: 12336 - protein, 7 aa, Artificial Sequence
  Synthetic Construct
EPLHRNS

SEQ ID NO: 12337 - protein, 7 aa, Artificial Sequence
  Synthetic Construct
ASTVTVE

SEQ ID NO: 12338 - protein, 7 aa, Artificial Sequence
  Synthetic Construct
APRIDNA

SEQ ID NO: 12339 - protein, 7 aa, Artificial Sequence
  Synthetic Construct
YRDSAAP

SEQ ID NO: 12340 - protein, 7 aa, Artificial Sequence
  Synthetic Construct
LTQNASV

SEQ ID NO: 12341 - protein, 7 aa, Artificial Sequence
  Synthetic Construct
LSARLTT

SEQ ID NO: 12342 - protein, 7 aa, Artificial Sequence
  Synthetic Construct
NGKSSDK

SEQ ID NO: 12343 - protein, 7 aa, Artificial Sequence
  Synthetic Construct
ALVKDTT

SEQ ID NO: 12344 - protein, 7 aa, Artificial Sequence
  Synthetic Construct
MLVTTGE

SEQ ID NO: 12345 - protein, 7 aa, Artificial Sequence
  Synthetic Construct
SGNPSYA

SEQ ID NO: 12346 - protein, 7 aa, Artificial Sequence
  Synthetic Construct
VITGGMS

SEQ ID NO: 12347 - protein, 7 aa, Artificial Sequence
  Synthetic Construct
LEPNVQT

SEQ ID NO: 12348 - protein, 7 aa, Artificial Sequence
  Synthetic Construct
RFSEVTP

SEQ ID NO: 12349 - protein, 7 aa, Artificial Sequence
  Synthetic Construct
DPGKASL

SEQ ID NO: 12350 - protein, 7 aa, Artificial Sequence
  Synthetic Construct
IAHESTD

SEQ ID NO: 12351 - protein, 7 aa, Artificial Sequence
  Synthetic Construct
YPSNSMH

SEQ ID NO: 12352 - protein, 7 aa, Artificial Sequence
  Synthetic Construct
STTPPSG

SEQ ID NO: 12353 - protein, 7 aa, Artificial Sequence
  Synthetic Construct
VEQNSKN

SEQ ID NO: 12354 - protein, 7 aa, Artificial Sequence
  Synthetic Construct
TIAGRLV

SEQ ID NO: 12355 - protein, 7 aa, Artificial Sequence
  Synthetic Construct
ARHTGEM

SEQ ID NO: 12356 - protein, 7 aa, Artificial Sequence
  Synthetic Construct
QHLPNHI

SEQ ID NO: 12357 - protein, 7 aa, Artificial Sequence
  Synthetic Construct
TTMGTYP

SEQ ID NO: 12358 - protein, 7 aa, Artificial Sequence
  Synthetic Construct
TESVMPR

SEQ ID NO: 12359 - protein, 7 aa, Artificial Sequence
  Synthetic Construct
GAKPSND

SEQ ID NO: 12360 - protein, 7 aa, Artificial Sequence
  Synthetic Construct
AVSSDMS

SEQ ID NO: 12361 - protein, 7 aa, Artificial Sequence
  Synthetic Construct
HSPQLGG

SEQ ID NO: 12362 - protein, 7 aa, Artificial Sequence
  Synthetic Construct
LYTNPNT

SEQ ID NO: 12363 - protein, 7 aa, Artificial Sequence
  Synthetic Construct
TVALNMA

SEQ ID NO: 12364 - protein, 7 aa, Artificial Sequence
  Synthetic Construct
QRVPAYQ

SEQ ID NO: 12365 - protein, 7 aa, Artificial Sequence
  Synthetic Construct
SDVSKVY

SEQ ID NO: 12366 - protein, 7 aa, Artificial Sequence
  Synthetic Construct
SNTGEQV

SEQ ID NO: 12367 - protein, 7 aa, Artificial Sequence
  Synthetic Construct
FTTGLNH

SEQ ID NO: 12368 - protein, 7 aa, Artificial Sequence
  Synthetic Construct
NDTQYKH

SEQ ID NO: 12369 - protein, 7 aa, Artificial Sequence
  Synthetic Construct
VHDVKGI

SEQ ID NO: 12370 - protein, 7 aa, Artificial Sequence
  Synthetic Construct
YGGRDSY

SEQ ID NO: 12371 - protein, 7 aa, Artificial Sequence
  Synthetic Construct
HSTATTH

SEQ ID NO: 12372 - protein, 7 aa, Artificial Sequence
  Synthetic Construct
PSPTTRT

SEQ ID NO: 12373 - protein, 7 aa, Artificial Sequence
  Synthetic Construct
GHAEAAM

SEQ ID NO: 12374 - protein, 7 aa, Artificial Sequence
  Synthetic Construct
SLSTRPV

SEQ ID NO: 12375 - protein, 7 aa, Artificial Sequence
  Synthetic Construct
SPVPGKP

SEQ ID NO: 12376 - protein, 7 aa, Artificial Sequence
  Synthetic Construct
TRINSPL

SEQ ID NO: 12377 - protein, 7 aa, Artificial Sequence
  Synthetic Construct
ESTYAKL

SEQ ID NO: 12378 - protein, 7 aa, Artificial Sequence
  Synthetic Construct
QINQGTR

SEQ ID NO: 12379 - protein, 7 aa, Artificial Sequence
  Synthetic Construct
GSRTGSI

SEQ ID NO: 12380 - protein, 7 aa, Artificial Sequence
  Synthetic Construct
GNASWSA

SEQ ID NO: 12381 - protein, 7 aa, Artificial Sequence
  Synthetic Construct
AAHDIGK

SEQ ID NO: 12382 - protein, 7 aa, Artificial Sequence
  Synthetic Construct
KDRPFVE

SEQ ID NO: 12383 - protein, 7 aa, Artificial Sequence
  Synthetic Construct
LPHTKPF

SEQ ID NO: 12384 - protein, 7 aa, Artificial Sequence
  Synthetic Construct
PGKGVSL

SEQ ID NO: 12385 - protein, 7 aa, Artificial Sequence
  Synthetic Construct
DRQNASA

SEQ ID NO: 12386 - protein, 7 aa, Artificial Sequence
  Synthetic Construct
VQPSLSV

SEQ ID NO: 12387 - protein, 7 aa, Artificial Sequence
  Synthetic Construct
KPTPIEF

SEQ ID NO: 12388 - protein, 7 aa, Artificial Sequence
  Synthetic Construct
LLHDMKS

SEQ ID NO: 12389 - protein, 7 aa, Artificial Sequence
  Synthetic Construct
NSDRTLS

SEQ ID NO: 12390 - protein, 7 aa, Artificial Sequence
  Synthetic Construct
KVGHGFN

SEQ ID NO: 12391 - protein, 7 aa, Artificial Sequence
  Synthetic Construct
TKPAVSF

SEQ ID NO: 12392 - protein, 7 aa, Artificial Sequence
  Synthetic Construct
AMTNIPK

SEQ ID NO: 12393 - protein, 7 aa, Artificial Sequence
  Synthetic Construct
FSHMSLP

SEQ ID NO: 12394 - protein, 7 aa, Artificial Sequence
  Synthetic Construct
GSVRDNP

SEQ ID NO: 12395 - protein, 7 aa, Artificial Sequence
  Synthetic Construct
SSSQGPT

SEQ ID NO: 12396 - protein, 7 aa, Artificial Sequence
  Synthetic Construct
LVGRPVT

SEQ ID NO: 12397 - protein, 7 aa, Artificial Sequence
  Synthetic Construct
INYGVQK

SEQ ID NO: 12398 - protein, 7 aa, Artificial Sequence
  Synthetic Construct
INKDNNQ

SEQ ID NO: 12399 - protein, 7 aa, Artificial Sequence
  Synthetic Construct
SGQSSAM

SEQ ID NO: 12400 - protein, 7 aa, Artificial Sequence
  Synthetic Construct
EYNSTKL

SEQ ID NO: 12401 - protein, 7 aa, Artificial Sequence
  Synthetic Construct
FMTLERA

SEQ ID NO: 12402 - protein, 7 aa, Artificial Sequence
  Synthetic Construct
FGKDYVN

SEQ ID NO: 12403 - protein, 7 aa, Artificial Sequence
  Synthetic Construct
LLLGGTP

SEQ ID NO: 12404 - protein, 7 aa, Artificial Sequence
  Synthetic Construct
TTTYTRN

SEQ ID NO: 12405 - protein, 7 aa, Artificial Sequence
  Synthetic Construct
DRGMRGA

SEQ ID NO: 12406 - protein, 7 aa, Artificial Sequence
  Synthetic Construct
AVSGTRT

SEQ ID NO: 12407 - protein, 7 aa, Artificial Sequence
  Synthetic Construct
NFSGVAK

SEQ ID NO: 12408 - protein, 7 aa, Artificial Sequence
  Synthetic Construct
DRNNSIS

SEQ ID NO: 12409 - protein, 7 aa, Artificial Sequence
  Synthetic Construct
IPQRPLD

SEQ ID NO: 12410 - protein, 7 aa, Artificial Sequence
  Synthetic Construct
PAANQYV

SEQ ID NO: 12411 - protein, 7 aa, Artificial Sequence
  Synthetic Construct
YSGTAIR

SEQ ID NO: 12412 - protein, 7 aa, Artificial Sequence
  Synthetic Construct
WVQRTES

SEQ ID NO: 12413 - protein, 7 aa, Artificial Sequence
  Synthetic Construct
PKDGGAI

SEQ ID NO: 12414 - protein, 7 aa, Artificial Sequence
  Synthetic Construct
LATPQEE

SEQ ID NO: 12415 - protein, 7 aa, Artificial Sequence
  Synthetic Construct
LNSPVMA

SEQ ID NO: 12416 - protein, 7 aa, Artificial Sequence
  Synthetic Construct
GATGTRA

SEQ ID NO: 12417 - protein, 7 aa, Artificial Sequence
  Synthetic Construct
RTDVRTN

SEQ ID NO: 12418 - protein, 7 aa, Artificial Sequence
  Synthetic Construct
RNLAHPY

SEQ ID NO: 12419 - protein, 7 aa, Artificial Sequence
  Synthetic Construct
LSTSYST

SEQ ID NO: 12420 - protein, 7 aa, Artificial Sequence
  Synthetic Construct
GVNQTAR

SEQ ID NO: 12421 - protein, 7 aa, Artificial Sequence
  Synthetic Construct
LPASSAR

SEQ ID NO: 12422 - protein, 7 aa, Artificial Sequence
  Synthetic Construct
QLYSVNA

SEQ ID NO: 12423 - protein, 7 aa, Artificial Sequence
  Synthetic Construct
VGTYTAT

SEQ ID NO: 12424 - protein, 7 aa, Artificial Sequence
  Synthetic Construct
RSMTVIE

SEQ ID NO: 12425 - protein, 7 aa, Artificial Sequence
  Synthetic Construct
FGRGDTG

SEQ ID NO: 12426 - protein, 7 aa, Artificial Sequence
  Synthetic Construct
AAGRSNP

SEQ ID NO: 12427 - protein, 7 aa, Artificial Sequence
  Synthetic Construct
MPQSSLA

SEQ ID NO: 12428 - protein, 7 aa, Artificial Sequence
  Synthetic Construct
PSKHERY

SEQ ID NO: 12429 - protein, 7 aa, Artificial Sequence
  Synthetic Construct
LFDSSKT

SEQ ID NO: 12430 - protein, 7 aa, Artificial Sequence
  Synthetic Construct
SPQPRLS

SEQ ID NO: 12431 - protein, 7 aa, Artificial Sequence
  Synthetic Construct
RRPDVEN

SEQ ID NO: 12432 - protein, 7 aa, Artificial Sequence
  Synthetic Construct
PMGSAGS

SEQ ID NO: 12433 - protein, 7 aa, Artificial Sequence
  Synthetic Construct
WSTGMTS

SEQ ID NO: 12434 - protein, 7 aa, Artificial Sequence
  Synthetic Construct
GLVRNGV

SEQ ID NO: 12435 - protein, 7 aa, Artificial Sequence
  Synthetic Construct
EGSYSTS

SEQ ID NO: 12436 - protein, 7 aa, Artificial Sequence
  Synthetic Construct
ATSMLTH

SEQ ID NO: 12437 - protein, 7 aa, Artificial Sequence
  Synthetic Construct
STTGPPS

SEQ ID NO: 12438 - protein, 7 aa, Artificial Sequence
  Synthetic Construct
RGASVSM

SEQ ID NO: 12439 - protein, 7 aa, Artificial Sequence
  Synthetic Construct
VHEHGAS

SEQ ID NO: 12440 - protein, 7 aa, Artificial Sequence
  Synthetic Construct
HSPSQPR

SEQ ID NO: 12441 - protein, 7 aa, Artificial Sequence
  Synthetic Construct
GIGQNTA

SEQ ID NO: 12442 - protein, 7 aa, Artificial Sequence
  Synthetic Construct
HRVENSY

SEQ ID NO: 12443 - protein, 7 aa, Artificial Sequence
  Synthetic Construct
TEFKPPS

SEQ ID NO: 12444 - protein, 7 aa, Artificial Sequence
  Synthetic Construct
YGNLGVN

SEQ ID NO: 12445 - protein, 7 aa, Artificial Sequence
  Synthetic Construct
LTRVLTG

SEQ ID NO: 12446 - protein, 7 aa, Artificial Sequence
  Synthetic Construct
MKNSNGA

SEQ ID NO: 12447 - protein, 7 aa, Artificial Sequence
  Synthetic Construct
GTQTHLQ

SEQ ID NO: 12448 - protein, 7 aa, Artificial Sequence
  Synthetic Construct
NALARTM

SEQ ID NO: 12449 - protein, 7 aa, Artificial Sequence
  Synthetic Construct
NNSMQTV

SEQ ID NO: 12450 - protein, 7 aa, Artificial Sequence
  Synthetic Construct
QQGNGRS

SEQ ID NO: 12451 - protein, 7 aa, Artificial Sequence
  Synthetic Construct
LTKSQGY

SEQ ID NO: 12452 - protein, 7 aa, Artificial Sequence
  Synthetic Construct
APAEPKT

SEQ ID NO: 12453 - protein, 7 aa, Artificial Sequence
  Synthetic Construct
YSNQVSN

SEQ ID NO: 12454 - protein, 7 aa, Artificial Sequence
  Synthetic Construct
TRTGFSP

SEQ ID NO: 12455 - protein, 7 aa, Artificial Sequence
  Synthetic Construct
PVYKTDD

SEQ ID NO: 12456 - protein, 7 aa, Artificial Sequence
  Synthetic Construct
SDRPAPE

SEQ ID NO: 12457 - protein, 7 aa, Artificial Sequence
  Synthetic Construct
VQEKSRP

SEQ ID NO: 12458 - protein, 7 aa, Artificial Sequence
  Synthetic Construct
SGGLTER

SEQ ID NO: 12459 - protein, 7 aa, Artificial Sequence
  Synthetic Construct
SGGTREG

SEQ ID NO: 12460 - protein, 7 aa, Artificial Sequence
  Synthetic Construct
AVPGETR

SEQ ID NO: 12461 - protein, 7 aa, Artificial Sequence
  Synthetic Construct
PRPERMY

SEQ ID NO: 12462 - protein, 7 aa, Artificial Sequence
  Synthetic Construct
SNGNISR

SEQ ID NO: 12463 - protein, 7 aa, Artificial Sequence
  Synthetic Construct
ARTERNQ

SEQ ID NO: 12464 - protein, 7 aa, Artificial Sequence
  Synthetic Construct
SPQQFSK

SEQ ID NO: 12465 - protein, 7 aa, Artificial Sequence
  Synthetic Construct
STGPFPQ

SEQ ID NO: 12466 - protein, 7 aa, Artificial Sequence
  Synthetic Construct
ANIGTST

SEQ ID NO: 12467 - protein, 7 aa, Artificial Sequence
  Synthetic Construct
YRDNTSG

SEQ ID NO: 12468 - protein, 7 aa, Artificial Sequence
  Synthetic Construct
VQTRSPM

SEQ ID NO: 12469 - protein, 7 aa, Artificial Sequence
  Synthetic Construct
IHTSIVD

SEQ ID NO: 12470 - protein, 7 aa, Artificial Sequence
  Synthetic Construct
MTRTSSE

SEQ ID NO: 12471 - protein, 7 aa, Artificial Sequence
  Synthetic Construct
PSNFPGS

SEQ ID NO: 12472 - protein, 7 aa, Artificial Sequence
  Synthetic Construct
MIGGTQS

SEQ ID NO: 12473 - protein, 7 aa, Artificial Sequence
  Synthetic Construct
KLDKHES

SEQ ID NO: 12474 - protein, 7 aa, Artificial Sequence
  Synthetic Construct
LTSSNSA

SEQ ID NO: 12475 - protein, 7 aa, Artificial Sequence
  Synthetic Construct
STRDTHF

SEQ ID NO: 12476 - protein, 7 aa, Artificial Sequence
  Synthetic Construct
DTLKAVR

SEQ ID NO: 12477 - protein, 7 aa, Artificial Sequence
  Synthetic Construct
QRNPSLH

SEQ ID NO: 12478 - protein, 7 aa, Artificial Sequence
  Synthetic Construct
SGDGNRS

SEQ ID NO: 12479 - protein, 7 aa, Artificial Sequence
  Synthetic Construct
GVYKTLH

SEQ ID NO: 12480 - protein, 7 aa, Artificial Sequence
  Synthetic Construct
INSNQVS

SEQ ID NO: 12481 - protein, 7 aa, Artificial Sequence
  Synthetic Construct
HYNEHMT

SEQ ID NO: 12482 - protein, 7 aa, Artificial Sequence
  Synthetic Construct
TVQVRDR

SEQ ID NO: 12483 - protein, 7 aa, Artificial Sequence
  Synthetic Construct
GNDIRSR

SEQ ID NO: 12484 - protein, 7 aa, Artificial Sequence
  Synthetic Construct
VSVSMGP

SEQ ID NO: 12485 - protein, 7 aa, Artificial Sequence
  Synthetic Construct
FKTNISA

SEQ ID NO: 12486 - protein, 7 aa, Artificial Sequence
  Synthetic Construct
FPKVERY

SEQ ID NO: 12487 - protein, 7 aa, Artificial Sequence
  Synthetic Construct
LSKFQTT

SEQ ID NO: 12488 - protein, 7 aa, Artificial Sequence
  Synthetic Construct
SLMNSRS

SEQ ID NO: 12489 - protein, 7 aa, Artificial Sequence
  Synthetic Construct
GRGVLES

SEQ ID NO: 12490 - protein, 7 aa, Artificial Sequence
  Synthetic Construct
PNGSQMI

SEQ ID NO: 12491 - protein, 7 aa, Artificial Sequence
  Synthetic Construct
PTVGNSY

SEQ ID NO: 12492 - protein, 7 aa, Artificial Sequence
  Synthetic Construct
SSDIMKA

SEQ ID NO: 12493 - protein, 7 aa, Artificial Sequence
  Synthetic Construct
LMTSAGR

SEQ ID NO: 12494 - protein, 7 aa, Artificial Sequence
  Synthetic Construct
PAMSSSR

SEQ ID NO: 12495 - protein, 7 aa, Artificial Sequence
  Synthetic Construct
RDKAIST

SEQ ID NO: 12496 - protein, 7 aa, Artificial Sequence
  Synthetic Construct
LTLKQGI

SEQ ID NO: 12497 - protein, 7 aa, Artificial Sequence
  Synthetic Construct
SHANGFS

SEQ ID NO: 12498 - protein, 7 aa, Artificial Sequence
  Synthetic Construct
PNLKAPQ

SEQ ID NO: 12499 - protein, 7 aa, Artificial Sequence
  Synthetic Construct
SYGREVR

SEQ ID NO: 12500 - protein, 7 aa, Artificial Sequence
  Synthetic Construct
NDTQSPK

SEQ ID NO: 12501 - protein, 7 aa, Artificial Sequence
  Synthetic Construct
DERAPKH

SEQ ID NO: 12502 - protein, 7 aa, Artificial Sequence
  Synthetic Construct
NGRPMGM

SEQ ID NO: 12503 - protein, 7 aa, Artificial Sequence
  Synthetic Construct
HTQSVTM

SEQ ID NO: 12504 - protein, 7 aa, Artificial Sequence
  Synthetic Construct
NNFNASL

SEQ ID NO: 12505 - protein, 7 aa, Artificial Sequence
  Synthetic Construct
EYLKGSA

SEQ ID NO: 12506 - protein, 7 aa, Artificial Sequence
  Synthetic Construct
SKTPDML

SEQ ID NO: 12507 - protein, 7 aa, Artificial Sequence
  Synthetic Construct
VNTGHVR

SEQ ID NO: 12508 - protein, 7 aa, Artificial Sequence
  Synthetic Construct
GSQSDAR

SEQ ID NO: 12509 - protein, 7 aa, Artificial Sequence
  Synthetic Construct
SLTFSKD

SEQ ID NO: 12510 - protein, 7 aa, Artificial Sequence
  Synthetic Construct
NALESRM

SEQ ID NO: 12511 - protein, 7 aa, Artificial Sequence
  Synthetic Construct
NGIAREP

SEQ ID NO: 12512 - protein, 7 aa, Artificial Sequence
  Synthetic Construct
NLVSVST

SEQ ID NO: 12513 - protein, 7 aa, Artificial Sequence
  Synthetic Construct
DMLSYKP

SEQ ID NO: 12514 - protein, 7 aa, Artificial Sequence
  Synthetic Construct
RSTDSMT

SEQ ID NO: 12515 - protein, 7 aa, Artificial Sequence
  Synthetic Construct
EMNHSLS

SEQ ID NO: 12516 - protein, 7 aa, Artificial Sequence
  Synthetic Construct
ALSKEAS

SEQ ID NO: 12517 - protein, 7 aa, Artificial Sequence
  Synthetic Construct
NGHNMSQ

SEQ ID NO: 12518 - protein, 7 aa, Artificial Sequence
  Synthetic Construct
TTAEATR

SEQ ID NO: 12519 - protein, 7 aa, Artificial Sequence
  Synthetic Construct
RESAHHN

SEQ ID NO: 12520 - protein, 7 aa, Artificial Sequence
  Synthetic Construct
MFTGNGQ

SEQ ID NO: 12521 - protein, 7 aa, Artificial Sequence
  Synthetic Construct
HLQTPPA

SEQ ID NO: 12522 - protein, 7 aa, Artificial Sequence
  Synthetic Construct
SLVGQGK

SEQ ID NO: 12523 - protein, 7 aa, Artificial Sequence
  Synthetic Construct
LPLTPIA

SEQ ID NO: 12524 - protein, 7 aa, Artificial Sequence
  Synthetic Construct
AMKQSSI

SEQ ID NO: 12525 - protein, 7 aa, Artificial Sequence
  Synthetic Construct
YPTNVKS

SEQ ID NO: 12526 - protein, 7 aa, Artificial Sequence
  Synthetic Construct
SNSLPSR

SEQ ID NO: 12527 - protein, 7 aa, Artificial Sequence
  Synthetic Construct
PTAATGT

SEQ ID NO: 12528 - protein, 7 aa, Artificial Sequence
  Synthetic Construct
IAQNGPG

SEQ ID NO: 12529 - protein, 7 aa, Artificial Sequence
  Synthetic Construct
TTHQLTP

SEQ ID NO: 12530 - protein, 7 aa, Artificial Sequence
  Synthetic Construct
LIPARDV

SEQ ID NO: 12531 - protein, 7 aa, Artificial Sequence
  Synthetic Construct
KIAHGDI

SEQ ID NO: 12532 - protein, 7 aa, Artificial Sequence
  Synthetic Construct
ARPQSDK

SEQ ID NO: 12533 - protein, 7 aa, Artificial Sequence
  Synthetic Construct
PRPNVLD

SEQ ID NO: 12534 - protein, 7 aa, Artificial Sequence
  Synthetic Construct
LNKGSSN

SEQ ID NO: 12535 - protein, 7 aa, Artificial Sequence
  Synthetic Construct
RVYNGDL

SEQ ID NO: 12536 - protein, 7 aa, Artificial Sequence
  Synthetic Construct
TVPANSS

SEQ ID NO: 12537 - protein, 7 aa, Artificial Sequence
  Synthetic Construct
TRHTSLT

SEQ ID NO: 12538 - protein, 7 aa, Artificial Sequence
  Synthetic Construct
NHAVTNS

SEQ ID NO: 12539 - protein, 7 aa, Artificial Sequence
  Synthetic Construct
LASHSTL

SEQ ID NO: 12540 - protein, 7 aa, Artificial Sequence
  Synthetic Construct
VAFKSGI

SEQ ID NO: 12541 - protein, 7 aa, Artificial Sequence
  Synthetic Construct
RVGPESS

SEQ ID NO: 12542 - protein, 7 aa, Artificial Sequence
  Synthetic Construct
APSNVHT

SEQ ID NO: 12543 - protein, 7 aa, Artificial Sequence
  Synthetic Construct
TRSEVMK

SEQ ID NO: 12544 - protein, 7 aa, Artificial Sequence
  Synthetic Construct
LKEQHGG

SEQ ID NO: 12545 - protein, 7 aa, Artificial Sequence
  Synthetic Construct
KAESHAT

SEQ ID NO: 12546 - protein, 7 aa, Artificial Sequence
  Synthetic Construct
YRTDMLS

SEQ ID NO: 12547 - protein, 7 aa, Artificial Sequence
  Synthetic Construct
DTQGRMR

SEQ ID NO: 12548 - protein, 7 aa, Artificial Sequence
  Synthetic Construct
CLPKGCT

SEQ ID NO: 12549 - protein, 7 aa, Artificial Sequence
  Synthetic Construct
GSPTVVH

SEQ ID NO: 12550 - protein, 7 aa, Artificial Sequence
  Synthetic Construct
LSLSTQR

SEQ ID NO: 12551 - protein, 7 aa, Artificial Sequence
  Synthetic Construct
NMAQNAR

SEQ ID NO: 12552 - protein, 7 aa, Artificial Sequence
  Synthetic Construct
LSTNVLL

SEQ ID NO: 12553 - protein, 7 aa, Artificial Sequence
  Synthetic Construct
TSPVIRT

SEQ ID NO: 12554 - protein, 7 aa, Artificial Sequence
  Synthetic Construct
PSAGHVL

SEQ ID NO: 12555 - protein, 7 aa, Artificial Sequence
  Synthetic Construct
LSGTATS

SEQ ID NO: 12556 - protein, 7 aa, Artificial Sequence
  Synthetic Construct
TGNPNPT

SEQ ID NO: 12557 - protein, 7 aa, Artificial Sequence
  Synthetic Construct
QFEHSLP

SEQ ID NO: 12558 - protein, 7 aa, Artificial Sequence
  Synthetic Construct
LTPGQIR

SEQ ID NO: 12559 - protein, 7 aa, Artificial Sequence
  Synthetic Construct
LMNAKTT

SEQ ID NO: 12560 - protein, 7 aa, Artificial Sequence
  Synthetic Construct
QRDTNMA

SEQ ID NO: 12561 - protein, 7 aa, Artificial Sequence
  Synthetic Construct
NLLEIGR

SEQ ID NO: 12562 - protein, 7 aa, Artificial Sequence
  Synthetic Construct
DVKDKQI

SEQ ID NO: 12563 - protein, 7 aa, Artificial Sequence
  Synthetic Construct
VTISNKP

SEQ ID NO: 12564 - protein, 7 aa, Artificial Sequence
  Synthetic Construct
STPINSR

SEQ ID NO: 12565 - protein, 7 aa, Artificial Sequence
  Synthetic Construct
GTHGLTS

SEQ ID NO: 12566 - protein, 7 aa, Artificial Sequence
  Synthetic Construct
QSPGMIH

SEQ ID NO: 12567 - protein, 7 aa, Artificial Sequence
  Synthetic Construct
QTGPVLS

SEQ ID NO: 12568 - protein, 7 aa, Artificial Sequence
  Synthetic Construct
TYVSSGP

SEQ ID NO: 12569 - protein, 7 aa, Artificial Sequence
  Synthetic Construct
TSTLPRL

SEQ ID NO: 12570 - protein, 7 aa, Artificial Sequence
  Synthetic Construct
YTHKDND

SEQ ID NO: 12571 - protein, 7 aa, Artificial Sequence
  Synthetic Construct
LGAQSTL

SEQ ID NO: 12572 - protein, 7 aa, Artificial Sequence
  Synthetic Construct
LAQVRPA

SEQ ID NO: 12573 - protein, 7 aa, Artificial Sequence
  Synthetic Construct
GRVVASN

SEQ ID NO: 12574 - protein, 7 aa, Artificial Sequence
  Synthetic Construct
SNRVRDL

SEQ ID NO: 12575 - protein, 7 aa, Artificial Sequence
  Synthetic Construct
ERDREKL

SEQ ID NO: 12576 - protein, 7 aa, Artificial Sequence
  Synthetic Construct
KSGTSST

SEQ ID NO: 12577 - protein, 7 aa, Artificial Sequence
  Synthetic Construct
AGQSTIY

SEQ ID NO: 12578 - protein, 7 aa, Artificial Sequence
  Synthetic Construct
EFSQPRL

SEQ ID NO: 12579 - protein, 7 aa, Artificial Sequence
  Synthetic Construct
TYARSDK

SEQ ID NO: 12580 - protein, 7 aa, Artificial Sequence
  Synthetic Construct
GKFNGHT

SEQ ID NO: 12581 - protein, 7 aa, Artificial Sequence
  Synthetic Construct
RLISNGN

SEQ ID NO: 12582 - protein, 7 aa, Artificial Sequence
  Synthetic Construct
LKESLGP

SEQ ID NO: 12583 - protein, 7 aa, Artificial Sequence
  Synthetic Construct
NRHTLAV

SEQ ID NO: 12584 - protein, 7 aa, Artificial Sequence
  Synthetic Construct
RDTRLSA

SEQ ID NO: 12585 - protein, 7 aa, Artificial Sequence
  Synthetic Construct
VSRLGSI

SEQ ID NO: 12586 - protein, 7 aa, Artificial Sequence
  Synthetic Construct
LTTSVIS

SEQ ID NO: 12587 - protein, 7 aa, Artificial Sequence
  Synthetic Construct
FKGVAHI

SEQ ID NO: 12588 - protein, 7 aa, Artificial Sequence
  Synthetic Construct
KTTEALP

SEQ ID NO: 12589 - protein, 7 aa, Artificial Sequence
  Synthetic Construct
RNQHDTT

SEQ ID NO: 12590 - protein, 7 aa, Artificial Sequence
  Synthetic Construct
NKLLPRS

SEQ ID NO: 12591 - protein, 7 aa, Artificial Sequence
  Synthetic Construct
VNSHERA

SEQ ID NO: 12592 - protein, 7 aa, Artificial Sequence
  Synthetic Construct
AKGSLNM

SEQ ID NO: 12593 - protein, 7 aa, Artificial Sequence
  Synthetic Construct
VKTDRVL

SEQ ID NO: 12594 - protein, 7 aa, Artificial Sequence
  Synthetic Construct
PRSDQIR

SEQ ID NO: 12595 - protein, 7 aa, Artificial Sequence
  Synthetic Construct
NRVGTER

SEQ ID NO: 12596 - protein, 7 aa, Artificial Sequence
  Synthetic Construct
GVPTAGT

SEQ ID NO: 12597 - protein, 7 aa, Artificial Sequence
  Synthetic Construct
SLMKQSH

SEQ ID NO: 12598 - protein, 7 aa, Artificial Sequence
  Synthetic Construct
GTSSNIM

SEQ ID NO: 12599 - protein, 7 aa, Artificial Sequence
  Synthetic Construct
LRSDIST

SEQ ID NO: 12600 - protein, 7 aa, Artificial Sequence
  Synthetic Construct
MTTGRDL

SEQ ID NO: 12601 - protein, 7 aa, Artificial Sequence
  Synthetic Construct
SGVANSY

SEQ ID NO: 12602 - protein, 7 aa, Artificial Sequence
  Synthetic Construct
AVPSYNN

SEQ ID NO: 12603 - protein, 7 aa, Artificial Sequence
  Synthetic Construct
LNGGNSP

SEQ ID NO: 12604 - protein, 7 aa, Artificial Sequence
  Synthetic Construct
NSHSTSW

SEQ ID NO: 12605 - protein, 7 aa, Artificial Sequence
  Synthetic Construct
MYHTGQV

SEQ ID NO: 12606 - protein, 7 aa, Artificial Sequence
  Synthetic Construct
RDKLYIA

SEQ ID NO: 12607 - protein, 7 aa, Artificial Sequence
  Synthetic Construct
RKSEAVL

SEQ ID NO: 12608 - protein, 7 aa, Artificial Sequence
  Synthetic Construct
HKGIQVI

SEQ ID NO: 12609 - protein, 7 aa, Artificial Sequence
  Synthetic Construct
IGKDAPK

SEQ ID NO: 12610 - protein, 7 aa, Artificial Sequence
  Synthetic Construct
SLAGLQD

SEQ ID NO: 12611 - protein, 7 aa, Artificial Sequence
  Synthetic Construct
FRVSVAE

SEQ ID NO: 12612 - protein, 7 aa, Artificial Sequence
  Synthetic Construct
THKEHSI

SEQ ID NO: 12613 - protein, 7 aa, Artificial Sequence
  Synthetic Construct
NSNHTYR

SEQ ID NO: 12614 - protein, 7 aa, Artificial Sequence
  Synthetic Construct
FNGVRTV

SEQ ID NO: 12615 - protein, 7 aa, Artificial Sequence
  Synthetic Construct
HMGMRDG

SEQ ID NO: 12616 - protein, 7 aa, Artificial Sequence
  Synthetic Construct
GQQSMAV

SEQ ID NO: 12617 - protein, 7 aa, Artificial Sequence
  Synthetic Construct
WSSQVNR

SEQ ID NO: 12618 - protein, 7 aa, Artificial Sequence
  Synthetic Construct
GSHVGMP

SEQ ID NO: 12619 - protein, 7 aa, Artificial Sequence
  Synthetic Construct
KGSLTAS

SEQ ID NO: 12620 - protein, 7 aa, Artificial Sequence
  Synthetic Construct
GAQSNIV

SEQ ID NO: 12621 - protein, 7 aa, Artificial Sequence
  Synthetic Construct
NDYNHTR

SEQ ID NO: 12622 - protein, 7 aa, Artificial Sequence
  Synthetic Construct
QINPSSV

SEQ ID NO: 12623 - protein, 7 aa, Artificial Sequence
  Synthetic Construct
ALRGASN

SEQ ID NO: 12624 - protein, 7 aa, Artificial Sequence
  Synthetic Construct
SASTMSF

SEQ ID NO: 12625 - protein, 7 aa, Artificial Sequence
  Synthetic Construct
LSSNNNN

SEQ ID NO: 12626 - protein, 7 aa, Artificial Sequence
  Synthetic Construct
STTLASK

SEQ ID NO: 12627 - protein, 7 aa, Artificial Sequence
  Synthetic Construct
HRMLDGV

SEQ ID NO: 12628 - protein, 7 aa, Artificial Sequence
  Synthetic Construct
SSESSTP

SEQ ID NO: 12629 - protein, 7 aa, Artificial Sequence
  Synthetic Construct
LYDSSHS

SEQ ID NO: 12630 - protein, 7 aa, Artificial Sequence
  Synthetic Construct
GNYNLSV

SEQ ID NO: 12631 - protein, 7 aa, Artificial Sequence
  Synthetic Construct
MHNVATV

SEQ ID NO: 12632 - protein, 7 aa, Artificial Sequence
  Synthetic Construct
TNYGDSV

SEQ ID NO: 12633 - protein, 7 aa, Artificial Sequence
  Synthetic Construct
NRGEDAR

SEQ ID NO: 12634 - protein, 7 aa, Artificial Sequence
  Synthetic Construct
FGKTAAT

SEQ ID NO: 12635 - protein, 7 aa, Artificial Sequence
  Synthetic Construct
NTKVNTE

SEQ ID NO: 12636 - protein, 7 aa, Artificial Sequence
  Synthetic Construct
VTGHLSS

SEQ ID NO: 12637 - protein, 7 aa, Artificial Sequence
  Synthetic Construct
VATSHLK

SEQ ID NO: 12638 - protein, 7 aa, Artificial Sequence
  Synthetic Construct
YTPGSDR

SEQ ID NO: 12639 - protein, 7 aa, Artificial Sequence
  Synthetic Construct
GFTTVTH

SEQ ID NO: 12640 - protein, 7 aa, Artificial Sequence
  Synthetic Construct
AAATSTT

SEQ ID NO: 12641 - protein, 7 aa, Artificial Sequence
  Synthetic Construct
ANIHVHG

SEQ ID NO: 12642 - protein, 7 aa, Artificial Sequence
  Synthetic Construct
YSLRGND

SEQ ID NO: 12643 - protein, 7 aa, Artificial Sequence
  Synthetic Construct
IDQIVQR

SEQ ID NO: 12644 - protein, 7 aa, Artificial Sequence
  Synthetic Construct
FNSDLAM

SEQ ID NO: 12645 - protein, 7 aa, Artificial Sequence
  Synthetic Construct
NMESQRY

SEQ ID NO: 12646 - protein, 7 aa, Artificial Sequence
  Synthetic Construct
PLSSSLS

SEQ ID NO: 12647 - protein, 7 aa, Artificial Sequence
  Synthetic Construct
QGTLHAE

SEQ ID NO: 12648 - protein, 7 aa, Artificial Sequence
  Synthetic Construct
PDRATAL

SEQ ID NO: 12649 - protein, 7 aa, Artificial Sequence
  Synthetic Construct
ANGKIQL

SEQ ID NO: 12650 - protein, 7 aa, Artificial Sequence
  Synthetic Construct
YSKDRHD

SEQ ID NO: 12651 - protein, 7 aa, Artificial Sequence
  Synthetic Construct
DSTSRAW

SEQ ID NO: 12652 - protein, 7 aa, Artificial Sequence
  Synthetic Construct
GLSVAIP

SEQ ID NO: 12653 - protein, 7 aa, Artificial Sequence
  Synthetic Construct
SYLTNHV

SEQ ID NO: 12654 - protein, 7 aa, Artificial Sequence
  Synthetic Construct
VITHNMP

SEQ ID NO: 12655 - protein, 7 aa, Artificial Sequence
  Synthetic Construct
NRTHVPQ

SEQ ID NO: 12656 - protein, 7 aa, Artificial Sequence
  Synthetic Construct
LQTTRAV

SEQ ID NO: 12657 - protein, 7 aa, Artificial Sequence
  Synthetic Construct
APNAIDV

SEQ ID NO: 12658 - protein, 7 aa, Artificial Sequence
  Synthetic Construct
VRDNTVY

SEQ ID NO: 12659 - protein, 7 aa, Artificial Sequence
  Synthetic Construct
TRIGTSL

SEQ ID NO: 12660 - protein, 7 aa, Artificial Sequence
  Synthetic Construct
TLTSGNV

SEQ ID NO: 12661 - protein, 7 aa, Artificial Sequence
  Synthetic Construct
HLDTMRG

SEQ ID NO: 12662 - protein, 7 aa, Artificial Sequence
  Synthetic Construct
LSSTTLN

SEQ ID NO: 12663 - protein, 7 aa, Artificial Sequence
  Synthetic Construct
VQSNRTN

SEQ ID NO: 12664 - protein, 7 aa, Artificial Sequence
  Synthetic Construct
NNNITTS

SEQ ID NO: 12665 - protein, 7 aa, Artificial Sequence
  Synthetic Construct
VGTAGKL

SEQ ID NO: 12666 - protein, 7 aa, Artificial Sequence
  Synthetic Construct
PAISTDH

SEQ ID NO: 12667 - protein, 7 aa, Artificial Sequence
  Synthetic Construct
SNLGNVP

SEQ ID NO: 12668 - protein, 7 aa, Artificial Sequence
  Synthetic Construct
QNQSRFT

SEQ ID NO: 12669 - protein, 7 aa, Artificial Sequence
  Synthetic Construct
ASKGMTL

SEQ ID NO: 12670 - protein, 7 aa, Artificial Sequence
  Synthetic Construct
ATAQDKT

SEQ ID NO: 12671 - protein, 7 aa, Artificial Sequence
  Synthetic Construct
WDSSSVR

SEQ ID NO: 12672 - protein, 7 aa, Artificial Sequence
  Synthetic Construct
TNGSEKS

SEQ ID NO: 12673 - protein, 7 aa, Artificial Sequence
  Synthetic Construct
SAENHTY

SEQ ID NO: 12674 - protein, 7 aa, Artificial Sequence
  Synthetic Construct
SVPQAYQ

SEQ ID NO: 12675 - protein, 7 aa, Artificial Sequence
  Synthetic Construct
KDYVVTN

SEQ ID NO: 12676 - protein, 7 aa, Artificial Sequence
  Synthetic Construct
VVQMKQT

SEQ ID NO: 12677 - protein, 7 aa, Artificial Sequence
  Synthetic Construct
RTLSLTA

SEQ ID NO: 12678 - protein, 7 aa, Artificial Sequence
  Synthetic Construct
NTVVGSS

SEQ ID NO: 12679 - protein, 7 aa, Artificial Sequence
  Synthetic Construct
SLNSPTT

SEQ ID NO: 12680 - protein, 7 aa, Artificial Sequence
  Synthetic Construct
TTGMDVK

SEQ ID NO: 12681 - protein, 7 aa, Artificial Sequence
  Synthetic Construct
NNRDTTN

SEQ ID NO: 12682 - protein, 7 aa, Artificial Sequence
  Synthetic Construct
WGNYTPT

SEQ ID NO: 12683 - protein, 7 aa, Artificial Sequence
  Synthetic Construct
GITRSDT

SEQ ID NO: 12684 - protein, 7 aa, Artificial Sequence
  Synthetic Construct
HILRTPE

SEQ ID NO: 12685 - protein, 7 aa, Artificial Sequence
  Synthetic Construct
RSASVEN

SEQ ID NO: 12686 - protein, 7 aa, Artificial Sequence
  Synthetic Construct
SLSLGKG

SEQ ID NO: 12687 - protein, 7 aa, Artificial Sequence
  Synthetic Construct
KREVVGD

SEQ ID NO: 12688 - protein, 7 aa, Artificial Sequence
  Synthetic Construct
IQPSNHE

SEQ ID NO: 12689 - protein, 7 aa, Artificial Sequence
  Synthetic Construct
MNLGNAP

SEQ ID NO: 12690 - protein, 7 aa, Artificial Sequence
  Synthetic Construct
QPNNTNS

SEQ ID NO: 12691 - protein, 7 aa, Artificial Sequence
  Synthetic Construct
LQSMVQG

SEQ ID NO: 12692 - protein, 7 aa, Artificial Sequence
  Synthetic Construct
HGNTTST

SEQ ID NO: 12693 - protein, 7 aa, Artificial Sequence
  Synthetic Construct
IQSTVTL

SEQ ID NO: 12694 - protein, 7 aa, Artificial Sequence
  Synthetic Construct
DDRQGPR

SEQ ID NO: 12695 - protein, 7 aa, Artificial Sequence
  Synthetic Construct
QTATNIL

SEQ ID NO: 12696 - protein, 7 aa, Artificial Sequence
  Synthetic Construct
RQHADTV

SEQ ID NO: 12697 - protein, 7 aa, Artificial Sequence
  Synthetic Construct
TRSESSL

SEQ ID NO: 12698 - protein, 7 aa, Artificial Sequence
  Synthetic Construct
RGHDPAV

SEQ ID NO: 12699 - protein, 7 aa, Artificial Sequence
  Synthetic Construct
STSQTDL

SEQ ID NO: 12700 - protein, 7 aa, Artificial Sequence
  Synthetic Construct
VSTSAVL

SEQ ID NO: 12701 - protein, 7 aa, Artificial Sequence
  Synthetic Construct
SMPPERF

SEQ ID NO: 12702 - protein, 7 aa, Artificial Sequence
  Synthetic Construct
VTSAHPV

SEQ ID NO: 12703 - protein, 7 aa, Artificial Sequence
  Synthetic Construct
TSRQVGL

SEQ ID NO: 12704 - protein, 7 aa, Artificial Sequence
  Synthetic Construct
TPKFSYE

SEQ ID NO: 12705 - protein, 7 aa, Artificial Sequence
  Synthetic Construct
NRMASTM

SEQ ID NO: 12706 - protein, 7 aa, Artificial Sequence
  Synthetic Construct
LLDNTRP

SEQ ID NO: 12707 - protein, 7 aa, Artificial Sequence
  Synthetic Construct
LTTIPST

SEQ ID NO: 12708 - protein, 7 aa, Artificial Sequence
  Synthetic Construct
ANRIRDN

SEQ ID NO: 12709 - protein, 7 aa, Artificial Sequence
  Synthetic Construct
PRDIQRT

SEQ ID NO: 12710 - protein, 7 aa, Artificial Sequence
  Synthetic Construct
MPHGLKN

SEQ ID NO: 12711 - protein, 7 aa, Artificial Sequence
  Synthetic Construct
PFTQNHL

SEQ ID NO: 12712 - protein, 7 aa, Artificial Sequence
  Synthetic Construct
NANGNTR

SEQ ID NO: 12713 - protein, 7 aa, Artificial Sequence
  Synthetic Construct
LAYSTSA

SEQ ID NO: 12714 - protein, 7 aa, Artificial Sequence
  Synthetic Construct
TDRYNIK

SEQ ID NO: 12715 - protein, 7 aa, Artificial Sequence
  Synthetic Construct
YVTSAEH

SEQ ID NO: 12716 - protein, 7 aa, Artificial Sequence
  Synthetic Construct
SHQQTTV

SEQ ID NO: 12717 - protein, 7 aa, Artificial Sequence
  Synthetic Construct
LNMQTRG

SEQ ID NO: 12718 - protein, 7 aa, Artificial Sequence
  Synthetic Construct
YTPQLKS

SEQ ID NO: 12719 - protein, 7 aa, Artificial Sequence
  Synthetic Construct
QINGQVI

SEQ ID NO: 12720 - protein, 7 aa, Artificial Sequence
  Synthetic Construct
TREGVLP

SEQ ID NO: 12721 - protein, 7 aa, Artificial Sequence
  Synthetic Construct
VHQSVPL

SEQ ID NO: 12722 - protein, 7 aa, Artificial Sequence
  Synthetic Construct
PYSMGHP

SEQ ID NO: 12723 - protein, 7 aa, Artificial Sequence
  Synthetic Construct
GTKTHSL

SEQ ID NO: 12724 - protein, 7 aa, Artificial Sequence
  Synthetic Construct
TLTTGSK

SEQ ID NO: 12725 - protein, 7 aa, Artificial Sequence
  Synthetic Construct
FTIGVTG

SEQ ID NO: 12726 - protein, 7 aa, Artificial Sequence
  Synthetic Construct
LSSHNHN

SEQ ID NO: 12727 - protein, 7 aa, Artificial Sequence
  Synthetic Construct
TGKMPLE

SEQ ID NO: 12728 - protein, 7 aa, Artificial Sequence
  Synthetic Construct
TANPHAT

SEQ ID NO: 12729 - protein, 7 aa, Artificial Sequence
  Synthetic Construct
HDSVASS

SEQ ID NO: 12730 - protein, 7 aa, Artificial Sequence
  Synthetic Construct
TRADVLM

SEQ ID NO: 12731 - protein, 7 aa, Artificial Sequence
  Synthetic Construct
ANHASNA

SEQ ID NO: 12732 - protein, 7 aa, Artificial Sequence
  Synthetic Construct
SHIVGVE

SEQ ID NO: 12733 - protein, 7 aa, Artificial Sequence
  Synthetic Construct
YTAQKTS

SEQ ID NO: 12734 - protein, 7 aa, Artificial Sequence
  Synthetic Construct
LPAVQKM

SEQ ID NO: 12735 - protein, 7 aa, Artificial Sequence
  Synthetic Construct
SGIQTAK

SEQ ID NO: 12736 - protein, 7 aa, Artificial Sequence
  Synthetic Construct
DPVKIGH

SEQ ID NO: 12737 - protein, 7 aa, Artificial Sequence
  Synthetic Construct
SQTMSKS

SEQ ID NO: 12738 - protein, 7 aa, Artificial Sequence
  Synthetic Construct
SLTPTNI

SEQ ID NO: 12739 - protein, 7 aa, Artificial Sequence
  Synthetic Construct
YLNNTNS

SEQ ID NO: 12740 - protein, 7 aa, Artificial Sequence
  Synthetic Construct
MTRMSQN

SEQ ID NO: 12741 - protein, 7 aa, Artificial Sequence
  Synthetic Construct
VNQSLSR

SEQ ID NO: 12742 - protein, 7 aa, Artificial Sequence
  Synthetic Construct
RTVTDNR

SEQ ID NO: 12743 - protein, 7 aa, Artificial Sequence
  Synthetic Construct
ITGVFAN

SEQ ID NO: 12744 - protein, 7 aa, Artificial Sequence
  Synthetic Construct
SPGLSRV

SEQ ID NO: 12745 - protein, 7 aa, Artificial Sequence
  Synthetic Construct
VVNPQTR

SEQ ID NO: 12746 - protein, 7 aa, Artificial Sequence
  Synthetic Construct
WSQSLSA

SEQ ID NO: 12747 - protein, 7 aa, Artificial Sequence
  Synthetic Construct
PRDASND

SEQ ID NO: 12748 - protein, 7 aa, Artificial Sequence
  Synthetic Construct
YTSMTEF

SEQ ID NO: 12749 - protein, 7 aa, Artificial Sequence
  Synthetic Construct
NNSPSPR

SEQ ID NO: 12750 - protein, 7 aa, Artificial Sequence
  Synthetic Construct
NSLSHGD

SEQ ID NO: 12751 - protein, 7 aa, Artificial Sequence
  Synthetic Construct
RVAGEMA

SEQ ID NO: 12752 - protein, 7 aa, Artificial Sequence
  Synthetic Construct
GIGSREL

SEQ ID NO: 12753 - protein, 7 aa, Artificial Sequence
  Synthetic Construct
YVSRIRD

SEQ ID NO: 12754 - protein, 7 aa, Artificial Sequence
  Synthetic Construct
YPSPNDN

SEQ ID NO: 12755 - protein, 7 aa, Artificial Sequence
  Synthetic Construct
LQRTAHN

SEQ ID NO: 12756 - protein, 7 aa, Artificial Sequence
  Synthetic Construct
LDSLSRH

SEQ ID NO: 12757 - protein, 7 aa, Artificial Sequence
  Synthetic Construct
TKISAGS

SEQ ID NO: 12758 - protein, 7 aa, Artificial Sequence
  Synthetic Construct
KDNSPVV

SEQ ID NO: 12759 - protein, 7 aa, Artificial Sequence
  Synthetic Construct
TGQGSSL

SEQ ID NO: 12760 - protein, 7 aa, Artificial Sequence
  Synthetic Construct
DTHLSRH

SEQ ID NO: 12761 - protein, 7 aa, Artificial Sequence
  Synthetic Construct
DIVRRQA

SEQ ID NO: 12762 - protein, 7 aa, Artificial Sequence
  Synthetic Construct
AMKYAQT

SEQ ID NO: 12763 - protein, 7 aa, Artificial Sequence
  Synthetic Construct
RLADQHP

SEQ ID NO: 12764 - protein, 7 aa, Artificial Sequence
  Synthetic Construct
APDSTRM

SEQ ID NO: 12765 - protein, 7 aa, Artificial Sequence
  Synthetic Construct
SRVSPSS

SEQ ID NO: 12766 - protein, 7 aa, Artificial Sequence
  Synthetic Construct
VHGQGEP

SEQ ID NO: 12767 - protein, 7 aa, Artificial Sequence
  Synthetic Construct
MRDSSTR

SEQ ID NO: 12768 - protein, 7 aa, Artificial Sequence
  Synthetic Construct
WPQHTNT

SEQ ID NO: 12769 - protein, 7 aa, Artificial Sequence
  Synthetic Construct
VGSYPVT

SEQ ID NO: 12770 - protein, 7 aa, Artificial Sequence
  Synthetic Construct
TATQGAN

SEQ ID NO: 12771 - protein, 7 aa, Artificial Sequence
  Synthetic Construct
KNNSMDS

SEQ ID NO: 12772 - protein, 7 aa, Artificial Sequence
  Synthetic Construct
HTNAVKE

SEQ ID NO: 12773 - protein, 7 aa, Artificial Sequence
  Synthetic Construct
LHSVTTP

SEQ ID NO: 12774 - protein, 7 aa, Artificial Sequence
  Synthetic Construct
APGQQNF

SEQ ID NO: 12775 - protein, 7 aa, Artificial Sequence
  Synthetic Construct
SYTNRTM

SEQ ID NO: 12776 - protein, 7 aa, Artificial Sequence
  Synthetic Construct
SGQSNTK

SEQ ID NO: 12777 - protein, 7 aa, Artificial Sequence
  Synthetic Construct
DSYRAQS

SEQ ID NO: 12778 - protein, 7 aa, Artificial Sequence
  Synthetic Construct
MYKHNSD

SEQ ID NO: 12779 - protein, 7 aa, Artificial Sequence
  Synthetic Construct
SLAMVNP

SEQ ID NO: 12780 - protein, 7 aa, Artificial Sequence
  Synthetic Construct
PLTSKSM

SEQ ID NO: 12781 - protein, 7 aa, Artificial Sequence
  Synthetic Construct
LGAQPTP

SEQ ID NO: 12782 - protein, 7 aa, Artificial Sequence
  Synthetic Construct
EGNQKPQ

SEQ ID NO: 12783 - protein, 7 aa, Artificial Sequence
  Synthetic Construct
QVRPGAH

SEQ ID NO: 12784 - protein, 7 aa, Artificial Sequence
  Synthetic Construct
SGNITAM

SEQ ID NO: 12785 - protein, 7 aa, Artificial Sequence
  Synthetic Construct
NDSKIAE

SEQ ID NO: 12786 - protein, 7 aa, Artificial Sequence
  Synthetic Construct
IMKNEHN

SEQ ID NO: 12787 - protein, 7 aa, Artificial Sequence
  Synthetic Construct
LLTNTDR

SEQ ID NO: 12788 - protein, 7 aa, Artificial Sequence
  Synthetic Construct
DTAQSRN

SEQ ID NO: 12789 - protein, 7 aa, Artificial Sequence
  Synthetic Construct
IDHGKTN

SEQ ID NO: 12790 - protein, 7 aa, Artificial Sequence
  Synthetic Construct
TSPRSLL

SEQ ID NO: 12791 - protein, 7 aa, Artificial Sequence
  Synthetic Construct
SNPRDSS

SEQ ID NO: 12792 - protein, 7 aa, Artificial Sequence
  Synthetic Construct
IMQSIQN

SEQ ID NO: 12793 - protein, 7 aa, Artificial Sequence
  Synthetic Construct
KVSPSST

SEQ ID NO: 12794 - protein, 7 aa, Artificial Sequence
  Synthetic Construct
TGPSPSL

SEQ ID NO: 12795 - protein, 7 aa, Artificial Sequence
  Synthetic Construct
GAARAQA

SEQ ID NO: 12796 - protein, 7 aa, Artificial Sequence
  Synthetic Construct
KFQSPEP

SEQ ID NO: 12797 - protein, 7 aa, Artificial Sequence
  Synthetic Construct
MATNSTE

SEQ ID NO: 12798 - protein, 7 aa, Artificial Sequence
  Synthetic Construct
NVLTNIS

SEQ ID NO: 12799 - protein, 7 aa, Artificial Sequence
  Synthetic Construct
KNGMNLV

SEQ ID NO: 12800 - protein, 7 aa, Artificial Sequence
  Synthetic Construct
TPTQPSS

SEQ ID NO: 12801 - protein, 7 aa, Artificial Sequence
  Synthetic Construct
TKELVIH

SEQ ID NO: 12802 - protein, 7 aa, Artificial Sequence
  Synthetic Construct
IMNQSVQ

SEQ ID NO: 12803 - protein, 7 aa, Artificial Sequence
  Synthetic Construct
VSNARDK

SEQ ID NO: 12804 - protein, 7 aa, Artificial Sequence
  Synthetic Construct
SNHTRSY

SEQ ID NO: 12805 - protein, 7 aa, Artificial Sequence
  Synthetic Construct
HTDRLNP

SEQ ID NO: 12806 - protein, 7 aa, Artificial Sequence
  Synthetic Construct
AAPSMSD

SEQ ID NO: 12807 - protein, 7 aa, Artificial Sequence
  Synthetic Construct
FSNTHAL

SEQ ID NO: 12808 - protein, 7 aa, Artificial Sequence
  Synthetic Construct
AHDLHRV

SEQ ID NO: 12809 - protein, 7 aa, Artificial Sequence
  Synthetic Construct
LQVNHVA

SEQ ID NO: 12810 - protein, 7 aa, Artificial Sequence
  Synthetic Construct
SGPNLSR

SEQ ID NO: 12811 - protein, 7 aa, Artificial Sequence
  Synthetic Construct
TYTSTPG

SEQ ID NO: 12812 - protein, 7 aa, Artificial Sequence
  Synthetic Construct
YGTPPST

SEQ ID NO: 12813 - protein, 7 aa, Artificial Sequence
  Synthetic Construct
YGVSSGS

SEQ ID NO: 12814 - protein, 7 aa, Artificial Sequence
  Synthetic Construct
PTRDLMS

SEQ ID NO: 12815 - protein, 7 aa, Artificial Sequence
  Synthetic Construct
KIDAMTQ

SEQ ID NO: 12816 - protein, 7 aa, Artificial Sequence
  Synthetic Construct
RIGTSEV

SEQ ID NO: 12817 - protein, 7 aa, Artificial Sequence
  Synthetic Construct
FDPLQSS

SEQ ID NO: 12818 - protein, 7 aa, Artificial Sequence
  Synthetic Construct
LLHHVEV

SEQ ID NO: 12819 - protein, 7 aa, Artificial Sequence
  Synthetic Construct
VTLGNSV

SEQ ID NO: 12820 - protein, 7 aa, Artificial Sequence
  Synthetic Construct
LLNDRSV

SEQ ID NO: 12821 - protein, 7 aa, Artificial Sequence
  Synthetic Construct
FVDRRPQ

SEQ ID NO: 12822 - protein, 7 aa, Artificial Sequence
  Synthetic Construct
TNVTTTT

SEQ ID NO: 12823 - protein, 7 aa, Artificial Sequence
  Synthetic Construct
DETNKRW

SEQ ID NO: 12824 - protein, 7 aa, Artificial Sequence
  Synthetic Construct
TSTSAIR

SEQ ID NO: 12825 - protein, 7 aa, Artificial Sequence
  Synthetic Construct
GTSRVQG

SEQ ID NO: 12826 - protein, 7 aa, Artificial Sequence
  Synthetic Construct
LNTMALP

SEQ ID NO: 12827 - protein, 7 aa, Artificial Sequence
  Synthetic Construct
STHATDR

SEQ ID NO: 12828 - protein, 7 aa, Artificial Sequence
  Synthetic Construct
HHGVTSG

SEQ ID NO: 12829 - protein, 7 aa, Artificial Sequence
  Synthetic Construct
GLMANNP

SEQ ID NO: 12830 - protein, 7 aa, Artificial Sequence
  Synthetic Construct
GSSSNSF

SEQ ID NO: 12831 - protein, 7 aa, Artificial Sequence
  Synthetic Construct
REKMTLL

SEQ ID NO: 12832 - protein, 7 aa, Artificial Sequence
  Synthetic Construct
SPVSSDS

SEQ ID NO: 12833 - protein, 7 aa, Artificial Sequence
  Synthetic Construct
DVAHKDR

SEQ ID NO: 12834 - protein, 7 aa, Artificial Sequence
  Synthetic Construct
SMVSNIA

SEQ ID NO: 12835 - protein, 7 aa, Artificial Sequence
  Synthetic Construct
MMHNMQS

SEQ ID NO: 12836 - protein, 7 aa, Artificial Sequence
  Synthetic Construct
VSNSSRM

SEQ ID NO: 12837 - protein, 7 aa, Artificial Sequence
  Synthetic Construct
YTATKAS

SEQ ID NO: 12838 - protein, 7 aa, Artificial Sequence
  Synthetic Construct
STSGGVR

SEQ ID NO: 12839 - protein, 7 aa, Artificial Sequence
  Synthetic Construct
FTRAEPA

SEQ ID NO: 12840 - protein, 7 aa, Artificial Sequence
  Synthetic Construct
PITRGTI

SEQ ID NO: 12841 - protein, 7 aa, Artificial Sequence
  Synthetic Construct
YHNSMLG

SEQ ID NO: 12842 - protein, 7 aa, Artificial Sequence
  Synthetic Construct
SNSPGNA

SEQ ID NO: 12843 - protein, 7 aa, Artificial Sequence
  Synthetic Construct
QKGVQLP

SEQ ID NO: 12844 - protein, 7 aa, Artificial Sequence
  Synthetic Construct
RSETNNT

SEQ ID NO: 12845 - protein, 7 aa, Artificial Sequence
  Synthetic Construct
VDQMLAP

SEQ ID NO: 12846 - protein, 7 aa, Artificial Sequence
  Synthetic Construct
QTRHTSM

SEQ ID NO: 12847 - protein, 7 aa, Artificial Sequence
  Synthetic Construct
MHADRAL

SEQ ID NO: 12848 - protein, 7 aa, Artificial Sequence
  Synthetic Construct
STTHAPK

SEQ ID NO: 12849 - protein, 7 aa, Artificial Sequence
  Synthetic Construct
SNQTIMT

SEQ ID NO: 12850 - protein, 7 aa, Artificial Sequence
  Synthetic Construct
VSSPSGL

SEQ ID NO: 12851 - protein, 7 aa, Artificial Sequence
  Synthetic Construct
KRGEEMV

SEQ ID NO: 12852 - protein, 7 aa, Artificial Sequence
  Synthetic Construct
QDSGNSY

SEQ ID NO: 12853 - protein, 7 aa, Artificial Sequence
  Synthetic Construct
SHATTGG

SEQ ID NO: 12854 - protein, 7 aa, Artificial Sequence
  Synthetic Construct
KLSETSH

SEQ ID NO: 12855 - protein, 7 aa, Artificial Sequence
  Synthetic Construct
LNYKEAP

SEQ ID NO: 12856 - protein, 7 aa, Artificial Sequence
  Synthetic Construct
SVDSVRL

SEQ ID NO: 12857 - protein, 7 aa, Artificial Sequence
  Synthetic Construct
QPNVIQT

SEQ ID NO: 12858 - protein, 7 aa, Artificial Sequence
  Synthetic Construct
RMTNLQT

SEQ ID NO: 12859 - protein, 7 aa, Artificial Sequence
  Synthetic Construct
ATPGGSG

SEQ ID NO: 12860 - protein, 7 aa, Artificial Sequence
  Synthetic Construct
DVNSMSS

SEQ ID NO: 12861 - protein, 7 aa, Artificial Sequence
  Synthetic Construct
LPRSHLD

SEQ ID NO: 12862 - protein, 7 aa, Artificial Sequence
  Synthetic Construct
PAPRYDK

SEQ ID NO: 12863 - protein, 7 aa, Artificial Sequence
  Synthetic Construct
RNYSDKD

SEQ ID NO: 12864 - protein, 7 aa, Artificial Sequence
  Synthetic Construct
SENLLSR

SEQ ID NO: 12865 - protein, 7 aa, Artificial Sequence
  Synthetic Construct
SSLNMKD

SEQ ID NO: 12866 - protein, 7 aa, Artificial Sequence
  Synthetic Construct
SDKEYGR

SEQ ID NO: 12867 - protein, 7 aa, Artificial Sequence
  Synthetic Construct
YVSQSGM

SEQ ID NO: 12868 - protein, 7 aa, Artificial Sequence
  Synthetic Construct
NVVSVRQ

SEQ ID NO: 12869 - protein, 7 aa, Artificial Sequence
  Synthetic Construct
TGKEGRT

SEQ ID NO: 12870 - protein, 7 aa, Artificial Sequence
  Synthetic Construct
FKNTVAT

SEQ ID NO: 12871 - protein, 7 aa, Artificial Sequence
  Synthetic Construct
GSREPSS

SEQ ID NO: 12872 - protein, 7 aa, Artificial Sequence
  Synthetic Construct
REKVSTP

SEQ ID NO: 12873 - protein, 7 aa, Artificial Sequence
  Synthetic Construct
QEPARHN

SEQ ID NO: 12874 - protein, 7 aa, Artificial Sequence
  Synthetic Construct
TSHSNGR

SEQ ID NO: 12875 - protein, 7 aa, Artificial Sequence
  Synthetic Construct
DLSSPKM

SEQ ID NO: 12876 - protein, 7 aa, Artificial Sequence
  Synthetic Construct
LATTPKP

SEQ ID NO: 12877 - protein, 7 aa, Artificial Sequence
  Synthetic Construct
SGPNVSL

SEQ ID NO: 12878 - protein, 7 aa, Artificial Sequence
  Synthetic Construct
PVYNASP

SEQ ID NO: 12879 - protein, 7 aa, Artificial Sequence
  Synthetic Construct
NSTTLVM

SEQ ID NO: 12880 - protein, 7 aa, Artificial Sequence
  Synthetic Construct
RNAVVSM

SEQ ID NO: 12881 - protein, 7 aa, Artificial Sequence
  Synthetic Construct
KDLLAKL

SEQ ID NO: 12882 - protein, 7 aa, Artificial Sequence
  Synthetic Construct
PHEGSSR

SEQ ID NO: 12883 - protein, 7 aa, Artificial Sequence
  Synthetic Construct
RDTVSRY

SEQ ID NO: 12884 - protein, 7 aa, Artificial Sequence
  Synthetic Construct
GQAAQGH

SEQ ID NO: 12885 - protein, 7 aa, Artificial Sequence
  Synthetic Construct
RAETAHV

SEQ ID NO: 12886 - protein, 7 aa, Artificial Sequence
  Synthetic Construct
ENRTVPT

SEQ ID NO: 12887 - protein, 7 aa, Artificial Sequence
  Synthetic Construct
SSNDARV

SEQ ID NO: 12888 - protein, 7 aa, Artificial Sequence
  Synthetic Construct
PGQVDRR

SEQ ID NO: 12889 - protein, 7 aa, Artificial Sequence
  Synthetic Construct
GPGANTT

SEQ ID NO: 12890 - protein, 7 aa, Artificial Sequence
  Synthetic Construct
MPENLKE

SEQ ID NO: 12891 - protein, 7 aa, Artificial Sequence
  Synthetic Construct
TNAVASN

SEQ ID NO: 12892 - protein, 7 aa, Artificial Sequence
  Synthetic Construct
YGKIELY

SEQ ID NO: 12893 - protein, 7 aa, Artificial Sequence
  Synthetic Construct
NPNGTGF

SEQ ID NO: 12894 - protein, 7 aa, Artificial Sequence
  Synthetic Construct
SRNTMGS

SEQ ID NO: 12895 - protein, 7 aa, Artificial Sequence
  Synthetic Construct
PSHGITA

SEQ ID NO: 12896 - protein, 7 aa, Artificial Sequence
  Synthetic Construct
LETLRGP

SEQ ID NO: 12897 - protein, 7 aa, Artificial Sequence
  Synthetic Construct
DRSPDIR

SEQ ID NO: 12898 - protein, 7 aa, Artificial Sequence
  Synthetic Construct
KDLASAK

SEQ ID NO: 12899 - protein, 7 aa, Artificial Sequence
  Synthetic Construct
ITSHGNS

SEQ ID NO: 12900 - protein, 7 aa, Artificial Sequence
  Synthetic Construct
HSKMPST

SEQ ID NO: 12901 - protein, 7 aa, Artificial Sequence
  Synthetic Construct
IATFTTA

SEQ ID NO: 12902 - protein, 7 aa, Artificial Sequence
  Synthetic Construct
AASGYLN

SEQ ID NO: 12903 - protein, 7 aa, Artificial Sequence
  Synthetic Construct
DSVRPAI

SEQ ID NO: 12904 - protein, 7 aa, Artificial Sequence
  Synthetic Construct
RLSEEMR

SEQ ID NO: 12905 - protein, 7 aa, Artificial Sequence
  Synthetic Construct
LPISATE

SEQ ID NO: 12906 - protein, 7 aa, Artificial Sequence
  Synthetic Construct
SNVAAQM

SEQ ID NO: 12907 - protein, 7 aa, Artificial Sequence
  Synthetic Construct
YQSLISE

SEQ ID NO: 12908 - protein, 7 aa, Artificial Sequence
  Synthetic Construct
YQSGYDK

SEQ ID NO: 12909 - protein, 7 aa, Artificial Sequence
  Synthetic Construct
LRTGELT

SEQ ID NO: 12910 - protein, 7 aa, Artificial Sequence
  Synthetic Construct
PATNNMR

SEQ ID NO: 12911 - protein, 7 aa, Artificial Sequence
  Synthetic Construct
VSSSKFS

SEQ ID NO: 12912 - protein, 7 aa, Artificial Sequence
  Synthetic Construct
TTLLDKA

SEQ ID NO: 12913 - protein, 7 aa, Artificial Sequence
  Synthetic Construct
SPALHPS

SEQ ID NO: 12914 - protein, 7 aa, Artificial Sequence
  Synthetic Construct
FNHNRTD

SEQ ID NO: 12915 - protein, 7 aa, Artificial Sequence
  Synthetic Construct
AEKTANG

SEQ ID NO: 12916 - protein, 7 aa, Artificial Sequence
  Synthetic Construct
NLRVTAS

SEQ ID NO: 12917 - protein, 7 aa, Artificial Sequence
  Synthetic Construct
MKDGSRI

SEQ ID NO: 12918 - protein, 7 aa, Artificial Sequence
  Synthetic Construct
RIGANAT

SEQ ID NO: 12919 - protein, 7 aa, Artificial Sequence
  Synthetic Construct
ANLTPNR

SEQ ID NO: 12920 - protein, 7 aa, Artificial Sequence
  Synthetic Construct
SVSDKSH

SEQ ID NO: 12921 - protein, 7 aa, Artificial Sequence
  Synthetic Construct
YSTLHTA

SEQ ID NO: 12922 - protein, 7 aa, Artificial Sequence
  Synthetic Construct
TKFGGIQ

SEQ ID NO: 12923 - protein, 7 aa, Artificial Sequence
  Synthetic Construct
DIPKGSS

SEQ ID NO: 12924 - protein, 7 aa, Artificial Sequence
  Synthetic Construct
ILPSSSQ

SEQ ID NO: 12925 - protein, 7 aa, Artificial Sequence
  Synthetic Construct
VSQTTSS

SEQ ID NO: 12926 - protein, 7 aa, Artificial Sequence
  Synthetic Construct
TIHLHKD

SEQ ID NO: 12927 - protein, 7 aa, Artificial Sequence
  Synthetic Construct
VTDRVGN

SEQ ID NO: 12928 - protein, 7 aa, Artificial Sequence
  Synthetic Construct
LPARAAN

SEQ ID NO: 12929 - protein, 7 aa, Artificial Sequence
  Synthetic Construct
HTQSMTV

SEQ ID NO: 12930 - protein, 7 aa, Artificial Sequence
  Synthetic Construct
LLNSSQL

SEQ ID NO: 12931 - protein, 7 aa, Artificial Sequence
  Synthetic Construct
RNSELRA

SEQ ID NO: 12932 - protein, 7 aa, Artificial Sequence
  Synthetic Construct
QKSPNGL

SEQ ID NO: 12933 - protein, 7 aa, Artificial Sequence
  Synthetic Construct
KSGDHLT

SEQ ID NO: 12934 - protein, 7 aa, Artificial Sequence
  Synthetic Construct
GNRTTSS

SEQ ID NO: 12935 - protein, 7 aa, Artificial Sequence
  Synthetic Construct
MVALTVG

SEQ ID NO: 12936 - protein, 7 aa, Artificial Sequence
  Synthetic Construct
LSSNSPR

SEQ ID NO: 12937 - protein, 7 aa, Artificial Sequence
  Synthetic Construct
ASNNQTY

SEQ ID NO: 12938 - protein, 7 aa, Artificial Sequence
  Synthetic Construct
NNIVTTS

SEQ ID NO: 12939 - protein, 7 aa, Artificial Sequence
  Synthetic Construct
HDTKKPM

SEQ ID NO: 12940 - protein, 7 aa, Artificial Sequence
  Synthetic Construct
INTASYK

SEQ ID NO: 12941 - protein, 7 aa, Artificial Sequence
  Synthetic Construct
SGMVSMS

SEQ ID NO: 12942 - protein, 7 aa, Artificial Sequence
  Synthetic Construct
LVTASAR

SEQ ID NO: 12943 - protein, 7 aa, Artificial Sequence
  Synthetic Construct
SRAPSAM

SEQ ID NO: 12944 - protein, 7 aa, Artificial Sequence
  Synthetic Construct
NNNQKVY

SEQ ID NO: 12945 - protein, 7 aa, Artificial Sequence
  Synthetic Construct
TSVVANP

SEQ ID NO: 12946 - protein, 7 aa, Artificial Sequence
  Synthetic Construct
GNAGPSL

SEQ ID NO: 12947 - protein, 7 aa, Artificial Sequence
  Synthetic Construct
YSTSLEL

SEQ ID NO: 12948 - protein, 7 aa, Artificial Sequence
  Synthetic Construct
PSNPPKE

SEQ ID NO: 12949 - protein, 7 aa, Artificial Sequence
  Synthetic Construct
TNSKPSW

SEQ ID NO: 12950 - protein, 7 aa, Artificial Sequence
  Synthetic Construct
SIDRQQL

SEQ ID NO: 12951 - protein, 7 aa, Artificial Sequence
  Synthetic Construct
NKAGPAS

SEQ ID NO: 12952 - protein, 7 aa, Artificial Sequence
  Synthetic Construct
SMTTNRS

SEQ ID NO: 12953 - protein, 7 aa, Artificial Sequence
  Synthetic Construct
GNSAVQL

SEQ ID NO: 12954 - protein, 7 aa, Artificial Sequence
  Synthetic Construct
RSSDVNT

SEQ ID NO: 12955 - protein, 7 aa, Artificial Sequence
  Synthetic Construct
HNGVQSV

SEQ ID NO: 12956 - protein, 7 aa, Artificial Sequence
  Synthetic Construct
EKDHGMA

SEQ ID NO: 12957 - protein, 7 aa, Artificial Sequence
  Synthetic Construct
YRLPDGR

SEQ ID NO: 12958 - protein, 7 aa, Artificial Sequence
  Synthetic Construct
SSRELRL

SEQ ID NO: 12959 - protein, 7 aa, Artificial Sequence
  Synthetic Construct
NQVESRV

SEQ ID NO: 12960 - protein, 7 aa, Artificial Sequence
  Synthetic Construct
ALHSVPK

SEQ ID NO: 12961 - protein, 7 aa, Artificial Sequence
  Synthetic Construct
TGPSTVP

SEQ ID NO: 12962 - protein, 7 aa, Artificial Sequence
  Synthetic Construct
EPLGVHP

SEQ ID NO: 12963 - protein, 7 aa, Artificial Sequence
  Synthetic Construct
TRTDTTN

SEQ ID NO: 12964 - protein, 7 aa, Artificial Sequence
  Synthetic Construct
SHNLTAD

SEQ ID NO: 12965 - protein, 7 aa, Artificial Sequence
  Synthetic Construct
NVRRDDT

SEQ ID NO: 12966 - protein, 7 aa, Artificial Sequence
  Synthetic Construct
FAANLVA

SEQ ID NO: 12967 - protein, 7 aa, Artificial Sequence
  Synthetic Construct
IGAQARM

SEQ ID NO: 12968 - protein, 7 aa, Artificial Sequence
  Synthetic Construct
NSMSKAY

SEQ ID NO: 12969 - protein, 7 aa, Artificial Sequence
  Synthetic Construct
NVNKDRV

SEQ ID NO: 12970 - protein, 7 aa, Artificial Sequence
  Synthetic Construct
SFQGSAR

SEQ ID NO: 12971 - protein, 7 aa, Artificial Sequence
  Synthetic Construct
ANSDHIH

SEQ ID NO: 12972 - protein, 7 aa, Artificial Sequence
  Synthetic Construct
VSLASKS

SEQ ID NO: 12973 - protein, 7 aa, Artificial Sequence
  Synthetic Construct
PKDRATS

SEQ ID NO: 12974 - protein, 7 aa, Artificial Sequence
  Synthetic Construct
VRSQSDS

SEQ ID NO: 12975 - protein, 7 aa, Artificial Sequence
  Synthetic Construct
LGNSVFK

SEQ ID NO: 12976 - protein, 7 aa, Artificial Sequence
  Synthetic Construct
STKESPK

SEQ ID NO: 12977 - protein, 7 aa, Artificial Sequence
  Synthetic Construct
LQPTTFS

SEQ ID NO: 12978 - protein, 7 aa, Artificial Sequence
  Synthetic Construct
PMHTAMV

SEQ ID NO: 12979 - protein, 7 aa, Artificial Sequence
  Synthetic Construct
VFAHTGL

SEQ ID NO: 12980 - protein, 7 aa, Artificial Sequence
  Synthetic Construct
QKATSIH

SEQ ID NO: 12981 - protein, 7 aa, Artificial Sequence
  Synthetic Construct
GSKSDNL

SEQ ID NO: 12982 - protein, 7 aa, Artificial Sequence
  Synthetic Construct
SGTNVVS

SEQ ID NO: 12983 - protein, 7 aa, Artificial Sequence
  Synthetic Construct
TKLTTLS

SEQ ID NO: 12984 - protein, 7 aa, Artificial Sequence
  Synthetic Construct
PILHNQI

SEQ ID NO: 12985 - protein, 7 aa, Artificial Sequence
  Synthetic Construct
VTNPIKP

SEQ ID NO: 12986 - protein, 7 aa, Artificial Sequence
  Synthetic Construct
TNALHMK

SEQ ID NO: 12987 - protein, 7 aa, Artificial Sequence
  Synthetic Construct
VAHAYPA

SEQ ID NO: 12988 - protein, 7 aa, Artificial Sequence
  Synthetic Construct
AEHGLGP

SEQ ID NO: 12989 - protein, 7 aa, Artificial Sequence
  Synthetic Construct
MNKYSPA

SEQ ID NO: 12990 - protein, 7 aa, Artificial Sequence
  Synthetic Construct
TMQDRLT

SEQ ID NO: 12991 - protein, 7 aa, Artificial Sequence
  Synthetic Construct
GVKILNS

SEQ ID NO: 12992 - protein, 7 aa, Artificial Sequence
  Synthetic Construct
AQNKMTS

SEQ ID NO: 12993 - protein, 7 aa, Artificial Sequence
  Synthetic Construct
TSALTDI

SEQ ID NO: 12994 - protein, 7 aa, Artificial Sequence
  Synthetic Construct
DLRHADI

SEQ ID NO: 12995 - protein, 7 aa, Artificial Sequence
  Synthetic Construct
QNKALTV

SEQ ID NO: 12996 - protein, 7 aa, Artificial Sequence
  Synthetic Construct
TQGITIV

SEQ ID NO: 12997 - protein, 7 aa, Artificial Sequence
  Synthetic Construct
TATILSG

SEQ ID NO: 12998 - protein, 7 aa, Artificial Sequence
  Synthetic Construct
FAASNIS

SEQ ID NO: 12999 - protein, 7 aa, Artificial Sequence
  Synthetic Construct
RNTMETM

SEQ ID NO: 13000 - protein, 7 aa, Artificial Sequence
  Synthetic Construct
SSGTSYS

SEQ ID NO: 13001 - protein, 7 aa, Artificial Sequence
  Synthetic Construct
ANHGLNA

SEQ ID NO: 13002 - protein, 7 aa, Artificial Sequence
  Synthetic Construct
MLSNSRS

SEQ ID NO: 13003 - protein, 7 aa, Artificial Sequence
  Synthetic Construct
AAIHATP

SEQ ID NO: 13004 - protein, 7 aa, Artificial Sequence
  Synthetic Construct
WQSFASA

SEQ ID NO: 13005 - protein, 7 aa, Artificial Sequence
  Synthetic Construct
MGGNSST

SEQ ID NO: 13006 - protein, 7 aa, Artificial Sequence
  Synthetic Construct
KTDLAQH

SEQ ID NO: 13007 - protein, 7 aa, Artificial Sequence
  Synthetic Construct
VNTTRFS

SEQ ID NO: 13008 - protein, 7 aa, Artificial Sequence
  Synthetic Construct
NVHAHQA

SEQ ID NO: 13009 - protein, 7 aa, Artificial Sequence
  Synthetic Construct
GAMSIQT

SEQ ID NO: 13010 - protein, 7 aa, Artificial Sequence
  Synthetic Construct
ARGPTIV

SEQ ID NO: 13011 - protein, 7 aa, Artificial Sequence
  Synthetic Construct
TMHSKSD

SEQ ID NO: 13012 - protein, 7 aa, Artificial Sequence
  Synthetic Construct
TVTQTTQ

SEQ ID NO: 13013 - protein, 7 aa, Artificial Sequence
  Synthetic Construct
GNTNSLT

SEQ ID NO: 13014 - protein, 7 aa, Artificial Sequence
  Synthetic Construct
RVIASVN

SEQ ID NO: 13015 - protein, 7 aa, Artificial Sequence
  Synthetic Construct
PSSGNSE

SEQ ID NO: 13016 - protein, 7 aa, Artificial Sequence
  Synthetic Construct
QPHGFTA

SEQ ID NO: 13017 - protein, 7 aa, Artificial Sequence
  Synthetic Construct
TTGTNMR

SEQ ID NO: 13018 - protein, 7 aa, Artificial Sequence
  Synthetic Construct
FTRLEDR

SEQ ID NO: 13019 - protein, 7 aa, Artificial Sequence
  Synthetic Construct
DRSPAHT

SEQ ID NO: 13020 - protein, 7 aa, Artificial Sequence
  Synthetic Construct
HVHNTVP

SEQ ID NO: 13021 - protein, 7 aa, Artificial Sequence
  Synthetic Construct
MNTTGTK

SEQ ID NO: 13022 - protein, 7 aa, Artificial Sequence
  Synthetic Construct
FATQTIA

SEQ ID NO: 13023 - protein, 7 aa, Artificial Sequence
  Synthetic Construct
VSGNIPV

SEQ ID NO: 13024 - protein, 7 aa, Artificial Sequence
  Synthetic Construct
DGRNIAP

SEQ ID NO: 13025 - protein, 7 aa, Artificial Sequence
  Synthetic Construct
MLPTVNR

SEQ ID NO: 13026 - protein, 7 aa, Artificial Sequence
  Synthetic Construct
PTTNVLG

SEQ ID NO: 13027 - protein, 7 aa, Artificial Sequence
  Synthetic Construct
REMHGTL

SEQ ID NO: 13028 - protein, 7 aa, Artificial Sequence
  Synthetic Construct
SPYSTRP

SEQ ID NO: 13029 - protein, 7 aa, Artificial Sequence
  Synthetic Construct
YNMNTEM

SEQ ID NO: 13030 - protein, 7 aa, Artificial Sequence
  Synthetic Construct
GARMGHS

SEQ ID NO: 13031 - protein, 7 aa, Artificial Sequence
  Synthetic Construct
FSPGYVP

SEQ ID NO: 13032 - protein, 7 aa, Artificial Sequence
  Synthetic Construct
QQHIPPS

SEQ ID NO: 13033 - protein, 7 aa, Artificial Sequence
  Synthetic Construct
LSTSLSP

SEQ ID NO: 13034 - protein, 7 aa, Artificial Sequence
  Synthetic Construct
VNGIKEY

SEQ ID NO: 13035 - protein, 7 aa, Artificial Sequence
  Synthetic Construct
GVRTEPM

SEQ ID NO: 13036 - protein, 7 aa, Artificial Sequence
  Synthetic Construct
RNNDSLT

SEQ ID NO: 13037 - protein, 7 aa, Artificial Sequence
  Synthetic Construct
FNASPKL

SEQ ID NO: 13038 - protein, 7 aa, Artificial Sequence
  Synthetic Construct
GLTTSTT

SEQ ID NO: 13039 - protein, 7 aa, Artificial Sequence
  Synthetic Construct
MIRGTSS

SEQ ID NO: 13040 - protein, 7 aa, Artificial Sequence
  Synthetic Construct
TKLVATV

SEQ ID NO: 13041 - protein, 7 aa, Artificial Sequence
  Synthetic Construct
VSRQFEP

SEQ ID NO: 13042 - protein, 7 aa, Artificial Sequence
  Synthetic Construct
NGDSLRP

SEQ ID NO: 13043 - protein, 7 aa, Artificial Sequence
  Synthetic Construct
TQNLSSH

SEQ ID NO: 13044 - protein, 7 aa, Artificial Sequence
  Synthetic Construct
TVTGSLV

SEQ ID NO: 13045 - protein, 7 aa, Artificial Sequence
  Synthetic Construct
GRGPEAQ

SEQ ID NO: 13046 - protein, 7 aa, Artificial Sequence
  Synthetic Construct
PRNVGLE

SEQ ID NO: 13047 - protein, 7 aa, Artificial Sequence
  Synthetic Construct
FNSSIPT

SEQ ID NO: 13048 - protein, 7 aa, Artificial Sequence
  Synthetic Construct
GNQQHSS

SEQ ID NO: 13049 - protein, 7 aa, Artificial Sequence
  Synthetic Construct
PITNGSF

SEQ ID NO: 13050 - protein, 7 aa, Artificial Sequence
  Synthetic Construct
VQRTPLT

SEQ ID NO: 13051 - protein, 7 aa, Artificial Sequence
  Synthetic Construct
TPYAGRA

SEQ ID NO: 13052 - protein, 7 aa, Artificial Sequence
  Synthetic Construct
LALSNRT

SEQ ID NO: 13053 - protein, 7 aa, Artificial Sequence
  Synthetic Construct
GQMATGL

SEQ ID NO: 13054 - protein, 7 aa, Artificial Sequence
  Synthetic Construct
SNPATTT

SEQ ID NO: 13055 - protein, 7 aa, Artificial Sequence
  Synthetic Construct
GRTTSDS

SEQ ID NO: 13056 - protein, 7 aa, Artificial Sequence
  Synthetic Construct
SRLTSLG

SEQ ID NO: 13057 - protein, 7 aa, Artificial Sequence
  Synthetic Construct
HLSTPDL

SEQ ID NO: 13058 - protein, 7 aa, Artificial Sequence
  Synthetic Construct
MPHAPTS

SEQ ID NO: 13059 - protein, 7 aa, Artificial Sequence
  Synthetic Construct
VAGMLTH

SEQ ID NO: 13060 - protein, 7 aa, Artificial Sequence
  Synthetic Construct
VASQKLN

SEQ ID NO: 13061 - protein, 7 aa, Artificial Sequence
  Synthetic Construct
TQSMTSR

SEQ ID NO: 13062 - protein, 7 aa, Artificial Sequence
  Synthetic Construct
PISTMSL

SEQ ID NO: 13063 - protein, 7 aa, Artificial Sequence
  Synthetic Construct
AQLNSAG

SEQ ID NO: 13064 - protein, 7 aa, Artificial Sequence
  Synthetic Construct
HLPKYEH

SEQ ID NO: 13065 - protein, 7 aa, Artificial Sequence
  Synthetic Construct
GVQAVVG

SEQ ID NO: 13066 - protein, 7 aa, Artificial Sequence
  Synthetic Construct
GDTQYAR

SEQ ID NO: 13067 - protein, 7 aa, Artificial Sequence
  Synthetic Construct
ASPLVMS

SEQ ID NO: 13068 - protein, 7 aa, Artificial Sequence
  Synthetic Construct
SNAGMSK

SEQ ID NO: 13069 - protein, 7 aa, Artificial Sequence
  Synthetic Construct
RSVSAVP

SEQ ID NO: 13070 - protein, 7 aa, Artificial Sequence
  Synthetic Construct
PSYHKSP

SEQ ID NO: 13071 - protein, 7 aa, Artificial Sequence
  Synthetic Construct
HQFTSSA

SEQ ID NO: 13072 - protein, 7 aa, Artificial Sequence
  Synthetic Construct
NQSPIGA

SEQ ID NO: 13073 - protein, 7 aa, Artificial Sequence
  Synthetic Construct
GAAGMSR

SEQ ID NO: 13074 - protein, 7 aa, Artificial Sequence
  Synthetic Construct
TVKTYSA

SEQ ID NO: 13075 - protein, 7 aa, Artificial Sequence
  Synthetic Construct
LSMTSQM

SEQ ID NO: 13076 - protein, 7 aa, Artificial Sequence
  Synthetic Construct
GLSPTFG

SEQ ID NO: 13077 - protein, 7 aa, Artificial Sequence
  Synthetic Construct
MDTVMKG

SEQ ID NO: 13078 - protein, 7 aa, Artificial Sequence
  Synthetic Construct
RDKISTY

SEQ ID NO: 13079 - protein, 7 aa, Artificial Sequence
  Synthetic Construct
DSNSYVR

SEQ ID NO: 13080 - protein, 7 aa, Artificial Sequence
  Synthetic Construct
SLKSSPF

SEQ ID NO: 13081 - protein, 7 aa, Artificial Sequence
  Synthetic Construct
LDRTAKP

SEQ ID NO: 13082 - protein, 7 aa, Artificial Sequence
  Synthetic Construct
PSRAPDP

SEQ ID NO: 13083 - protein, 7 aa, Artificial Sequence
  Synthetic Construct
YLNQIRS

SEQ ID NO: 13084 - protein, 7 aa, Artificial Sequence
  Synthetic Construct
QNRSVVE

SEQ ID NO: 13085 - protein, 7 aa, Artificial Sequence
  Synthetic Construct
QESMVKY

SEQ ID NO: 13086 - protein, 7 aa, Artificial Sequence
  Synthetic Construct
KLSQESN

SEQ ID NO: 13087 - protein, 7 aa, Artificial Sequence
  Synthetic Construct
RGTMEHD

SEQ ID NO: 13088 - protein, 7 aa, Artificial Sequence
  Synthetic Construct
QSGPGIV

SEQ ID NO: 13089 - protein, 7 aa, Artificial Sequence
  Synthetic Construct
LNQGDLL

SEQ ID NO: 13090 - protein, 7 aa, Artificial Sequence
  Synthetic Construct
AKTIGST

SEQ ID NO: 13091 - protein, 7 aa, Artificial Sequence
  Synthetic Construct
DSGNRTS

SEQ ID NO: 13092 - protein, 7 aa, Artificial Sequence
  Synthetic Construct
LSHSTSF

SEQ ID NO: 13093 - protein, 7 aa, Artificial Sequence
  Synthetic Construct
GDFSSKQ

SEQ ID NO: 13094 - protein, 7 aa, Artificial Sequence
  Synthetic Construct
DHSNAYR

SEQ ID NO: 13095 - protein, 7 aa, Artificial Sequence
  Synthetic Construct
VPTDRPR

SEQ ID NO: 13096 - protein, 7 aa, Artificial Sequence
  Synthetic Construct
SMQLINE

SEQ ID NO: 13097 - protein, 7 aa, Artificial Sequence
  Synthetic Construct
YANSVGL

SEQ ID NO: 13098 - protein, 7 aa, Artificial Sequence
  Synthetic Construct
VYLASGG

SEQ ID NO: 13099 - protein, 7 aa, Artificial Sequence
  Synthetic Construct
LIPVTSV

SEQ ID NO: 13100 - protein, 7 aa, Artificial Sequence
  Synthetic Construct
GNMNSRT

SEQ ID NO: 13101 - protein, 7 aa, Artificial Sequence
  Synthetic Construct
SHNDRSL

SEQ ID NO: 13102 - protein, 7 aa, Artificial Sequence
  Synthetic Construct
HRIPTAG

SEQ ID NO: 13103 - protein, 7 aa, Artificial Sequence
  Synthetic Construct
MGKDYTH

SEQ ID NO: 13104 - protein, 7 aa, Artificial Sequence
  Synthetic Construct
SHASTPI

SEQ ID NO: 13105 - protein, 7 aa, Artificial Sequence
  Synthetic Construct
LNSQTRS

SEQ ID NO: 13106 - protein, 7 aa, Artificial Sequence
  Synthetic Construct
RTLSDSV

SEQ ID NO: 13107 - protein, 7 aa, Artificial Sequence
  Synthetic Construct
LTTAKTF

SEQ ID NO: 13108 - protein, 7 aa, Artificial Sequence
  Synthetic Construct
RIVGSTS

SEQ ID NO: 13109 - protein, 7 aa, Artificial Sequence
  Synthetic Construct
TKTLALH

SEQ ID NO: 13110 - protein, 7 aa, Artificial Sequence
  Synthetic Construct
WEVPARN

SEQ ID NO: 13111 - protein, 7 aa, Artificial Sequence
  Synthetic Construct
ISNPAIA

SEQ ID NO: 13112 - protein, 7 aa, Artificial Sequence
  Synthetic Construct
LGASQTS

SEQ ID NO: 13113 - protein, 7 aa, Artificial Sequence
  Synthetic Construct
LSTHNSV

SEQ ID NO: 13114 - protein, 7 aa, Artificial Sequence
  Synthetic Construct
RHTDIDT

SEQ ID NO: 13115 - protein, 7 aa, Artificial Sequence
  Synthetic Construct
GRPVIAA

SEQ ID NO: 13116 - protein, 7 aa, Artificial Sequence
  Synthetic Construct
ANLRDGV

SEQ ID NO: 13117 - protein, 7 aa, Artificial Sequence
  Synthetic Construct
VQSPSIT

SEQ ID NO: 13118 - protein, 7 aa, Artificial Sequence
  Synthetic Construct
FTSGSHL

SEQ ID NO: 13119 - protein, 7 aa, Artificial Sequence
  Synthetic Construct
PLQQSGH

SEQ ID NO: 13120 - protein, 7 aa, Artificial Sequence
  Synthetic Construct
ARVATTL

SEQ ID NO: 13121 - protein, 7 aa, Artificial Sequence
  Synthetic Construct
PGRQNDA

SEQ ID NO: 13122 - protein, 7 aa, Artificial Sequence
  Synthetic Construct
KYSSTAI

SEQ ID NO: 13123 - protein, 7 aa, Artificial Sequence
  Synthetic Construct
HSTHYIA

SEQ ID NO: 13124 - protein, 7 aa, Artificial Sequence
  Synthetic Construct
QPLNALP

SEQ ID NO: 13125 - protein, 7 aa, Artificial Sequence
  Synthetic Construct
KTQETGN

SEQ ID NO: 13126 - protein, 7 aa, Artificial Sequence
  Synthetic Construct
SELSRHA

SEQ ID NO: 13127 - protein, 7 aa, Artificial Sequence
  Synthetic Construct
GPKTIST

SEQ ID NO: 13128 - protein, 7 aa, Artificial Sequence
  Synthetic Construct
SHSIVNP

SEQ ID NO: 13129 - protein, 7 aa, Artificial Sequence
  Synthetic Construct
HSNTVSS

SEQ ID NO: 13130 - protein, 7 aa, Artificial Sequence
  Synthetic Construct
VAGLTVQ

SEQ ID NO: 13131 - protein, 7 aa, Artificial Sequence
  Synthetic Construct
ANPGLAN

SEQ ID NO: 13132 - protein, 7 aa, Artificial Sequence
  Synthetic Construct
ASVQMTL

SEQ ID NO: 13133 - protein, 7 aa, Artificial Sequence
  Synthetic Construct
LVTAQGP

SEQ ID NO: 13134 - protein, 7 aa, Artificial Sequence
  Synthetic Construct
TTRYTSP

SEQ ID NO: 13135 - protein, 7 aa, Artificial Sequence
  Synthetic Construct
MDTDKPR

SEQ ID NO: 13136 - protein, 7 aa, Artificial Sequence
  Synthetic Construct
GTSVQDR

SEQ ID NO: 13137 - protein, 7 aa, Artificial Sequence
  Synthetic Construct
RASPQQY

SEQ ID NO: 13138 - protein, 7 aa, Artificial Sequence
  Synthetic Construct
VSSEHRI

SEQ ID NO: 13139 - protein, 7 aa, Artificial Sequence
  Synthetic Construct
SNMKIQP

SEQ ID NO: 13140 - protein, 7 aa, Artificial Sequence
  Synthetic Construct
NLRIEPM

SEQ ID NO: 13141 - protein, 7 aa, Artificial Sequence
  Synthetic Construct
PTESLRV

SEQ ID NO: 13142 - protein, 7 aa, Artificial Sequence
  Synthetic Construct
TNRGLAL

SEQ ID NO: 13143 - protein, 7 aa, Artificial Sequence
  Synthetic Construct
HEKTAYI

SEQ ID NO: 13144 - protein, 7 aa, Artificial Sequence
  Synthetic Construct
NVISKNL

SEQ ID NO: 13145 - protein, 7 aa, Artificial Sequence
  Synthetic Construct
GTAGFSS

SEQ ID NO: 13146 - protein, 7 aa, Artificial Sequence
  Synthetic Construct
IAQMGVK

SEQ ID NO: 13147 - protein, 7 aa, Artificial Sequence
  Synthetic Construct
TSKDVKD

SEQ ID NO: 13148 - protein, 7 aa, Artificial Sequence
  Synthetic Construct
IIGARDI

SEQ ID NO: 13149 - protein, 7 aa, Artificial Sequence
  Synthetic Construct
LRDTGLG

SEQ ID NO: 13150 - protein, 7 aa, Artificial Sequence
  Synthetic Construct
LSNSLGQ

SEQ ID NO: 13151 - protein, 7 aa, Artificial Sequence
  Synthetic Construct
NVLNSRG

SEQ ID NO: 13152 - protein, 7 aa, Artificial Sequence
  Synthetic Construct
FRGSGSP

SEQ ID NO: 13153 - protein, 7 aa, Artificial Sequence
  Synthetic Construct
NPELPRQ

SEQ ID NO: 13154 - protein, 7 aa, Artificial Sequence
  Synthetic Construct
TSSSFKE

SEQ ID NO: 13155 - protein, 7 aa, Artificial Sequence
  Synthetic Construct
NREYMTH

SEQ ID NO: 13156 - protein, 7 aa, Artificial Sequence
  Synthetic Construct
TPGVAHP

SEQ ID NO: 13157 - protein, 7 aa, Artificial Sequence
  Synthetic Construct
TQSSEGP

SEQ ID NO: 13158 - protein, 7 aa, Artificial Sequence
  Synthetic Construct
RGEPIVS

SEQ ID NO: 13159 - protein, 7 aa, Artificial Sequence
  Synthetic Construct
SLTSLNS

SEQ ID NO: 13160 - protein, 7 aa, Artificial Sequence
  Synthetic Construct
TVLHTRQ

SEQ ID NO: 13161 - protein, 7 aa, Artificial Sequence
  Synthetic Construct
LSKSGAD

SEQ ID NO: 13162 - protein, 7 aa, Artificial Sequence
  Synthetic Construct
ANGNQSL

SEQ ID NO: 13163 - protein, 7 aa, Artificial Sequence
  Synthetic Construct
FVTSSSG

SEQ ID NO: 13164 - protein, 7 aa, Artificial Sequence
  Synthetic Construct
GANNHTR

SEQ ID NO: 13165 - protein, 7 aa, Artificial Sequence
  Synthetic Construct
HASDVNN

SEQ ID NO: 13166 - protein, 7 aa, Artificial Sequence
  Synthetic Construct
GHHTSDP

SEQ ID NO: 13167 - protein, 7 aa, Artificial Sequence
  Synthetic Construct
DKNPGVH

SEQ ID NO: 13168 - protein, 7 aa, Artificial Sequence
  Synthetic Construct
SRNSHIE

SEQ ID NO: 13169 - protein, 7 aa, Artificial Sequence
  Synthetic Construct
QASSDHV

SEQ ID NO: 13170 - protein, 7 aa, Artificial Sequence
  Synthetic Construct
LRDTPYN

SEQ ID NO: 13171 - protein, 7 aa, Artificial Sequence
  Synthetic Construct
SLAATRD

SEQ ID NO: 13172 - protein, 7 aa, Artificial Sequence
  Synthetic Construct
GHVNNAV

SEQ ID NO: 13173 - protein, 7 aa, Artificial Sequence
  Synthetic Construct
IGGLTTR

SEQ ID NO: 13174 - protein, 7 aa, Artificial Sequence
  Synthetic Construct
SKERNGQ

SEQ ID NO: 13175 - protein, 7 aa, Artificial Sequence
  Synthetic Construct
LNSGSSA

SEQ ID NO: 13176 - protein, 7 aa, Artificial Sequence
  Synthetic Construct
TMSTTYE

SEQ ID NO: 13177 - protein, 7 aa, Artificial Sequence
  Synthetic Construct
GADNRIS

SEQ ID NO: 13178 - protein, 7 aa, Artificial Sequence
  Synthetic Construct
TQNNGDV

SEQ ID NO: 13179 - protein, 7 aa, Artificial Sequence
  Synthetic Construct
NGPSVLS

SEQ ID NO: 13180 - protein, 7 aa, Artificial Sequence
  Synthetic Construct
TALRDVG

SEQ ID NO: 13181 - protein, 7 aa, Artificial Sequence
  Synthetic Construct
RTMGTTM

SEQ ID NO: 13182 - protein, 7 aa, Artificial Sequence
  Synthetic Construct
TRGTTVE

SEQ ID NO: 13183 - protein, 7 aa, Artificial Sequence
  Synthetic Construct
TVSRVQV

SEQ ID NO: 13184 - protein, 7 aa, Artificial Sequence
  Synthetic Construct
RLDTSAD

SEQ ID NO: 13185 - protein, 7 aa, Artificial Sequence
  Synthetic Construct
LMTKGLV

SEQ ID NO: 13186 - protein, 7 aa, Artificial Sequence
  Synthetic Construct
PMRMQTA

SEQ ID NO: 13187 - protein, 7 aa, Artificial Sequence
  Synthetic Construct
VVLGSTS

SEQ ID NO: 13188 - protein, 7 aa, Artificial Sequence
  Synthetic Construct
SNNGNGH

SEQ ID NO: 13189 - protein, 7 aa, Artificial Sequence
  Synthetic Construct
RGPDLLN

SEQ ID NO: 13190 - protein, 7 aa, Artificial Sequence
  Synthetic Construct
GFNSMKP

SEQ ID NO: 13191 - protein, 7 aa, Artificial Sequence
  Synthetic Construct
LNSNPMN

SEQ ID NO: 13192 - protein, 7 aa, Artificial Sequence
  Synthetic Construct
LSNRVQS

SEQ ID NO: 13193 - protein, 7 aa, Artificial Sequence
  Synthetic Construct
SRMEGTV

SEQ ID NO: 13194 - protein, 7 aa, Artificial Sequence
  Synthetic Construct
SEQYVRV

SEQ ID NO: 13195 - protein, 7 aa, Artificial Sequence
  Synthetic Construct
SNLANQP

SEQ ID NO: 13196 - protein, 7 aa, Artificial Sequence
  Synthetic Construct
VSMQRPT

SEQ ID NO: 13197 - protein, 7 aa, Artificial Sequence
  Synthetic Construct
FHGQGMS

SEQ ID NO: 13198 - protein, 7 aa, Artificial Sequence
  Synthetic Construct
TGAINAP

SEQ ID NO: 13199 - protein, 7 aa, Artificial Sequence
  Synthetic Construct
TLFKNGP

SEQ ID NO: 13200 - protein, 7 aa, Artificial Sequence
  Synthetic Construct
VVPISTN

SEQ ID NO: 13201 - protein, 7 aa, Artificial Sequence
  Synthetic Construct
AKGTALV

SEQ ID NO: 13202 - protein, 7 aa, Artificial Sequence
  Synthetic Construct
RDTVQVY

SEQ ID NO: 13203 - protein, 7 aa, Artificial Sequence
  Synthetic Construct
LGTKATH

SEQ ID NO: 13204 - protein, 7 aa, Artificial Sequence
  Synthetic Construct
DNVRVTA

SEQ ID NO: 13205 - protein, 7 aa, Artificial Sequence
  Synthetic Construct
TRPGSHT

SEQ ID NO: 13206 - protein, 7 aa, Artificial Sequence
  Synthetic Construct
AQLAPRA

SEQ ID NO: 13207 - protein, 7 aa, Artificial Sequence
  Synthetic Construct
STMRTSL

SEQ ID NO: 13208 - protein, 7 aa, Artificial Sequence
  Synthetic Construct
MNQTSAK

SEQ ID NO: 13209 - protein, 7 aa, Artificial Sequence
  Synthetic Construct
SRSSPTI

SEQ ID NO: 13210 - protein, 7 aa, Artificial Sequence
  Synthetic Construct
SALNQYP

SEQ ID NO: 13211 - protein, 7 aa, Artificial Sequence
  Synthetic Construct
ISTTTRN

SEQ ID NO: 13212 - protein, 7 aa, Artificial Sequence
  Synthetic Construct
SRDTPSG

SEQ ID NO: 13213 - protein, 7 aa, Artificial Sequence
  Synthetic Construct
NFNKQGL

SEQ ID NO: 13214 - protein, 7 aa, Artificial Sequence
  Synthetic Construct
PSNTSSV

SEQ ID NO: 13215 - protein, 7 aa, Artificial Sequence
  Synthetic Construct
TVSTNAR

SEQ ID NO: 13216 - protein, 7 aa, Artificial Sequence
  Synthetic Construct
NMSQTVA

SEQ ID NO: 13217 - protein, 7 aa, Artificial Sequence
  Synthetic Construct
IGKSSTP

SEQ ID NO: 13218 - protein, 7 aa, Artificial Sequence
  Synthetic Construct
RETETGR

SEQ ID NO: 13219 - protein, 7 aa, Artificial Sequence
  Synthetic Construct
PYTPLTG

SEQ ID NO: 13220 - protein, 7 aa, Artificial Sequence
  Synthetic Construct
AEYNTGV

SEQ ID NO: 13221 - protein, 7 aa, Artificial Sequence
  Synthetic Construct
GRNAETR

SEQ ID NO: 13222 - protein, 7 aa, Artificial Sequence
  Synthetic Construct
TFNHTTD

SEQ ID NO: 13223 - protein, 7 aa, Artificial Sequence
  Synthetic Construct
THLSTLG

SEQ ID NO: 13224 - protein, 7 aa, Artificial Sequence
  Synthetic Construct
LKGISQH

SEQ ID NO: 13225 - protein, 7 aa, Artificial Sequence
  Synthetic Construct
YSSGMTT

SEQ ID NO: 13226 - protein, 7 aa, Artificial Sequence
  Synthetic Construct
TAITMTS

SEQ ID NO: 13227 - protein, 7 aa, Artificial Sequence
  Synthetic Construct
RGNELNT

SEQ ID NO: 13228 - protein, 7 aa, Artificial Sequence
  Synthetic Construct
VVSSQMA

SEQ ID NO: 13229 - protein, 7 aa, Artificial Sequence
  Synthetic Construct
HQHENMV

SEQ ID NO: 13230 - protein, 7 aa, Artificial Sequence
  Synthetic Construct
SFGGVPK

SEQ ID NO: 13231 - protein, 7 aa, Artificial Sequence
  Synthetic Construct
LMRDSKS

SEQ ID NO: 13232 - protein, 7 aa, Artificial Sequence
  Synthetic Construct
MRTNLSM

SEQ ID NO: 13233 - protein, 7 aa, Artificial Sequence
  Synthetic Construct
PNNPVVP

SEQ ID NO: 13234 - protein, 7 aa, Artificial Sequence
  Synthetic Construct
RVSQSMG

SEQ ID NO: 13235 - protein, 7 aa, Artificial Sequence
  Synthetic Construct
AEGPQKT

SEQ ID NO: 13236 - protein, 7 aa, Artificial Sequence
  Synthetic Construct
LNSVVHT

SEQ ID NO: 13237 - protein, 7 aa, Artificial Sequence
  Synthetic Construct
LLTLNSA

SEQ ID NO: 13238 - protein, 7 aa, Artificial Sequence
  Synthetic Construct
TLAPRRD

SEQ ID NO: 13239 - protein, 7 aa, Artificial Sequence
  Synthetic Construct
RVANPAT

SEQ ID NO: 13240 - protein, 7 aa, Artificial Sequence
  Synthetic Construct
LPDPRLQ

SEQ ID NO: 13241 - protein, 7 aa, Artificial Sequence
  Synthetic Construct
KMDVGEA

SEQ ID NO: 13242 - protein, 7 aa, Artificial Sequence
  Synthetic Construct
GPSPMVM

SEQ ID NO: 13243 - protein, 7 aa, Artificial Sequence
  Synthetic Construct
GTNKATA

SEQ ID NO: 13244 - protein, 7 aa, Artificial Sequence
  Synthetic Construct
LSAHGTT

SEQ ID NO: 13245 - protein, 7 aa, Artificial Sequence
  Synthetic Construct
TSRYNSA

SEQ ID NO: 13246 - protein, 7 aa, Artificial Sequence
  Synthetic Construct
GPNSSFK

SEQ ID NO: 13247 - protein, 7 aa, Artificial Sequence
  Synthetic Construct
SVGRAPI

SEQ ID NO: 13248 - protein, 7 aa, Artificial Sequence
  Synthetic Construct
FQGEKTW

SEQ ID NO: 13249 - protein, 7 aa, Artificial Sequence
  Synthetic Construct
TSSARTI

SEQ ID NO: 13250 - protein, 7 aa, Artificial Sequence
  Synthetic Construct
AERTGTA

SEQ ID NO: 13251 - protein, 7 aa, Artificial Sequence
  Synthetic Construct
LNLGTPK

SEQ ID NO: 13252 - protein, 7 aa, Artificial Sequence
  Synthetic Construct
AAPVGSR

SEQ ID NO: 13253 - protein, 7 aa, Artificial Sequence
  Synthetic Construct
MRQANHP

SEQ ID NO: 13254 - protein, 7 aa, Artificial Sequence
  Synthetic Construct
EQQRDVL

SEQ ID NO: 13255 - protein, 7 aa, Artificial Sequence
  Synthetic Construct
PKSDELT

SEQ ID NO: 13256 - protein, 7 aa, Artificial Sequence
  Synthetic Construct
NARVQET

SEQ ID NO: 13257 - protein, 7 aa, Artificial Sequence
  Synthetic Construct
TTVATQS

SEQ ID NO: 13258 - protein, 7 aa, Artificial Sequence
  Synthetic Construct
TEVSHRP

SEQ ID NO: 13259 - protein, 7 aa, Artificial Sequence
  Synthetic Construct
SSTVKNV

SEQ ID NO: 13260 - protein, 7 aa, Artificial Sequence
  Synthetic Construct
IDSHLNR

SEQ ID NO: 13261 - protein, 7 aa, Artificial Sequence
  Synthetic Construct
GSTQLSL

SEQ ID NO: 13262 - protein, 7 aa, Artificial Sequence
  Synthetic Construct
DGSPATK

SEQ ID NO: 13263 - protein, 7 aa, Artificial Sequence
  Synthetic Construct
QTGNSQA

SEQ ID NO: 13264 - protein, 7 aa, Artificial Sequence
  Synthetic Construct
RQDVNVS

SEQ ID NO: 13265 - protein, 7 aa, Artificial Sequence
  Synthetic Construct
LDYGVKS

SEQ ID NO: 13266 - protein, 7 aa, Artificial Sequence
  Synthetic Construct
GSRPEAP

SEQ ID NO: 13267 - protein, 7 aa, Artificial Sequence
  Synthetic Construct
WSNMTAA

SEQ ID NO: 13268 - protein, 7 aa, Artificial Sequence
  Synthetic Construct
TNTTRIS

SEQ ID NO: 13269 - protein, 7 aa, Artificial Sequence
  Synthetic Construct
PYAERQA

SEQ ID NO: 13270 - protein, 7 aa, Artificial Sequence
  Synthetic Construct
TSSATVL

SEQ ID NO: 13271 - protein, 7 aa, Artificial Sequence
  Synthetic Construct
AQTDFRQ

SEQ ID NO: 13272 - protein, 7 aa, Artificial Sequence
  Synthetic Construct
NSGNEHS

SEQ ID NO: 13273 - protein, 7 aa, Artificial Sequence
  Synthetic Construct
KPLINAT

SEQ ID NO: 13274 - protein, 7 aa, Artificial Sequence
  Synthetic Construct
MGSSSAF

SEQ ID NO: 13275 - protein, 7 aa, Artificial Sequence
  Synthetic Construct
IGNKTSL

SEQ ID NO: 13276 - protein, 7 aa, Artificial Sequence
  Synthetic Construct
AANTAPK

SEQ ID NO: 13277 - protein, 7 aa, Artificial Sequence
  Synthetic Construct
LVDQRAT

SEQ ID NO: 13278 - protein, 7 aa, Artificial Sequence
  Synthetic Construct
QVKLGST

SEQ ID NO: 13279 - protein, 7 aa, Artificial Sequence
  Synthetic Construct
LTSNTHV

SEQ ID NO: 13280 - protein, 7 aa, Artificial Sequence
  Synthetic Construct
VYSAINK

SEQ ID NO: 13281 - protein, 7 aa, Artificial Sequence
  Synthetic Construct
RANGSDL

SEQ ID NO: 13282 - protein, 7 aa, Artificial Sequence
  Synthetic Construct
NLKSQTE

SEQ ID NO: 13283 - protein, 7 aa, Artificial Sequence
  Synthetic Construct
SYGNEIR

SEQ ID NO: 13284 - protein, 7 aa, Artificial Sequence
  Synthetic Construct
LTRGAIG

SEQ ID NO: 13285 - protein, 7 aa, Artificial Sequence
  Synthetic Construct
PIRTVDT

SEQ ID NO: 13286 - protein, 7 aa, Artificial Sequence
  Synthetic Construct
RSMPDGS

SEQ ID NO: 13287 - protein, 7 aa, Artificial Sequence
  Synthetic Construct
TAHTGPL

SEQ ID NO: 13288 - protein, 7 aa, Artificial Sequence
  Synthetic Construct
SQGSPLS

SEQ ID NO: 13289 - protein, 7 aa, Artificial Sequence
  Synthetic Construct
LQAIAHS

SEQ ID NO: 13290 - protein, 7 aa, Artificial Sequence
  Synthetic Construct
GNSLSTS

SEQ ID NO: 13291 - protein, 7 aa, Artificial Sequence
  Synthetic Construct
LTHREAE

SEQ ID NO: 13292 - protein, 7 aa, Artificial Sequence
  Synthetic Construct
TLHLAKE

SEQ ID NO: 13293 - protein, 7 aa, Artificial Sequence
  Synthetic Construct
NISSSGK

SEQ ID NO: 13294 - protein, 7 aa, Artificial Sequence
  Synthetic Construct
GRHMVME

SEQ ID NO: 13295 - protein, 7 aa, Artificial Sequence
  Synthetic Construct
GERFGGP

SEQ ID NO: 13296 - protein, 7 aa, Artificial Sequence
  Synthetic Construct
YSGSSTK

SEQ ID NO: 13297 - protein, 7 aa, Artificial Sequence
  Synthetic Construct
KESVSAN

SEQ ID NO: 13298 - protein, 7 aa, Artificial Sequence
  Synthetic Construct
ITSDGKP

SEQ ID NO: 13299 - protein, 7 aa, Artificial Sequence
  Synthetic Construct
GHDARVV

SEQ ID NO: 13300 - protein, 7 aa, Artificial Sequence
  Synthetic Construct
TSSNGVR

SEQ ID NO: 13301 - protein, 7 aa, Artificial Sequence
  Synthetic Construct
NHQNRSL

SEQ ID NO: 13302 - protein, 7 aa, Artificial Sequence
  Synthetic Construct
RVPEQNV

SEQ ID NO: 13303 - protein, 7 aa, Artificial Sequence
  Synthetic Construct
SAQLRSS

SEQ ID NO: 13304 - protein, 7 aa, Artificial Sequence
  Synthetic Construct
HAKSETY

SEQ ID NO: 13305 - protein, 7 aa, Artificial Sequence
  Synthetic Construct
LLTQVET

SEQ ID NO: 13306 - protein, 7 aa, Artificial Sequence
  Synthetic Construct
TKTADTY

SEQ ID NO: 13307 - protein, 7 aa, Artificial Sequence
  Synthetic Construct
VMPATLS

SEQ ID NO: 13308 - protein, 7 aa, Artificial Sequence
  Synthetic Construct
YQANNLI

SEQ ID NO: 13309 - protein, 7 aa, Artificial Sequence
  Synthetic Construct
VRVPDSS

SEQ ID NO: 13310 - protein, 7 aa, Artificial Sequence
  Synthetic Construct
HQTGSGF

SEQ ID NO: 13311 - protein, 7 aa, Artificial Sequence
  Synthetic Construct
SATLSGY

SEQ ID NO: 13312 - protein, 7 aa, Artificial Sequence
  Synthetic Construct
NGSATYS

SEQ ID NO: 13313 - protein, 7 aa, Artificial Sequence
  Synthetic Construct
STRPTLT

SEQ ID NO: 13314 - protein, 7 aa, Artificial Sequence
  Synthetic Construct
RPADVSQ

SEQ ID NO: 13315 - protein, 7 aa, Artificial Sequence
  Synthetic Construct
SHLSSTG

SEQ ID NO: 13316 - protein, 7 aa, Artificial Sequence
  Synthetic Construct
ANQSYDR

SEQ ID NO: 13317 - protein, 7 aa, Artificial Sequence
  Synthetic Construct
SSGDRTA

SEQ ID NO: 13318 - protein, 7 aa, Artificial Sequence
  Synthetic Construct
GSVPGLN

SEQ ID NO: 13319 - protein, 7 aa, Artificial Sequence
  Synthetic Construct
LVTIHSA

SEQ ID NO: 13320 - protein, 7 aa, Artificial Sequence
  Synthetic Construct
PQHETTL

SEQ ID NO: 13321 - protein, 7 aa, Artificial Sequence
  Synthetic Construct
PTKSAQY

SEQ ID NO: 13322 - protein, 7 aa, Artificial Sequence
  Synthetic Construct
KKDPVLG

SEQ ID NO: 13323 - protein, 7 aa, Artificial Sequence
  Synthetic Construct
FRVGPSA

SEQ ID NO: 13324 - protein, 7 aa, Artificial Sequence
  Synthetic Construct
TSSGHAV

SEQ ID NO: 13325 - protein, 7 aa, Artificial Sequence
  Synthetic Construct
RVGEARM

SEQ ID NO: 13326 - protein, 7 aa, Artificial Sequence
  Synthetic Construct
RVTSPSK

SEQ ID NO: 13327 - protein, 7 aa, Artificial Sequence
  Synthetic Construct
DRMPSTI

SEQ ID NO: 13328 - protein, 7 aa, Artificial Sequence
  Synthetic Construct
QGDTSKH

SEQ ID NO: 13329 - protein, 7 aa, Artificial Sequence
  Synthetic Construct
STSSNRA

SEQ ID NO: 13330 - protein, 7 aa, Artificial Sequence
  Synthetic Construct
KVPTGYT

SEQ ID NO: 13331 - protein, 7 aa, Artificial Sequence
  Synthetic Construct
FKGQRND

SEQ ID NO: 13332 - protein, 7 aa, Artificial Sequence
  Synthetic Construct
GNHLGNE

SEQ ID NO: 13333 - protein, 7 aa, Artificial Sequence
  Synthetic Construct
ASKSFEL

SEQ ID NO: 13334 - protein, 7 aa, Artificial Sequence
  Synthetic Construct
TVRDTTR

SEQ ID NO: 13335 - protein, 7 aa, Artificial Sequence
  Synthetic Construct
KVSPNTL

SEQ ID NO: 13336 - protein, 7 aa, Artificial Sequence
  Synthetic Construct
GRTPESY

SEQ ID NO: 13337 - protein, 7 aa, Artificial Sequence
  Synthetic Construct
QVSGVRT

SEQ ID NO: 13338 - protein, 7 aa, Artificial Sequence
  Synthetic Construct
YTGISTS

SEQ ID NO: 13339 - protein, 7 aa, Artificial Sequence
  Synthetic Construct
QTAEPHK

SEQ ID NO: 13340 - protein, 7 aa, Artificial Sequence
  Synthetic Construct
LGPVGSP

SEQ ID NO: 13341 - protein, 7 aa, Artificial Sequence
  Synthetic Construct
ARDDSTD

SEQ ID NO: 13342 - protein, 7 aa, Artificial Sequence
  Synthetic Construct
NFKHSEV

SEQ ID NO: 13343 - protein, 7 aa, Artificial Sequence
  Synthetic Construct
ITTPLQA

SEQ ID NO: 13344 - protein, 7 aa, Artificial Sequence
  Synthetic Construct
PMSSRER

SEQ ID NO: 13345 - protein, 7 aa, Artificial Sequence
  Synthetic Construct
VENGKGL

SEQ ID NO: 13346 - protein, 7 aa, Artificial Sequence
  Synthetic Construct
TSNSGLA

SEQ ID NO: 13347 - protein, 7 aa, Artificial Sequence
  Synthetic Construct
GNSLANP

SEQ ID NO: 13348 - protein, 7 aa, Artificial Sequence
  Synthetic Construct
ASNEAHA

SEQ ID NO: 13349 - protein, 7 aa, Artificial Sequence
  Synthetic Construct
GLAGSTP

SEQ ID NO: 13350 - protein, 7 aa, Artificial Sequence
  Synthetic Construct
VPAPGRY

SEQ ID NO: 13351 - protein, 7 aa, Artificial Sequence
  Synthetic Construct
ASDRLIA

SEQ ID NO: 13352 - protein, 7 aa, Artificial Sequence
  Synthetic Construct
ISTWQTQ

SEQ ID NO: 13353 - protein, 7 aa, Artificial Sequence
  Synthetic Construct
ITSGATV

SEQ ID NO: 13354 - protein, 7 aa, Artificial Sequence
  Synthetic Construct
LAKASNV

SEQ ID NO: 13355 - protein, 7 aa, Artificial Sequence
  Synthetic Construct
PQGTFGS

SEQ ID NO: 13356 - protein, 7 aa, Artificial Sequence
  Synthetic Construct
IVRPPNS

SEQ ID NO: 13357 - protein, 7 aa, Artificial Sequence
  Synthetic Construct
TSHLTSA

SEQ ID NO: 13358 - protein, 7 aa, Artificial Sequence
  Synthetic Construct
LHPETMR

SEQ ID NO: 13359 - protein, 7 aa, Artificial Sequence
  Synthetic Construct
VLHDTRY

SEQ ID NO: 13360 - protein, 7 aa, Artificial Sequence
  Synthetic Construct
VSNPPRG

SEQ ID NO: 13361 - protein, 7 aa, Artificial Sequence
  Synthetic Construct
EPLMTRP

SEQ ID NO: 13362 - protein, 7 aa, Artificial Sequence
  Synthetic Construct
DRVSSSH

SEQ ID NO: 13363 - protein, 7 aa, Artificial Sequence
  Synthetic Construct
TKTGHSS

SEQ ID NO: 13364 - protein, 7 aa, Artificial Sequence
  Synthetic Construct
SSYSPVT

SEQ ID NO: 13365 - protein, 7 aa, Artificial Sequence
  Synthetic Construct
KPNLQNN

SEQ ID NO: 13366 - protein, 7 aa, Artificial Sequence
  Synthetic Construct
LKSPPGI

SEQ ID NO: 13367 - protein, 7 aa, Artificial Sequence
  Synthetic Construct
GMQLGMP

SEQ ID NO: 13368 - protein, 7 aa, Artificial Sequence
  Synthetic Construct
HQANLTL

SEQ ID NO: 13369 - protein, 7 aa, Artificial Sequence
  Synthetic Construct
TGHPTTA

SEQ ID NO: 13370 - protein, 7 aa, Artificial Sequence
  Synthetic Construct
FIGSHLG

SEQ ID NO: 13371 - protein, 7 aa, Artificial Sequence
  Synthetic Construct
RNESNGP

SEQ ID NO: 13372 - protein, 7 aa, Artificial Sequence
  Synthetic Construct
KIETNGN

SEQ ID NO: 13373 - protein, 7 aa, Artificial Sequence
  Synthetic Construct
YLQNGVV

SEQ ID NO: 13374 - protein, 7 aa, Artificial Sequence
  Synthetic Construct
RPGMLGT

SEQ ID NO: 13375 - protein, 7 aa, Artificial Sequence
  Synthetic Construct
LTQIGTA

SEQ ID NO: 13376 - protein, 7 aa, Artificial Sequence
  Synthetic Construct
NEDVQRA

SEQ ID NO: 13377 - protein, 7 aa, Artificial Sequence
  Synthetic Construct
HLADQSR

SEQ ID NO: 13378 - protein, 7 aa, Artificial Sequence
  Synthetic Construct
LGNDTVR

SEQ ID NO: 13379 - protein, 7 aa, Artificial Sequence
  Synthetic Construct
NNHHVPP

SEQ ID NO: 13380 - protein, 7 aa, Artificial Sequence
  Synthetic Construct
DKAGTLS

SEQ ID NO: 13381 - protein, 7 aa, Artificial Sequence
  Synthetic Construct
RTKNESM

SEQ ID NO: 13382 - protein, 7 aa, Artificial Sequence
  Synthetic Construct
FNVVRGD

SEQ ID NO: 13383 - protein, 7 aa, Artificial Sequence
  Synthetic Construct
IVRGMNQ

SEQ ID NO: 13384 - protein, 7 aa, Artificial Sequence
  Synthetic Construct
QHTPTLN

SEQ ID NO: 13385 - protein, 7 aa, Artificial Sequence
  Synthetic Construct
SLGKEPL

SEQ ID NO: 13386 - protein, 7 aa, Artificial Sequence
  Synthetic Construct
SSGHGLN

SEQ ID NO: 13387 - protein, 7 aa, Artificial Sequence
  Synthetic Construct
RINSDST

SEQ ID NO: 13388 - protein, 7 aa, Artificial Sequence
  Synthetic Construct
NPHNHPV

SEQ ID NO: 13389 - protein, 7 aa, Artificial Sequence
  Synthetic Construct
SHKPSTV

SEQ ID NO: 13390 - protein, 7 aa, Artificial Sequence
  Synthetic Construct
SSMSTTY

SEQ ID NO: 13391 - protein, 7 aa, Artificial Sequence
  Synthetic Construct
GAAASNP

SEQ ID NO: 13392 - protein, 7 aa, Artificial Sequence
  Synthetic Construct
MNQREQK

SEQ ID NO: 13393 - protein, 7 aa, Artificial Sequence
  Synthetic Construct
SYPSNPR

SEQ ID NO: 13394 - protein, 7 aa, Artificial Sequence
  Synthetic Construct
LRDFVTD

SEQ ID NO: 13395 - protein, 7 aa, Artificial Sequence
  Synthetic Construct
NNTVMRS

SEQ ID NO: 13396 - protein, 7 aa, Artificial Sequence
  Synthetic Construct
LSPRKYI

SEQ ID NO: 13397 - protein, 7 aa, Artificial Sequence
  Synthetic Construct
HIRPPSP

SEQ ID NO: 13398 - protein, 7 aa, Artificial Sequence
  Synthetic Construct
PYVSTTA

SEQ ID NO: 13399 - protein, 7 aa, Artificial Sequence
  Synthetic Construct
VNHGSPT

SEQ ID NO: 13400 - protein, 7 aa, Artificial Sequence
  Synthetic Construct
SGYLNGA

SEQ ID NO: 13401 - protein, 7 aa, Artificial Sequence
  Synthetic Construct
SRERTSD

SEQ ID NO: 13402 - protein, 7 aa, Artificial Sequence
  Synthetic Construct
THSVTRS

SEQ ID NO: 13403 - protein, 7 aa, Artificial Sequence
  Synthetic Construct
LVANKNA

SEQ ID NO: 13404 - protein, 7 aa, Artificial Sequence
  Synthetic Construct
NFTDRAT

SEQ ID NO: 13405 - protein, 7 aa, Artificial Sequence
  Synthetic Construct
YRTSTLA

SEQ ID NO: 13406 - protein, 7 aa, Artificial Sequence
  Synthetic Construct
HVMNKQA

SEQ ID NO: 13407 - protein, 7 aa, Artificial Sequence
  Synthetic Construct
ATNNPAS

SEQ ID NO: 13408 - protein, 7 aa, Artificial Sequence
  Synthetic Construct
TIMKAQT

SEQ ID NO: 13409 - protein, 7 aa, Artificial Sequence
  Synthetic Construct
GMSTMTP

SEQ ID NO: 13410 - protein, 7 aa, Artificial Sequence
  Synthetic Construct
GTPIYKQ

SEQ ID NO: 13411 - protein, 7 aa, Artificial Sequence
  Synthetic Construct
NGTLEKA

SEQ ID NO: 13412 - protein, 7 aa, Artificial Sequence
  Synthetic Construct
SNERTIP

SEQ ID NO: 13413 - protein, 7 aa, Artificial Sequence
  Synthetic Construct
IPVSIQA

SEQ ID NO: 13414 - protein, 7 aa, Artificial Sequence
  Synthetic Construct
NLQREGP

SEQ ID NO: 13415 - protein, 7 aa, Artificial Sequence
  Synthetic Construct
GEGGKSN

SEQ ID NO: 13416 - protein, 7 aa, Artificial Sequence
  Synthetic Construct
LQGNGRN

SEQ ID NO: 13417 - protein, 7 aa, Artificial Sequence
  Synthetic Construct
LVSSTSE

SEQ ID NO: 13418 - protein, 7 aa, Artificial Sequence
  Synthetic Construct
SLAGNTT

SEQ ID NO: 13419 - protein, 7 aa, Artificial Sequence
  Synthetic Construct
LTVGNNV

SEQ ID NO: 13420 - protein, 7 aa, Artificial Sequence
  Synthetic Construct
SILTRDS

SEQ ID NO: 13421 - protein, 7 aa, Artificial Sequence
  Synthetic Construct
VLVDSRA

SEQ ID NO: 13422 - protein, 7 aa, Artificial Sequence
  Synthetic Construct
GVASTTT

SEQ ID NO: 13423 - protein, 7 aa, Artificial Sequence
  Synthetic Construct
HGANLSV

SEQ ID NO: 13424 - protein, 7 aa, Artificial Sequence
  Synthetic Construct
SFNQPSV

SEQ ID NO: 13425 - protein, 7 aa, Artificial Sequence
  Synthetic Construct
LNQNQRV

SEQ ID NO: 13426 - protein, 7 aa, Artificial Sequence
  Synthetic Construct
RIDSQDT

SEQ ID NO: 13427 - protein, 7 aa, Artificial Sequence
  Synthetic Construct
TVPGRPS

SEQ ID NO: 13428 - protein, 7 aa, Artificial Sequence
  Synthetic Construct
REPNNTS

SEQ ID NO: 13429 - protein, 7 aa, Artificial Sequence
  Synthetic Construct
ERMTMHA

SEQ ID NO: 13430 - protein, 7 aa, Artificial Sequence
  Synthetic Construct
IAIQNDR

SEQ ID NO: 13431 - protein, 7 aa, Artificial Sequence
  Synthetic Construct
LGAQSIS

SEQ ID NO: 13432 - protein, 7 aa, Artificial Sequence
  Synthetic Construct
AGDKTYV

SEQ ID NO: 13433 - protein, 7 aa, Artificial Sequence
  Synthetic Construct
MNRTAYT

SEQ ID NO: 13434 - protein, 7 aa, Artificial Sequence
  Synthetic Construct
ALPGGLM

SEQ ID NO: 13435 - protein, 7 aa, Artificial Sequence
  Synthetic Construct
LKNHDTT

SEQ ID NO: 13436 - protein, 7 aa, Artificial Sequence
  Synthetic Construct
PLNYALE

SEQ ID NO: 13437 - protein, 7 aa, Artificial Sequence
  Synthetic Construct
SKQMHND

SEQ ID NO: 13438 - protein, 7 aa, Artificial Sequence
  Synthetic Construct
TAHTTPF

SEQ ID NO: 13439 - protein, 7 aa, Artificial Sequence
  Synthetic Construct
LKTGDSQ

SEQ ID NO: 13440 - protein, 7 aa, Artificial Sequence
  Synthetic Construct
YSTTAEY

SEQ ID NO: 13441 - protein, 7 aa, Artificial Sequence
  Synthetic Construct
PLDRTGE

SEQ ID NO: 13442 - protein, 7 aa, Artificial Sequence
  Synthetic Construct
GPGEVKI

SEQ ID NO: 13443 - protein, 7 aa, Artificial Sequence
  Synthetic Construct
LRNLDLN

SEQ ID NO: 13444 - protein, 7 aa, Artificial Sequence
  Synthetic Construct
LGSTLTK

SEQ ID NO: 13445 - protein, 7 aa, Artificial Sequence
  Synthetic Construct
LRPVSEH

SEQ ID NO: 13446 - protein, 7 aa, Artificial Sequence
  Synthetic Construct
SRSLTEM

SEQ ID NO: 13447 - protein, 7 aa, Artificial Sequence
  Synthetic Construct
NGLSTTM

SEQ ID NO: 13448 - protein, 7 aa, Artificial Sequence
  Synthetic Construct
HDKTYAM

SEQ ID NO: 13449 - protein, 7 aa, Artificial Sequence
  Synthetic Construct
VPSDKMR

SEQ ID NO: 13450 - protein, 7 aa, Artificial Sequence
  Synthetic Construct
GAHNLLT

SEQ ID NO: 13451 - protein, 7 aa, Artificial Sequence
  Synthetic Construct
STSTMVM

SEQ ID NO: 13452 - protein, 7 aa, Artificial Sequence
  Synthetic Construct
NMAHESK

SEQ ID NO: 13453 - protein, 7 aa, Artificial Sequence
  Synthetic Construct
YLGVGAT

SEQ ID NO: 13454 - protein, 7 aa, Artificial Sequence
  Synthetic Construct
ASEYNQH

SEQ ID NO: 13455 - protein, 7 aa, Artificial Sequence
  Synthetic Construct
RAEGDKI

SEQ ID NO: 13456 - protein, 7 aa, Artificial Sequence
  Synthetic Construct
SSGSSFH

SEQ ID NO: 13457 - protein, 7 aa, Artificial Sequence
  Synthetic Construct
WGKEYTG

SEQ ID NO: 13458 - protein, 7 aa, Artificial Sequence
  Synthetic Construct
PASGAMP

SEQ ID NO: 13459 - protein, 7 aa, Artificial Sequence
  Synthetic Construct
RGAVVVA

SEQ ID NO: 13460 - protein, 7 aa, Artificial Sequence
  Synthetic Construct
VMMQNHA

SEQ ID NO: 13461 - protein, 7 aa, Artificial Sequence
  Synthetic Construct
QDRLQSR

SEQ ID NO: 13462 - protein, 7 aa, Artificial Sequence
  Synthetic Construct
GHAAVSV

SEQ ID NO: 13463 - protein, 7 aa, Artificial Sequence
  Synthetic Construct
DKTDSTP

SEQ ID NO: 13464 - protein, 7 aa, Artificial Sequence
  Synthetic Construct
VPPTSFT

SEQ ID NO: 13465 - protein, 7 aa, Artificial Sequence
  Synthetic Construct
VGPNAQH

SEQ ID NO: 13466 - protein, 7 aa, Artificial Sequence
  Synthetic Construct
HHGRADT

SEQ ID NO: 13467 - protein, 7 aa, Artificial Sequence
  Synthetic Construct
HVNMGPA

SEQ ID NO: 13468 - protein, 7 aa, Artificial Sequence
  Synthetic Construct
HATKETS

SEQ ID NO: 13469 - protein, 7 aa, Artificial Sequence
  Synthetic Construct
LATGVSN

SEQ ID NO: 13470 - protein, 7 aa, Artificial Sequence
  Synthetic Construct
SLGSYPT

SEQ ID NO: 13471 - protein, 7 aa, Artificial Sequence
  Synthetic Construct
GSKAYVG

SEQ ID NO: 13472 - protein, 7 aa, Artificial Sequence
  Synthetic Construct
QDRMSVN

SEQ ID NO: 13473 - protein, 7 aa, Artificial Sequence
  Synthetic Construct
WSDSLRD

SEQ ID NO: 13474 - protein, 7 aa, Artificial Sequence
  Synthetic Construct
TKVPMTQ

SEQ ID NO: 13475 - protein, 7 aa, Artificial Sequence
  Synthetic Construct
SPLSDRL

SEQ ID NO: 13476 - protein, 7 aa, Artificial Sequence
  Synthetic Construct
LYGSSVV

SEQ ID NO: 13477 - protein, 7 aa, Artificial Sequence
  Synthetic Construct
PTQTVSS

SEQ ID NO: 13478 - protein, 7 aa, Artificial Sequence
  Synthetic Construct
LNKLLGA

SEQ ID NO: 13479 - protein, 7 aa, Artificial Sequence
  Synthetic Construct
HSNQEPR

SEQ ID NO: 13480 - protein, 7 aa, Artificial Sequence
  Synthetic Construct
NGASIHS

SEQ ID NO: 13481 - protein, 7 aa, Artificial Sequence
  Synthetic Construct
LSQQRLQ

SEQ ID NO: 13482 - protein, 7 aa, Artificial Sequence
  Synthetic Construct
LPHGTMN

SEQ ID NO: 13483 - protein, 7 aa, Artificial Sequence
  Synthetic Construct
SSPDAKY

SEQ ID NO: 13484 - protein, 7 aa, Artificial Sequence
  Synthetic Construct
FHTPAGN

SEQ ID NO: 13485 - protein, 7 aa, Artificial Sequence
  Synthetic Construct
RTTANSL

SEQ ID NO: 13486 - protein, 7 aa, Artificial Sequence
  Synthetic Construct
LDKTIPQ

SEQ ID NO: 13487 - protein, 7 aa, Artificial Sequence
  Synthetic Construct
WQGNRQA

SEQ ID NO: 13488 - protein, 7 aa, Artificial Sequence
  Synthetic Construct
GYGTITP

SEQ ID NO: 13489 - protein, 7 aa, Artificial Sequence
  Synthetic Construct
MREQNKA

SEQ ID NO: 13490 - protein, 7 aa, Artificial Sequence
  Synthetic Construct
NLAGLTG

SEQ ID NO: 13491 - protein, 7 aa, Artificial Sequence
  Synthetic Construct
WFKAGSA

SEQ ID NO: 13492 - protein, 7 aa, Artificial Sequence
  Synthetic Construct
INVAPYK

SEQ ID NO: 13493 - protein, 7 aa, Artificial Sequence
  Synthetic Construct
GVHSNGQ

SEQ ID NO: 13494 - protein, 7 aa, Artificial Sequence
  Synthetic Construct
MSASTNT

SEQ ID NO: 13495 - protein, 7 aa, Artificial Sequence
  Synthetic Construct
GSHNAQG

SEQ ID NO: 13496 - protein, 7 aa, Artificial Sequence
  Synthetic Construct
ISAVPKN

SEQ ID NO: 13497 - protein, 7 aa, Artificial Sequence
  Synthetic Construct
AGGGMQN

SEQ ID NO: 13498 - protein, 7 aa, Artificial Sequence
  Synthetic Construct
LLNTTST

SEQ ID NO: 13499 - protein, 7 aa, Artificial Sequence
  Synthetic Construct
TNTVSAS

SEQ ID NO: 13500 - protein, 7 aa, Artificial Sequence
  Synthetic Construct
QLSPIAM

SEQ ID NO: 13501 - protein, 7 aa, Artificial Sequence
  Synthetic Construct
APRGVNL

SEQ ID NO: 13502 - protein, 7 aa, Artificial Sequence
  Synthetic Construct
LTRTSVD

SEQ ID NO: 13503 - protein, 7 aa, Artificial Sequence
  Synthetic Construct
LGQKAPT

SEQ ID NO: 13504 - protein, 7 aa, Artificial Sequence
  Synthetic Construct
KNAPPLT

SEQ ID NO: 13505 - protein, 7 aa, Artificial Sequence
  Synthetic Construct
VRNAVHA

SEQ ID NO: 13506 - protein, 7 aa, Artificial Sequence
  Synthetic Construct
IRHMDAP

SEQ ID NO: 13507 - protein, 7 aa, Artificial Sequence
  Synthetic Construct
GAPLVAT

SEQ ID NO: 13508 - protein, 7 aa, Artificial Sequence
  Synthetic Construct
SDHNARG

SEQ ID NO: 13509 - protein, 7 aa, Artificial Sequence
  Synthetic Construct
ISDTLHY

SEQ ID NO: 13510 - protein, 7 aa, Artificial Sequence
  Synthetic Construct
NNRGSIS

SEQ ID NO: 13511 - protein, 7 aa, Artificial Sequence
  Synthetic Construct
QRERDGV

SEQ ID NO: 13512 - protein, 7 aa, Artificial Sequence
  Synthetic Construct
SKQDVRA

SEQ ID NO: 13513 - protein, 7 aa, Artificial Sequence
  Synthetic Construct
NSGRLNV

SEQ ID NO: 13514 - protein, 7 aa, Artificial Sequence
  Synthetic Construct
GPSVESN

SEQ ID NO: 13515 - protein, 7 aa, Artificial Sequence
  Synthetic Construct
LLSSSPS

SEQ ID NO: 13516 - protein, 7 aa, Artificial Sequence
  Synthetic Construct
KVLVSGS

SEQ ID NO: 13517 - protein, 7 aa, Artificial Sequence
  Synthetic Construct
DVRNTIA

SEQ ID NO: 13518 - protein, 7 aa, Artificial Sequence
  Synthetic Construct
HKLVTKD

SEQ ID NO: 13519 - protein, 7 aa, Artificial Sequence
  Synthetic Construct
PYVSGVP

SEQ ID NO: 13520 - protein, 7 aa, Artificial Sequence
  Synthetic Construct
TTKASFT

SEQ ID NO: 13521 - protein, 7 aa, Artificial Sequence
  Synthetic Construct
TPHGPDA

SEQ ID NO: 13522 - protein, 7 aa, Artificial Sequence
  Synthetic Construct
DYRQTDH

SEQ ID NO: 13523 - protein, 7 aa, Artificial Sequence
  Synthetic Construct
HSPKPDH

SEQ ID NO: 13524 - protein, 7 aa, Artificial Sequence
  Synthetic Construct
AYGQVPP

SEQ ID NO: 13525 - protein, 7 aa, Artificial Sequence
  Synthetic Construct
SNQGLAG

SEQ ID NO: 13526 - protein, 7 aa, Artificial Sequence
  Synthetic Construct
INSPIGN

SEQ ID NO: 13527 - protein, 7 aa, Artificial Sequence
  Synthetic Construct
QNQIMSG

SEQ ID NO: 13528 - protein, 7 aa, Artificial Sequence
  Synthetic Construct
VYQGNQN

SEQ ID NO: 13529 - protein, 7 aa, Artificial Sequence
  Synthetic Construct
GSNSQHT

SEQ ID NO: 13530 - protein, 7 aa, Artificial Sequence
  Synthetic Construct
KQEPSDR

SEQ ID NO: 13531 - protein, 7 aa, Artificial Sequence
  Synthetic Construct
HRSSPAA

SEQ ID NO: 13532 - protein, 7 aa, Artificial Sequence
  Synthetic Construct
NEGNSMK

SEQ ID NO: 13533 - protein, 7 aa, Artificial Sequence
  Synthetic Construct
RPDKGPM

SEQ ID NO: 13534 - protein, 7 aa, Artificial Sequence
  Synthetic Construct
AIVSHPL

SEQ ID NO: 13535 - protein, 7 aa, Artificial Sequence
  Synthetic Construct
TQGERPV

SEQ ID NO: 13536 - protein, 7 aa, Artificial Sequence
  Synthetic Construct
YVNSAPK

SEQ ID NO: 13537 - protein, 7 aa, Artificial Sequence
  Synthetic Construct
PSGTSIV

SEQ ID NO: 13538 - protein, 7 aa, Artificial Sequence
  Synthetic Construct
SVGANRS

SEQ ID NO: 13539 - protein, 7 aa, Artificial Sequence
  Synthetic Construct
SAHFNHS

SEQ ID NO: 13540 - protein, 7 aa, Artificial Sequence
  Synthetic Construct
KVNSAHL

SEQ ID NO: 13541 - protein, 7 aa, Artificial Sequence
  Synthetic Construct
GFGNMGA

SEQ ID NO: 13542 - protein, 7 aa, Artificial Sequence
  Synthetic Construct
NLKPETD

SEQ ID NO: 13543 - protein, 7 aa, Artificial Sequence
  Synthetic Construct
PNSNTAF

SEQ ID NO: 13544 - protein, 7 aa, Artificial Sequence
  Synthetic Construct
HDTLRTP

SEQ ID NO: 13545 - protein, 7 aa, Artificial Sequence
  Synthetic Construct
RFPQAPP

SEQ ID NO: 13546 - protein, 7 aa, Artificial Sequence
  Synthetic Construct
SSGNKSD

SEQ ID NO: 13547 - protein, 7 aa, Artificial Sequence
  Synthetic Construct
MSKMADR

SEQ ID NO: 13548 - protein, 7 aa, Artificial Sequence
  Synthetic Construct
EHRETSI

SEQ ID NO: 13549 - protein, 7 aa, Artificial Sequence
  Synthetic Construct
STEYPVP

SEQ ID NO: 13550 - protein, 7 aa, Artificial Sequence
  Synthetic Construct
DKSMNPS

SEQ ID NO: 13551 - protein, 7 aa, Artificial Sequence
  Synthetic Construct
EYHNNLK

SEQ ID NO: 13552 - protein, 7 aa, Artificial Sequence
  Synthetic Construct
IFTNTGH

SEQ ID NO: 13553 - protein, 7 aa, Artificial Sequence
  Synthetic Construct
KSNSPLA

SEQ ID NO: 13554 - protein, 7 aa, Artificial Sequence
  Synthetic Construct
YSSGYNA

SEQ ID NO: 13555 - protein, 7 aa, Artificial Sequence
  Synthetic Construct
GSKTQGD

SEQ ID NO: 13556 - protein, 7 aa, Artificial Sequence
  Synthetic Construct
IVSGSSQ

SEQ ID NO: 13557 - protein, 7 aa, Artificial Sequence
  Synthetic Construct
SLINSTY

SEQ ID NO: 13558 - protein, 7 aa, Artificial Sequence
  Synthetic Construct
NMKIQHV

SEQ ID NO: 13559 - protein, 7 aa, Artificial Sequence
  Synthetic Construct
DSTKLGH

SEQ ID NO: 13560 - protein, 7 aa, Artificial Sequence
  Synthetic Construct
QSHGTSS

SEQ ID NO: 13561 - protein, 7 aa, Artificial Sequence
  Synthetic Construct
KDNNRSA

SEQ ID NO: 13562 - protein, 7 aa, Artificial Sequence
  Synthetic Construct
FQPSYAA

SEQ ID NO: 13563 - protein, 7 aa, Artificial Sequence
  Synthetic Construct
PTVQMKA

SEQ ID NO: 13564 - protein, 7 aa, Artificial Sequence
  Synthetic Construct
SPTSSTF

SEQ ID NO: 13565 - protein, 7 aa, Artificial Sequence
  Synthetic Construct
GRDANVP

SEQ ID NO: 13566 - protein, 7 aa, Artificial Sequence
  Synthetic Construct
TLMSTSP

SEQ ID NO: 13567 - protein, 7 aa, Artificial Sequence
  Synthetic Construct
LHGATTT

SEQ ID NO: 13568 - protein, 7 aa, Artificial Sequence
  Synthetic Construct
RTNEVMR

SEQ ID NO: 13569 - protein, 7 aa, Artificial Sequence
  Synthetic Construct
DNLRVTA

SEQ ID NO: 13570 - protein, 7 aa, Artificial Sequence
  Synthetic Construct
RQAGDQL

SEQ ID NO: 13571 - protein, 7 aa, Artificial Sequence
  Synthetic Construct
VGQHLTH

SEQ ID NO: 13572 - protein, 7 aa, Artificial Sequence
  Synthetic Construct
LSAASGI

SEQ ID NO: 13573 - protein, 7 aa, Artificial Sequence
  Synthetic Construct
SSHNGFI

SEQ ID NO: 13574 - protein, 7 aa, Artificial Sequence
  Synthetic Construct
NATRQYS

SEQ ID NO: 13575 - protein, 7 aa, Artificial Sequence
  Synthetic Construct
VSRQSLG

SEQ ID NO: 13576 - protein, 7 aa, Artificial Sequence
  Synthetic Construct
DVVKPHG

SEQ ID NO: 13577 - protein, 7 aa, Artificial Sequence
  Synthetic Construct
GIGGISS

SEQ ID NO: 13578 - protein, 7 aa, Artificial Sequence
  Synthetic Construct
TNNSLRE

SEQ ID NO: 13579 - protein, 7 aa, Artificial Sequence
  Synthetic Construct
TRTASAL

SEQ ID NO: 13580 - protein, 7 aa, Artificial Sequence
  Synthetic Construct
TTTAPSP

SEQ ID NO: 13581 - protein, 7 aa, Artificial Sequence
  Synthetic Construct
NASMSSI

SEQ ID NO: 13582 - protein, 7 aa, Artificial Sequence
  Synthetic Construct
TQPHRGL

SEQ ID NO: 13583 - protein, 7 aa, Artificial Sequence
  Synthetic Construct
RLDHHSS

SEQ ID NO: 13584 - protein, 7 aa, Artificial Sequence
  Synthetic Construct
ENTTRIA

SEQ ID NO: 13585 - protein, 7 aa, Artificial Sequence
  Synthetic Construct
SLRGNEA

SEQ ID NO: 13586 - protein, 7 aa, Artificial Sequence
  Synthetic Construct
PNVPSHS

SEQ ID NO: 13587 - protein, 7 aa, Artificial Sequence
  Synthetic Construct
GMPLMKM

SEQ ID NO: 13588 - protein, 7 aa, Artificial Sequence
  Synthetic Construct
QKTERTV

SEQ ID NO: 13589 - protein, 7 aa, Artificial Sequence
  Synthetic Construct
NHTNHSS

SEQ ID NO: 13590 - protein, 7 aa, Artificial Sequence
  Synthetic Construct
GLGNRSA

SEQ ID NO: 13591 - protein, 7 aa, Artificial Sequence
  Synthetic Construct
DLDKRGL

SEQ ID NO: 13592 - protein, 7 aa, Artificial Sequence
  Synthetic Construct
LTNAQPD

SEQ ID NO: 13593 - protein, 7 aa, Artificial Sequence
  Synthetic Construct
TKPDYLV

SEQ ID NO: 13594 - protein, 7 aa, Artificial Sequence
  Synthetic Construct
KLQLHEV

SEQ ID NO: 13595 - protein, 7 aa, Artificial Sequence
  Synthetic Construct
TSVTISS

SEQ ID NO: 13596 - protein, 7 aa, Artificial Sequence
  Synthetic Construct
NSSNRAE

SEQ ID NO: 13597 - protein, 7 aa, Artificial Sequence
  Synthetic Construct
LEHGTRI

SEQ ID NO: 13598 - protein, 7 aa, Artificial Sequence
  Synthetic Construct
TLQMREH

SEQ ID NO: 13599 - protein, 7 aa, Artificial Sequence
  Synthetic Construct
GSPTAQT

SEQ ID NO: 13600 - protein, 7 aa, Artificial Sequence
  Synthetic Construct
NKGQTLT

SEQ ID NO: 13601 - protein, 7 aa, Artificial Sequence
  Synthetic Construct
SVGHRDM

SEQ ID NO: 13602 - protein, 7 aa, Artificial Sequence
  Synthetic Construct
RDKSSMH

SEQ ID NO: 13603 - protein, 7 aa, Artificial Sequence
  Synthetic Construct
VSVINNT

SEQ ID NO: 13604 - protein, 7 aa, Artificial Sequence
  Synthetic Construct
LPNSAFS

SEQ ID NO: 13605 - protein, 7 aa, Artificial Sequence
  Synthetic Construct
RTVSTDD

SEQ ID NO: 13606 - protein, 7 aa, Artificial Sequence
  Synthetic Construct
LMDRMAS

SEQ ID NO: 13607 - protein, 7 aa, Artificial Sequence
  Synthetic Construct
PSGFNTL

SEQ ID NO: 13608 - protein, 7 aa, Artificial Sequence
  Synthetic Construct
KSAQPMS

SEQ ID NO: 13609 - protein, 7 aa, Artificial Sequence
  Synthetic Construct
TGLSVQK

SEQ ID NO: 13610 - protein, 7 aa, Artificial Sequence
  Synthetic Construct
HGFPAGP

SEQ ID NO: 13611 - protein, 7 aa, Artificial Sequence
  Synthetic Construct
SYEAVGI

SEQ ID NO: 13612 - protein, 7 aa, Artificial Sequence
  Synthetic Construct
TAKGVLS

SEQ ID NO: 13613 - protein, 7 aa, Artificial Sequence
  Synthetic Construct
GASTHNA

SEQ ID NO: 13614 - protein, 7 aa, Artificial Sequence
  Synthetic Construct
IIKEIPA

SEQ ID NO: 13615 - protein, 7 aa, Artificial Sequence
  Synthetic Construct
NHVISNG

SEQ ID NO: 13616 - protein, 7 aa, Artificial Sequence
  Synthetic Construct
YTNMAGV

SEQ ID NO: 13617 - protein, 7 aa, Artificial Sequence
  Synthetic Construct
FNRIGAG

SEQ ID NO: 13618 - protein, 7 aa, Artificial Sequence
  Synthetic Construct
WSTMMKS

SEQ ID NO: 13619 - protein, 7 aa, Artificial Sequence
  Synthetic Construct
TAPANHV

SEQ ID NO: 13620 - protein, 7 aa, Artificial Sequence
  Synthetic Construct
MHGGSEL

SEQ ID NO: 13621 - protein, 7 aa, Artificial Sequence
  Synthetic Construct
MSRMGVA

SEQ ID NO: 13622 - protein, 7 aa, Artificial Sequence
  Synthetic Construct
TRISEVL

SEQ ID NO: 13623 - protein, 7 aa, Artificial Sequence
  Synthetic Construct
SGPGLRT

SEQ ID NO: 13624 - protein, 7 aa, Artificial Sequence
  Synthetic Construct
DKRHHAE

SEQ ID NO: 13625 - protein, 7 aa, Artificial Sequence
  Synthetic Construct
LTQNDRP

SEQ ID NO: 13626 - protein, 7 aa, Artificial Sequence
  Synthetic Construct
SVTTSHV

SEQ ID NO: 13627 - protein, 7 aa, Artificial Sequence
  Synthetic Construct
MLTGGTN

SEQ ID NO: 13628 - protein, 7 aa, Artificial Sequence
  Synthetic Construct
DNVANAG

SEQ ID NO: 13629 - protein, 7 aa, Artificial Sequence
  Synthetic Construct
MTTNSIA

SEQ ID NO: 13630 - protein, 7 aa, Artificial Sequence
  Synthetic Construct
MRTQSLS

SEQ ID NO: 13631 - protein, 7 aa, Artificial Sequence
  Synthetic Construct
YGSFTGQ

SEQ ID NO: 13632 - protein, 7 aa, Artificial Sequence
  Synthetic Construct
GPMLLKA

SEQ ID NO: 13633 - protein, 7 aa, Artificial Sequence
  Synthetic Construct
MTQKAPV

SEQ ID NO: 13634 - protein, 7 aa, Artificial Sequence
  Synthetic Construct
SANATKL

SEQ ID NO: 13635 - protein, 7 aa, Artificial Sequence
  Synthetic Construct
FNGSLAM

SEQ ID NO: 13636 - protein, 7 aa, Artificial Sequence
  Synthetic Construct
IVNAKLT

SEQ ID NO: 13637 - protein, 7 aa, Artificial Sequence
  Synthetic Construct
MFSGLQA

SEQ ID NO: 13638 - protein, 7 aa, Artificial Sequence
  Synthetic Construct
VDYRVNG

SEQ ID NO: 13639 - protein, 7 aa, Artificial Sequence
  Synthetic Construct
LASAGNG

SEQ ID NO: 13640 - protein, 7 aa, Artificial Sequence
  Synthetic Construct
RDLHSKD

SEQ ID NO: 13641 - protein, 7 aa, Artificial Sequence
  Synthetic Construct
SHVSRTA

SEQ ID NO: 13642 - protein, 7 aa, Artificial Sequence
  Synthetic Construct
TPVQSLS

SEQ ID NO: 13643 - protein, 7 aa, Artificial Sequence
  Synthetic Construct
YLNGSEL

SEQ ID NO: 13644 - protein, 7 aa, Artificial Sequence
  Synthetic Construct
PALKTHE

SEQ ID NO: 13645 - protein, 7 aa, Artificial Sequence
  Synthetic Construct
NKSLTSD

SEQ ID NO: 13646 - protein, 7 aa, Artificial Sequence
  Synthetic Construct
YNATKSS

SEQ ID NO: 13647 - protein, 7 aa, Artificial Sequence
  Synthetic Construct
MRDKSHD

SEQ ID NO: 13648 - protein, 7 aa, Artificial Sequence
  Synthetic Construct
HRTEGQN

SEQ ID NO: 13649 - protein, 7 aa, Artificial Sequence
  Synthetic Construct
LHKPDEF

SEQ ID NO: 13650 - protein, 7 aa, Artificial Sequence
  Synthetic Construct
IAARPPS

SEQ ID NO: 13651 - protein, 7 aa, Artificial Sequence
  Synthetic Construct
TPTHYSH

SEQ ID NO: 13652 - protein, 7 aa, Artificial Sequence
  Synthetic Construct
STFSADR

SEQ ID NO: 13653 - protein, 7 aa, Artificial Sequence
  Synthetic Construct
QSVQVTA

SEQ ID NO: 13654 - protein, 7 aa, Artificial Sequence
  Synthetic Construct
LDSSRNR

SEQ ID NO: 13655 - protein, 7 aa, Artificial Sequence
  Synthetic Construct
RQPQSTV

SEQ ID NO: 13656 - protein, 7 aa, Artificial Sequence
  Synthetic Construct
RVDDGVR

SEQ ID NO: 13657 - protein, 7 aa, Artificial Sequence
  Synthetic Construct
KITNTYS

SEQ ID NO: 13658 - protein, 7 aa, Artificial Sequence
  Synthetic Construct
PGKATPP

SEQ ID NO: 13659 - protein, 7 aa, Artificial Sequence
  Synthetic Construct
FSTHTPP

SEQ ID NO: 13660 - protein, 7 aa, Artificial Sequence
  Synthetic Construct
LAPNMRL

SEQ ID NO: 13661 - protein, 7 aa, Artificial Sequence
  Synthetic Construct
NLPRTNV

SEQ ID NO: 13662 - protein, 7 aa, Artificial Sequence
  Synthetic Construct
ETSNVNR

SEQ ID NO: 13663 - protein, 7 aa, Artificial Sequence
  Synthetic Construct
GSTDHRL

SEQ ID NO: 13664 - protein, 7 aa, Artificial Sequence
  Synthetic Construct
VNTAMPA

SEQ ID NO: 13665 - protein, 7 aa, Artificial Sequence
  Synthetic Construct
MVARDQN

SEQ ID NO: 13666 - protein, 7 aa, Artificial Sequence
  Synthetic Construct
KNNPVLH

SEQ ID NO: 13667 - protein, 7 aa, Artificial Sequence
  Synthetic Construct
DSTTVRL

SEQ ID NO: 13668 - protein, 7 aa, Artificial Sequence
  Synthetic Construct
KLNVMND

SEQ ID NO: 13669 - protein, 7 aa, Artificial Sequence
  Synthetic Construct
SLRDKNA

SEQ ID NO: 13670 - protein, 7 aa, Artificial Sequence
  Synthetic Construct
GVGNSLS

SEQ ID NO: 13671 - protein, 7 aa, Artificial Sequence
  Synthetic Construct
FSKTNFN

SEQ ID NO: 13672 - protein, 7 aa, Artificial Sequence
  Synthetic Construct
ANRPSLP

SEQ ID NO: 13673 - protein, 7 aa, Artificial Sequence
  Synthetic Construct
DSQTNRV

SEQ ID NO: 13674 - protein, 7 aa, Artificial Sequence
  Synthetic Construct
ISTSSPV

SEQ ID NO: 13675 - protein, 7 aa, Artificial Sequence
  Synthetic Construct
ILKITEG

SEQ ID NO: 13676 - protein, 7 aa, Artificial Sequence
  Synthetic Construct
FRPASEI

SEQ ID NO: 13677 - protein, 7 aa, Artificial Sequence
  Synthetic Construct
KKDSEPL

SEQ ID NO: 13678 - protein, 7 aa, Artificial Sequence
  Synthetic Construct
NARPLTA

SEQ ID NO: 13679 - protein, 7 aa, Artificial Sequence
  Synthetic Construct
KAARMET

SEQ ID NO: 13680 - protein, 7 aa, Artificial Sequence
  Synthetic Construct
HANVSSR

SEQ ID NO: 13681 - protein, 7 aa, Artificial Sequence
  Synthetic Construct
TSTTQTS

SEQ ID NO: 13682 - protein, 7 aa, Artificial Sequence
  Synthetic Construct
SALSLSP

SEQ ID NO: 13683 - protein, 7 aa, Artificial Sequence
  Synthetic Construct
ANVQIQS

SEQ ID NO: 13684 - protein, 7 aa, Artificial Sequence
  Synthetic Construct
TPSSNSL

SEQ ID NO: 13685 - protein, 7 aa, Artificial Sequence
  Synthetic Construct
TMTGPGH

SEQ ID NO: 13686 - protein, 7 aa, Artificial Sequence
  Synthetic Construct
ITAQITN

SEQ ID NO: 13687 - protein, 7 aa, Artificial Sequence
  Synthetic Construct
LPNPSSR

SEQ ID NO: 13688 - protein, 7 aa, Artificial Sequence
  Synthetic Construct
KMGTMTP

SEQ ID NO: 13689 - protein, 7 aa, Artificial Sequence
  Synthetic Construct
YTNGRIN

SEQ ID NO: 13690 - protein, 7 aa, Artificial Sequence
  Synthetic Construct
DGSNVVK

SEQ ID NO: 13691 - protein, 7 aa, Artificial Sequence
  Synthetic Construct
LPLSIPA

SEQ ID NO: 13692 - protein, 7 aa, Artificial Sequence
  Synthetic Construct
ESRLSSS

SEQ ID NO: 13693 - protein, 7 aa, Artificial Sequence
  Synthetic Construct
MSPSRGN

SEQ ID NO: 13694 - protein, 7 aa, Artificial Sequence
  Synthetic Construct
SVHAAKQ

SEQ ID NO: 13695 - protein, 7 aa, Artificial Sequence
  Synthetic Construct
AFSSGTS

SEQ ID NO: 13696 - protein, 7 aa, Artificial Sequence
  Synthetic Construct
TGWSPSP

SEQ ID NO: 13697 - protein, 7 aa, Artificial Sequence
  Synthetic Construct
ASHSASG

SEQ ID NO: 13698 - protein, 7 aa, Artificial Sequence
  Synthetic Construct
VTPRSPL

SEQ ID NO: 13699 - protein, 7 aa, Artificial Sequence
  Synthetic Construct
TERDTSR

SEQ ID NO: 13700 - protein, 7 aa, Artificial Sequence
  Synthetic Construct
YTLTGTT

SEQ ID NO: 13701 - protein, 7 aa, Artificial Sequence
  Synthetic Construct
DLRVSRD

SEQ ID NO: 13702 - protein, 7 aa, Artificial Sequence
  Synthetic Construct
LIASHTA

SEQ ID NO: 13703 - protein, 7 aa, Artificial Sequence
  Synthetic Construct
QRSENSH

SEQ ID NO: 13704 - protein, 7 aa, Artificial Sequence
  Synthetic Construct
SASNQTY

SEQ ID NO: 13705 - protein, 7 aa, Artificial Sequence
  Synthetic Construct
LEKVLQP

SEQ ID NO: 13706 - protein, 7 aa, Artificial Sequence
  Synthetic Construct
NSGPLVI

SEQ ID NO: 13707 - protein, 7 aa, Artificial Sequence
  Synthetic Construct
GTIHSPV

SEQ ID NO: 13708 - protein, 7 aa, Artificial Sequence
  Synthetic Construct
NKNGEVL

SEQ ID NO: 13709 - protein, 7 aa, Artificial Sequence
  Synthetic Construct
PMNERER

SEQ ID NO: 13710 - protein, 7 aa, Artificial Sequence
  Synthetic Construct
GSNNLHP

SEQ ID NO: 13711 - protein, 7 aa, Artificial Sequence
  Synthetic Construct
MSLHAKS

SEQ ID NO: 13712 - protein, 7 aa, Artificial Sequence
  Synthetic Construct
QEKALAR

SEQ ID NO: 13713 - protein, 7 aa, Artificial Sequence
  Synthetic Construct
DRSTHAK

SEQ ID NO: 13714 - protein, 7 aa, Artificial Sequence
  Synthetic Construct
IVRGDTS

SEQ ID NO: 13715 - protein, 7 aa, Artificial Sequence
  Synthetic Construct
SSGGMNE

SEQ ID NO: 13716 - protein, 7 aa, Artificial Sequence
  Synthetic Construct
KLHAVEA

SEQ ID NO: 13717 - protein, 7 aa, Artificial Sequence
  Synthetic Construct
MFAEGTV

SEQ ID NO: 13718 - protein, 7 aa, Artificial Sequence
  Synthetic Construct
TLGRVPQ

SEQ ID NO: 13719 - protein, 7 aa, Artificial Sequence
  Synthetic Construct
LLGNKDK

SEQ ID NO: 13720 - protein, 7 aa, Artificial Sequence
  Synthetic Construct
RVNTSTD

SEQ ID NO: 13721 - protein, 7 aa, Artificial Sequence
  Synthetic Construct
PQGVSPA

SEQ ID NO: 13722 - protein, 7 aa, Artificial Sequence
  Synthetic Construct
GAVLSKA

SEQ ID NO: 13723 - protein, 7 aa, Artificial Sequence
  Synthetic Construct
LGHAATS

SEQ ID NO: 13724 - protein, 7 aa, Artificial Sequence
  Synthetic Construct
SGFSSTA

SEQ ID NO: 13725 - protein, 7 aa, Artificial Sequence
  Synthetic Construct
LVNQPQS

SEQ ID NO: 13726 - protein, 7 aa, Artificial Sequence
  Synthetic Construct
GRAEVGI

SEQ ID NO: 13727 - protein, 7 aa, Artificial Sequence
  Synthetic Construct
VLATKNS

SEQ ID NO: 13728 - protein, 7 aa, Artificial Sequence
  Synthetic Construct
QAHAFAD

SEQ ID NO: 13729 - protein, 7 aa, Artificial Sequence
  Synthetic Construct
NLDTVKT

SEQ ID NO: 13730 - protein, 7 aa, Artificial Sequence
  Synthetic Construct
RPQTLPN

SEQ ID NO: 13731 - protein, 7 aa, Artificial Sequence
  Synthetic Construct
NPRNSPT

SEQ ID NO: 13732 - protein, 7 aa, Artificial Sequence
  Synthetic Construct
HVQMDAD

SEQ ID NO: 13733 - protein, 7 aa, Artificial Sequence
  Synthetic Construct
TYRTEPV

SEQ ID NO: 13734 - protein, 7 aa, Artificial Sequence
  Synthetic Construct
PGLVNMS

SEQ ID NO: 13735 - protein, 7 aa, Artificial Sequence
  Synthetic Construct
SLSQGPA

SEQ ID NO: 13736 - protein, 7 aa, Artificial Sequence
  Synthetic Construct
LGASGYT

SEQ ID NO: 13737 - protein, 7 aa, Artificial Sequence
  Synthetic Construct
SAVTTMP

SEQ ID NO: 13738 - protein, 7 aa, Artificial Sequence
  Synthetic Construct
KVNAELL

SEQ ID NO: 13739 - protein, 7 aa, Artificial Sequence
  Synthetic Construct
PFTPKLS

SEQ ID NO: 13740 - protein, 7 aa, Artificial Sequence
  Synthetic Construct
MRSTNAS

SEQ ID NO: 13741 - protein, 7 aa, Artificial Sequence
  Synthetic Construct
VMYARGD

SEQ ID NO: 13742 - protein, 7 aa, Artificial Sequence
  Synthetic Construct
RVGSTMQ

SEQ ID NO: 13743 - protein, 7 aa, Artificial Sequence
  Synthetic Construct
LTVAVET

SEQ ID NO: 13744 - protein, 7 aa, Artificial Sequence
  Synthetic Construct
WTNSGSS

SEQ ID NO: 13745 - protein, 7 aa, Artificial Sequence
  Synthetic Construct
HAMRGTG

SEQ ID NO: 13746 - protein, 7 aa, Artificial Sequence
  Synthetic Construct
HQDVRGS

SEQ ID NO: 13747 - protein, 7 aa, Artificial Sequence
  Synthetic Construct
SFQREIP

SEQ ID NO: 13748 - protein, 7 aa, Artificial Sequence
  Synthetic Construct
LQRAALN

SEQ ID NO: 13749 - protein, 7 aa, Artificial Sequence
  Synthetic Construct
SDATIRP

SEQ ID NO: 13750 - protein, 7 aa, Artificial Sequence
  Synthetic Construct
QMSTGRV

SEQ ID NO: 13751 - protein, 7 aa, Artificial Sequence
  Synthetic Construct
RSTQAIP

SEQ ID NO: 13752 - protein, 7 aa, Artificial Sequence
  Synthetic Construct
QIRDANA

SEQ ID NO: 13753 - protein, 7 aa, Artificial Sequence
  Synthetic Construct
LHTSNAY

SEQ ID NO: 13754 - protein, 7 aa, Artificial Sequence
  Synthetic Construct
SSGLGTP

SEQ ID NO: 13755 - protein, 7 aa, Artificial Sequence
  Synthetic Construct
DHKPVRD

SEQ ID NO: 13756 - protein, 7 aa, Artificial Sequence
  Synthetic Construct
MKLVSVG

SEQ ID NO: 13757 - protein, 7 aa, Artificial Sequence
  Synthetic Construct
GEQSLKA

SEQ ID NO: 13758 - protein, 7 aa, Artificial Sequence
  Synthetic Construct
MTSGTNG

SEQ ID NO: 13759 - protein, 7 aa, Artificial Sequence
  Synthetic Construct
HAAKGVV

SEQ ID NO: 13760 - protein, 7 aa, Artificial Sequence
  Synthetic Construct
SSRQNEP

SEQ ID NO: 13761 - protein, 7 aa, Artificial Sequence
  Synthetic Construct
ALINRPN

SEQ ID NO: 13762 - protein, 7 aa, Artificial Sequence
  Synthetic Construct
LRSSMAS

SEQ ID NO: 13763 - protein, 7 aa, Artificial Sequence
  Synthetic Construct
NNEYSKL

SEQ ID NO: 13764 - protein, 7 aa, Artificial Sequence
  Synthetic Construct
TGRLNGE

SEQ ID NO: 13765 - protein, 7 aa, Artificial Sequence
  Synthetic Construct
TNSHAVR

SEQ ID NO: 13766 - protein, 7 aa, Artificial Sequence
  Synthetic Construct
IVTNHSH

SEQ ID NO: 13767 - protein, 7 aa, Artificial Sequence
  Synthetic Construct
ALTRDIT

SEQ ID NO: 13768 - protein, 7 aa, Artificial Sequence
  Synthetic Construct
GIANQGV

SEQ ID NO: 13769 - protein, 7 aa, Artificial Sequence
  Synthetic Construct
NTVRSQQ

SEQ ID NO: 13770 - protein, 7 aa, Artificial Sequence
  Synthetic Construct
MENSNKA

SEQ ID NO: 13771 - protein, 7 aa, Artificial Sequence
  Synthetic Construct
GTVRVQA

SEQ ID NO: 13772 - protein, 7 aa, Artificial Sequence
  Synthetic Construct
TTSHLID

SEQ ID NO: 13773 - protein, 7 aa, Artificial Sequence
  Synthetic Construct
GTQAHQG

SEQ ID NO: 13774 - protein, 7 aa, Artificial Sequence
  Synthetic Construct
KMSASSV

SEQ ID NO: 13775 - protein, 7 aa, Artificial Sequence
  Synthetic Construct
SLKVNPG

SEQ ID NO: 13776 - protein, 7 aa, Artificial Sequence
  Synthetic Construct
STGTSTL

SEQ ID NO: 13777 - protein, 7 aa, Artificial Sequence
  Synthetic Construct
VLTNREQ

SEQ ID NO: 13778 - protein, 7 aa, Artificial Sequence
  Synthetic Construct
LDVSRTL

SEQ ID NO: 13779 - protein, 7 aa, Artificial Sequence
  Synthetic Construct
SFGTESR

SEQ ID NO: 13780 - protein, 7 aa, Artificial Sequence
  Synthetic Construct
QLAKGNY

SEQ ID NO: 13781 - protein, 7 aa, Artificial Sequence
  Synthetic Construct
AKNDPRA

SEQ ID NO: 13782 - protein, 7 aa, Artificial Sequence
  Synthetic Construct
LTQVGGT

SEQ ID NO: 13783 - protein, 7 aa, Artificial Sequence
  Synthetic Construct
KQNTTSL

SEQ ID NO: 13784 - protein, 7 aa, Artificial Sequence
  Synthetic Construct
LSTRAED

SEQ ID NO: 13785 - protein, 7 aa, Artificial Sequence
  Synthetic Construct
TVPNIPM

SEQ ID NO: 13786 - protein, 7 aa, Artificial Sequence
  Synthetic Construct
NSLSKLS

SEQ ID NO: 13787 - protein, 7 aa, Artificial Sequence
  Synthetic Construct
MNEHQMK

SEQ ID NO: 13788 - protein, 7 aa, Artificial Sequence
  Synthetic Construct
DVKGHQS

SEQ ID NO: 13789 - protein, 7 aa, Artificial Sequence
  Synthetic Construct
DVSLQKD

SEQ ID NO: 13790 - protein, 7 aa, Artificial Sequence
  Synthetic Construct
TRPSGTY

SEQ ID NO: 13791 - protein, 7 aa, Artificial Sequence
  Synthetic Construct
VKGPDSL

SEQ ID NO: 13792 - protein, 7 aa, Artificial Sequence
  Synthetic Construct
NHSSYEL

SEQ ID NO: 13793 - protein, 7 aa, Artificial Sequence
  Synthetic Construct
TVRTPLI

SEQ ID NO: 13794 - protein, 7 aa, Artificial Sequence
  Synthetic Construct
ASIDSQH

SEQ ID NO: 13795 - protein, 7 aa, Artificial Sequence
  Synthetic Construct
DQKNSGH

SEQ ID NO: 13796 - protein, 7 aa, Artificial Sequence
  Synthetic Construct
LDTNNKA

SEQ ID NO: 13797 - protein, 7 aa, Artificial Sequence
  Synthetic Construct
ASAHAQV

SEQ ID NO: 13798 - protein, 7 aa, Artificial Sequence
  Synthetic Construct
DSGKHND

SEQ ID NO: 13799 - protein, 7 aa, Artificial Sequence
  Synthetic Construct
LNRNSGM

SEQ ID NO: 13800 - protein, 7 aa, Artificial Sequence
  Synthetic Construct
PTMLPDK

SEQ ID NO: 13801 - protein, 7 aa, Artificial Sequence
  Synthetic Construct
STQVSNY

SEQ ID NO: 13802 - protein, 7 aa, Artificial Sequence
  Synthetic Construct
SNQTLMS

SEQ ID NO: 13803 - protein, 7 aa, Artificial Sequence
  Synthetic Construct
RNPGSTS

SEQ ID NO: 13804 - protein, 7 aa, Artificial Sequence
  Synthetic Construct
RMAQGYS

SEQ ID NO: 13805 - protein, 7 aa, Artificial Sequence
  Synthetic Construct
QVMRQSS

SEQ ID NO: 13806 - protein, 7 aa, Artificial Sequence
  Synthetic Construct
KNTTVSD

SEQ ID NO: 13807 - protein, 7 aa, Artificial Sequence
  Synthetic Construct
TGKTARD

SEQ ID NO: 13808 - protein, 7 aa, Artificial Sequence
  Synthetic Construct
ILRTLTE

SEQ ID NO: 13809 - protein, 7 aa, Artificial Sequence
  Synthetic Construct
RLDNAGM

SEQ ID NO: 13810 - protein, 7 aa, Artificial Sequence
  Synthetic Construct
SGTGRQQ

SEQ ID NO: 13811 - protein, 7 aa, Artificial Sequence
  Synthetic Construct
LGKDTFS

SEQ ID NO: 13812 - protein, 7 aa, Artificial Sequence
  Synthetic Construct
RYDGSVA

SEQ ID NO: 13813 - protein, 7 aa, Artificial Sequence
  Synthetic Construct
AHYPAST

SEQ ID NO: 13814 - protein, 7 aa, Artificial Sequence
  Synthetic Construct
KSNGSPL

SEQ ID NO: 13815 - protein, 7 aa, Artificial Sequence
  Synthetic Construct
RDLVLTK

SEQ ID NO: 13816 - protein, 7 aa, Artificial Sequence
  Synthetic Construct
TSNPGNM

SEQ ID NO: 13817 - protein, 7 aa, Artificial Sequence
  Synthetic Construct
LPRPSNT

SEQ ID NO: 13818 - protein, 7 aa, Artificial Sequence
  Synthetic Construct
TGGGSFS

SEQ ID NO: 13819 - protein, 7 aa, Artificial Sequence
  Synthetic Construct
YPNKELS

SEQ ID NO: 13820 - protein, 7 aa, Artificial Sequence
  Synthetic Construct
TMVHQES

SEQ ID NO: 13821 - protein, 7 aa, Artificial Sequence
  Synthetic Construct
VNSNNSM

SEQ ID NO: 13822 - protein, 7 aa, Artificial Sequence
  Synthetic Construct
NGVHVTP

SEQ ID NO: 13823 - protein, 7 aa, Artificial Sequence
  Synthetic Construct
AKYLNSN

SEQ ID NO: 13824 - protein, 7 aa, Artificial Sequence
  Synthetic Construct
GMTKNGG

SEQ ID NO: 13825 - protein, 7 aa, Artificial Sequence
  Synthetic Construct
RARDEGM

SEQ ID NO: 13826 - protein, 7 aa, Artificial Sequence
  Synthetic Construct
VPSPGAT

SEQ ID NO: 13827 - protein, 7 aa, Artificial Sequence
  Synthetic Construct
KTQLGQM

SEQ ID NO: 13828 - protein, 7 aa, Artificial Sequence
  Synthetic Construct
STSTIQP

SEQ ID NO: 13829 - protein, 7 aa, Artificial Sequence
  Synthetic Construct
RKENASY

SEQ ID NO: 13830 - protein, 7 aa, Artificial Sequence
  Synthetic Construct
LTNHGNV

SEQ ID NO: 13831 - protein, 7 aa, Artificial Sequence
  Synthetic Construct
LDNVHSH

SEQ ID NO: 13832 - protein, 7 aa, Artificial Sequence
  Synthetic Construct
PTMAVTP

SEQ ID NO: 13833 - protein, 7 aa, Artificial Sequence
  Synthetic Construct
KPERTEA

SEQ ID NO: 13834 - protein, 7 aa, Artificial Sequence
  Synthetic Construct
TGDRKSG

SEQ ID NO: 13835 - protein, 7 aa, Artificial Sequence
  Synthetic Construct
AKHTSFP

SEQ ID NO: 13836 - protein, 7 aa, Artificial Sequence
  Synthetic Construct
GLVASLG

SEQ ID NO: 13837 - protein, 7 aa, Artificial Sequence
  Synthetic Construct
SVPRSEL

SEQ ID NO: 13838 - protein, 7 aa, Artificial Sequence
  Synthetic Construct
AERIGMG

SEQ ID NO: 13839 - protein, 7 aa, Artificial Sequence
  Synthetic Construct
SLVRQSD

SEQ ID NO: 13840 - protein, 7 aa, Artificial Sequence
  Synthetic Construct
HVKANPI

SEQ ID NO: 13841 - protein, 7 aa, Artificial Sequence
  Synthetic Construct
VVDTLKN

SEQ ID NO: 13842 - protein, 7 aa, Artificial Sequence
  Synthetic Construct
QIPYNSS

SEQ ID NO: 13843 - protein, 7 aa, Artificial Sequence
  Synthetic Construct
ADHSMHV

SEQ ID NO: 13844 - protein, 7 aa, Artificial Sequence
  Synthetic Construct
NHVTAQA

SEQ ID NO: 13845 - protein, 7 aa, Artificial Sequence
  Synthetic Construct
TNFTKSG

SEQ ID NO: 13846 - protein, 7 aa, Artificial Sequence
  Synthetic Construct
YGHSMTN

SEQ ID NO: 13847 - protein, 7 aa, Artificial Sequence
  Synthetic Construct
MRPDLKT

SEQ ID NO: 13848 - protein, 7 aa, Artificial Sequence
  Synthetic Construct
GPGTSFK

SEQ ID NO: 13849 - protein, 7 aa, Artificial Sequence
  Synthetic Construct
SSTTPGL

SEQ ID NO: 13850 - protein, 7 aa, Artificial Sequence
  Synthetic Construct
SVKANPT

SEQ ID NO: 13851 - protein, 7 aa, Artificial Sequence
  Synthetic Construct
TPTVFTP

SEQ ID NO: 13852 - protein, 7 aa, Artificial Sequence
  Synthetic Construct
MLPSPGS

SEQ ID NO: 13853 - protein, 7 aa, Artificial Sequence
  Synthetic Construct
NFDYAKP

SEQ ID NO: 13854 - protein, 7 aa, Artificial Sequence
  Synthetic Construct
TLNTSPM

SEQ ID NO: 13855 - protein, 7 aa, Artificial Sequence
  Synthetic Construct
TNSPKST

SEQ ID NO: 13856 - protein, 7 aa, Artificial Sequence
  Synthetic Construct
VTPGRYS

SEQ ID NO: 13857 - protein, 7 aa, Artificial Sequence
  Synthetic Construct
TRVSNLD

SEQ ID NO: 13858 - protein, 7 aa, Artificial Sequence
  Synthetic Construct
SHGPDRT

SEQ ID NO: 13859 - protein, 7 aa, Artificial Sequence
  Synthetic Construct
NIHTATT

SEQ ID NO: 13860 - protein, 7 aa, Artificial Sequence
  Synthetic Construct
LLPQTTL

SEQ ID NO: 13861 - protein, 7 aa, Artificial Sequence
  Synthetic Construct
RTNDTSA

SEQ ID NO: 13862 - protein, 7 aa, Artificial Sequence
  Synthetic Construct
ERNGSHE

SEQ ID NO: 13863 - protein, 7 aa, Artificial Sequence
  Synthetic Construct
NTREAFI

SEQ ID NO: 13864 - protein, 7 aa, Artificial Sequence
  Synthetic Construct
VGQYASP

SEQ ID NO: 13865 - protein, 7 aa, Artificial Sequence
  Synthetic Construct
VAETGRT

SEQ ID NO: 13866 - protein, 7 aa, Artificial Sequence
  Synthetic Construct
MSAGSNS

SEQ ID NO: 13867 - protein, 7 aa, Artificial Sequence
  Synthetic Construct
LSPKNAQ

SEQ ID NO: 13868 - protein, 7 aa, Artificial Sequence
  Synthetic Construct
SGTSQLP

SEQ ID NO: 13869 - protein, 7 aa, Artificial Sequence
  Synthetic Construct
RLQDKPQ

SEQ ID NO: 13870 - protein, 7 aa, Artificial Sequence
  Synthetic Construct
NVPRSSV

SEQ ID NO: 13871 - protein, 7 aa, Artificial Sequence
  Synthetic Construct
ALGSPRP

SEQ ID NO: 13872 - protein, 7 aa, Artificial Sequence
  Synthetic Construct
AKEPMSA

SEQ ID NO: 13873 - protein, 7 aa, Artificial Sequence
  Synthetic Construct
AVSGAAH

SEQ ID NO: 13874 - protein, 7 aa, Artificial Sequence
  Synthetic Construct
YNNKSAA

SEQ ID NO: 13875 - protein, 7 aa, Artificial Sequence
  Synthetic Construct
QVSVRNL

SEQ ID NO: 13876 - protein, 7 aa, Artificial Sequence
  Synthetic Construct
KGTHPPA

SEQ ID NO: 13877 - protein, 7 aa, Artificial Sequence
  Synthetic Construct
QYPNSKV

SEQ ID NO: 13878 - protein, 7 aa, Artificial Sequence
  Synthetic Construct
HNASNSG

SEQ ID NO: 13879 - protein, 7 aa, Artificial Sequence
  Synthetic Construct
ELNPKFI

SEQ ID NO: 13880 - protein, 7 aa, Artificial Sequence
  Synthetic Construct
SRETPGT

SEQ ID NO: 13881 - protein, 7 aa, Artificial Sequence
  Synthetic Construct
NFKPQNE

SEQ ID NO: 13882 - protein, 7 aa, Artificial Sequence
  Synthetic Construct
AMTSGSA

SEQ ID NO: 13883 - protein, 7 aa, Artificial Sequence
  Synthetic Construct
KDPRSTL

SEQ ID NO: 13884 - protein, 7 aa, Artificial Sequence
  Synthetic Construct
DRGTRTV

SEQ ID NO: 13885 - protein, 7 aa, Artificial Sequence
  Synthetic Construct
SLARNNV

SEQ ID NO: 13886 - protein, 7 aa, Artificial Sequence
  Synthetic Construct
AIRFNEP

SEQ ID NO: 13887 - protein, 7 aa, Artificial Sequence
  Synthetic Construct
QHHIATP

SEQ ID NO: 13888 - protein, 7 aa, Artificial Sequence
  Synthetic Construct
QILREPV

SEQ ID NO: 13889 - protein, 7 aa, Artificial Sequence
  Synthetic Construct
TVVNKLS

SEQ ID NO: 13890 - protein, 7 aa, Artificial Sequence
  Synthetic Construct
RDNTTKF

SEQ ID NO: 13891 - protein, 7 aa, Artificial Sequence
  Synthetic Construct
SLLSTLG

SEQ ID NO: 13892 - protein, 7 aa, Artificial Sequence
  Synthetic Construct
GQVPVTR

SEQ ID NO: 13893 - protein, 7 aa, Artificial Sequence
  Synthetic Construct
IQNSLMP

SEQ ID NO: 13894 - protein, 7 aa, Artificial Sequence
  Synthetic Construct
QHNTQNT

SEQ ID NO: 13895 - protein, 7 aa, Artificial Sequence
  Synthetic Construct
VGPTMTH

SEQ ID NO: 13896 - protein, 7 aa, Artificial Sequence
  Synthetic Construct
TNVTMAR

SEQ ID NO: 13897 - protein, 7 aa, Artificial Sequence
  Synthetic Construct
SAHFTGT

SEQ ID NO: 13898 - protein, 7 aa, Artificial Sequence
  Synthetic Construct
RYSVNDK

SEQ ID NO: 13899 - protein, 7 aa, Artificial Sequence
  Synthetic Construct
VYKSADP

SEQ ID NO: 13900 - protein, 7 aa, Artificial Sequence
  Synthetic Construct
VHTALPM

SEQ ID NO: 13901 - protein, 7 aa, Artificial Sequence
  Synthetic Construct
TISSAGI

SEQ ID NO: 13902 - protein, 7 aa, Artificial Sequence
  Synthetic Construct
RLPSTQA

SEQ ID NO: 13903 - protein, 7 aa, Artificial Sequence
  Synthetic Construct
SQERAMS

SEQ ID NO: 13904 - protein, 7 aa, Artificial Sequence
  Synthetic Construct
MNQLANP

SEQ ID NO: 13905 - protein, 7 aa, Artificial Sequence
  Synthetic Construct
FGATSGQ

SEQ ID NO: 13906 - protein, 7 aa, Artificial Sequence
  Synthetic Construct
TLLRSPA

SEQ ID NO: 13907 - protein, 7 aa, Artificial Sequence
  Synthetic Construct
LRSNVSN

SEQ ID NO: 13908 - protein, 7 aa, Artificial Sequence
  Synthetic Construct
IANSQAA

SEQ ID NO: 13909 - protein, 7 aa, Artificial Sequence
  Synthetic Construct
SNRIVPV

SEQ ID NO: 13910 - protein, 7 aa, Artificial Sequence
  Synthetic Construct
SPNPSNA

SEQ ID NO: 13911 - protein, 7 aa, Artificial Sequence
  Synthetic Construct
KWDSANE

SEQ ID NO: 13912 - protein, 7 aa, Artificial Sequence
  Synthetic Construct
ASRQGEA

SEQ ID NO: 13913 - protein, 7 aa, Artificial Sequence
  Synthetic Construct
VPGNSPH

SEQ ID NO: 13914 - protein, 7 aa, Artificial Sequence
  Synthetic Construct
SATTNSV

SEQ ID NO: 13915 - protein, 7 aa, Artificial Sequence
  Synthetic Construct
HIGARQV

SEQ ID NO: 13916 - protein, 7 aa, Artificial Sequence
  Synthetic Construct
LTDRSPM

SEQ ID NO: 13917 - protein, 7 aa, Artificial Sequence
  Synthetic Construct
NPTQAVL

SEQ ID NO: 13918 - protein, 7 aa, Artificial Sequence
  Synthetic Construct
TKNETGT

SEQ ID NO: 13919 - protein, 7 aa, Artificial Sequence
  Synthetic Construct
LTATLTS

SEQ ID NO: 13920 - protein, 7 aa, Artificial Sequence
  Synthetic Construct
YKASYAA

SEQ ID NO: 13921 - protein, 7 aa, Artificial Sequence
  Synthetic Construct
TLPDKVS

SEQ ID NO: 13922 - protein, 7 aa, Artificial Sequence
  Synthetic Construct
NNHIPLA

SEQ ID NO: 13923 - protein, 7 aa, Artificial Sequence
  Synthetic Construct
SNLTSNP

SEQ ID NO: 13924 - protein, 7 aa, Artificial Sequence
  Synthetic Construct
QQNDRNA

SEQ ID NO: 13925 - protein, 7 aa, Artificial Sequence
  Synthetic Construct
MLSTNRS

SEQ ID NO: 13926 - protein, 7 aa, Artificial Sequence
  Synthetic Construct
ITSATLS

SEQ ID NO: 13927 - protein, 7 aa, Artificial Sequence
  Synthetic Construct
VDAMQRP

SEQ ID NO: 13928 - protein, 7 aa, Artificial Sequence
  Synthetic Construct
REANYAS

SEQ ID NO: 13929 - protein, 7 aa, Artificial Sequence
  Synthetic Construct
RSNNADL

SEQ ID NO: 13930 - protein, 7 aa, Artificial Sequence
  Synthetic Construct
GLDKMGS

SEQ ID NO: 13931 - protein, 7 aa, Artificial Sequence
  Synthetic Construct
FTTSHAP

SEQ ID NO: 13932 - protein, 7 aa, Artificial Sequence
  Synthetic Construct
DKSVKFA

SEQ ID NO: 13933 - protein, 7 aa, Artificial Sequence
  Synthetic Construct
HAKKELQ

SEQ ID NO: 13934 - protein, 7 aa, Artificial Sequence
  Synthetic Construct
VESKGAS

SEQ ID NO: 13935 - protein, 7 aa, Artificial Sequence
  Synthetic Construct
KTAPSMG

SEQ ID NO: 13936 - protein, 7 aa, Artificial Sequence
  Synthetic Construct
GLRTDNR

SEQ ID NO: 13937 - protein, 7 aa, Artificial Sequence
  Synthetic Construct
RIAGNNP

SEQ ID NO: 13938 - protein, 7 aa, Artificial Sequence
  Synthetic Construct
KDPHQVV

SEQ ID NO: 13939 - protein, 7 aa, Artificial Sequence
  Synthetic Construct
EQTPHNS

SEQ ID NO: 13940 - protein, 7 aa, Artificial Sequence
  Synthetic Construct
GLDKGNW

SEQ ID NO: 13941 - protein, 7 aa, Artificial Sequence
  Synthetic Construct
PSNGNYS

SEQ ID NO: 13942 - protein, 7 aa, Artificial Sequence
  Synthetic Construct
GRPGIGS

SEQ ID NO: 13943 - protein, 7 aa, Artificial Sequence
  Synthetic Construct
RTSPGVS

SEQ ID NO: 13944 - protein, 7 aa, Artificial Sequence
  Synthetic Construct
VNASLIS

SEQ ID NO: 13945 - protein, 7 aa, Artificial Sequence
  Synthetic Construct
KTSTNLQ

SEQ ID NO: 13946 - protein, 7 aa, Artificial Sequence
  Synthetic Construct
MDMKQNM

SEQ ID NO: 13947 - protein, 7 aa, Artificial Sequence
  Synthetic Construct
DLNGINV

SEQ ID NO: 13948 - protein, 7 aa, Artificial Sequence
  Synthetic Construct
RTPPSFE

SEQ ID NO: 13949 - protein, 7 aa, Artificial Sequence
  Synthetic Construct
DFHDRKG

SEQ ID NO: 13950 - protein, 7 aa, Artificial Sequence
  Synthetic Construct
LHTQTQT

SEQ ID NO: 13951 - protein, 7 aa, Artificial Sequence
  Synthetic Construct
LGASNNA

SEQ ID NO: 13952 - protein, 7 aa, Artificial Sequence
  Synthetic Construct
IASVPRD

SEQ ID NO: 13953 - protein, 7 aa, Artificial Sequence
  Synthetic Construct
KAKDVGD

SEQ ID NO: 13954 - protein, 7 aa, Artificial Sequence
  Synthetic Construct
SAFAAKQ

SEQ ID NO: 13955 - protein, 7 aa, Artificial Sequence
  Synthetic Construct
VYQGQHL

SEQ ID NO: 13956 - protein, 7 aa, Artificial Sequence
  Synthetic Construct
YLPAASS

SEQ ID NO: 13957 - protein, 7 aa, Artificial Sequence
  Synthetic Construct
SPSTVIS

SEQ ID NO: 13958 - protein, 7 aa, Artificial Sequence
  Synthetic Construct
GTNKPPD

SEQ ID NO: 13959 - protein, 7 aa, Artificial Sequence
  Synthetic Construct
ESTGAIR

SEQ ID NO: 13960 - protein, 7 aa, Artificial Sequence
  Synthetic Construct
LMNTTIA

SEQ ID NO: 13961 - protein, 7 aa, Artificial Sequence
  Synthetic Construct
MAGVAQP

SEQ ID NO: 13962 - protein, 7 aa, Artificial Sequence
  Synthetic Construct
RPELKRE

SEQ ID NO: 13963 - protein, 7 aa, Artificial Sequence
  Synthetic Construct
KAQDTPT

SEQ ID NO: 13964 - protein, 7 aa, Artificial Sequence
  Synthetic Construct
STNHSTS

SEQ ID NO: 13965 - protein, 7 aa, Artificial Sequence
  Synthetic Construct
FPRTTTD

SEQ ID NO: 13966 - protein, 7 aa, Artificial Sequence
  Synthetic Construct
SRAHNLD

SEQ ID NO: 13967 - protein, 7 aa, Artificial Sequence
  Synthetic Construct
RTIQEGI

SEQ ID NO: 13968 - protein, 7 aa, Artificial Sequence
  Synthetic Construct
GGKSFAQ

SEQ ID NO: 13969 - protein, 7 aa, Artificial Sequence
  Synthetic Construct
GRPSSTQ

SEQ ID NO: 13970 - protein, 7 aa, Artificial Sequence
  Synthetic Construct
NPLNTST

SEQ ID NO: 13971 - protein, 7 aa, Artificial Sequence
  Synthetic Construct
ENLSNGR

SEQ ID NO: 13972 - protein, 7 aa, Artificial Sequence
  Synthetic Construct
ENTIRMS

SEQ ID NO: 13973 - protein, 7 aa, Artificial Sequence
  Synthetic Construct
PPRSMPM

SEQ ID NO: 13974 - protein, 7 aa, Artificial Sequence
  Synthetic Construct
LLSSNLP

SEQ ID NO: 13975 - protein, 7 aa, Artificial Sequence
  Synthetic Construct
RVQSLNE

SEQ ID NO: 13976 - protein, 7 aa, Artificial Sequence
  Synthetic Construct
PRRAQDD

SEQ ID NO: 13977 - protein, 7 aa, Artificial Sequence
  Synthetic Construct
QGNVNVG

SEQ ID NO: 13978 - protein, 7 aa, Artificial Sequence
  Synthetic Construct
SGETLRG

SEQ ID NO: 13979 - protein, 7 aa, Artificial Sequence
  Synthetic Construct
HVSHNTD

SEQ ID NO: 13980 - protein, 7 aa, Artificial Sequence
  Synthetic Construct
FGGGSLV

SEQ ID NO: 13981 - protein, 7 aa, Artificial Sequence
  Synthetic Construct
PSLRSEG

SEQ ID NO: 13982 - protein, 7 aa, Artificial Sequence
  Synthetic Construct
VRSENGV

SEQ ID NO: 13983 - protein, 7 aa, Artificial Sequence
  Synthetic Construct
TLKVTGD

SEQ ID NO: 13984 - protein, 7 aa, Artificial Sequence
  Synthetic Construct
VPKVYLD

SEQ ID NO: 13985 - protein, 7 aa, Artificial Sequence
  Synthetic Construct
TSMRNTE

SEQ ID NO: 13986 - protein, 7 aa, Artificial Sequence
  Synthetic Construct
GYSHGSM

SEQ ID NO: 13987 - protein, 7 aa, Artificial Sequence
  Synthetic Construct
ATFPEKQ

SEQ ID NO: 13988 - protein, 7 aa, Artificial Sequence
  Synthetic Construct
TGPTHGT

SEQ ID NO: 13989 - protein, 7 aa, Artificial Sequence
  Synthetic Construct
TNDRHAP

SEQ ID NO: 13990 - protein, 7 aa, Artificial Sequence
  Synthetic Construct
RHLASVD

SEQ ID NO: 13991 - protein, 7 aa, Artificial Sequence
  Synthetic Construct
NMIQPSN

SEQ ID NO: 13992 - protein, 7 aa, Artificial Sequence
  Synthetic Construct
NLSGSPA

SEQ ID NO: 13993 - protein, 7 aa, Artificial Sequence
  Synthetic Construct
QTVGPLP

SEQ ID NO: 13994 - protein, 7 aa, Artificial Sequence
  Synthetic Construct
VGHLSRD

SEQ ID NO: 13995 - protein, 7 aa, Artificial Sequence
  Synthetic Construct
QNFNAGH

SEQ ID NO: 13996 - protein, 7 aa, Artificial Sequence
  Synthetic Construct
LTGAARV

SEQ ID NO: 13997 - protein, 7 aa, Artificial Sequence
  Synthetic Construct
GTRPTAT

SEQ ID NO: 13998 - protein, 7 aa, Artificial Sequence
  Synthetic Construct
MPLSVAP

SEQ ID NO: 13999 - protein, 7 aa, Artificial Sequence
  Synthetic Construct
DRVQQFS

SEQ ID NO: 14000 - protein, 7 aa, Artificial Sequence
  Synthetic Construct
NNDTSTK

SEQ ID NO: 14001 - protein, 7 aa, Artificial Sequence
  Synthetic Construct
PSKNTHI

SEQ ID NO: 14002 - protein, 7 aa, Artificial Sequence
  Synthetic Construct
PFKADVT

SEQ ID NO: 14003 - protein, 7 aa, Artificial Sequence
  Synthetic Construct
PKTPTYV

SEQ ID NO: 14004 - protein, 7 aa, Artificial Sequence
  Synthetic Construct
LTNMTTP

SEQ ID NO: 14005 - protein, 7 aa, Artificial Sequence
  Synthetic Construct
GSKVHLS

SEQ ID NO: 14006 - protein, 7 aa, Artificial Sequence
  Synthetic Construct
SIPGYNN

SEQ ID NO: 14007 - protein, 7 aa, Artificial Sequence
  Synthetic Construct
MKTAESY

SEQ ID NO: 14008 - protein, 7 aa, Artificial Sequence
  Synthetic Construct
NGDRLLN

SEQ ID NO: 14009 - protein, 7 aa, Artificial Sequence
  Synthetic Construct
GTTHTSL

SEQ ID NO: 14010 - protein, 7 aa, Artificial Sequence
  Synthetic Construct
LGPSTQS

SEQ ID NO: 14011 - protein, 7 aa, Artificial Sequence
  Synthetic Construct
MNALTDK

SEQ ID NO: 14012 - protein, 7 aa, Artificial Sequence
  Synthetic Construct
SSKEISL

SEQ ID NO: 14013 - protein, 7 aa, Artificial Sequence
  Synthetic Construct
LDNGTTR

SEQ ID NO: 14014 - protein, 7 aa, Artificial Sequence
  Synthetic Construct
RVNFNSD

SEQ ID NO: 14015 - protein, 7 aa, Artificial Sequence
  Synthetic Construct
NMQAISN

SEQ ID NO: 14016 - protein, 7 aa, Artificial Sequence
  Synthetic Construct
NTNPRSI

SEQ ID NO: 14017 - protein, 7 aa, Artificial Sequence
  Synthetic Construct
KINSNSP

SEQ ID NO: 14018 - protein, 7 aa, Artificial Sequence
  Synthetic Construct
VPLGKAS

SEQ ID NO: 14019 - protein, 7 aa, Artificial Sequence
  Synthetic Construct
RLNHNSP

SEQ ID NO: 14020 - protein, 7 aa, Artificial Sequence
  Synthetic Construct
QLNTVLP

SEQ ID NO: 14021 - protein, 7 aa, Artificial Sequence
  Synthetic Construct
DSFGKSL

SEQ ID NO: 14022 - protein, 7 aa, Artificial Sequence
  Synthetic Construct
KPPKLVD

SEQ ID NO: 14023 - protein, 7 aa, Artificial Sequence
  Synthetic Construct
QITVGKP

SEQ ID NO: 14024 - protein, 7 aa, Artificial Sequence
  Synthetic Construct
QHPHGQQ

SEQ ID NO: 14025 - protein, 7 aa, Artificial Sequence
  Synthetic Construct
TSTNMAA

SEQ ID NO: 14026 - protein, 7 aa, Artificial Sequence
  Synthetic Construct
QGGLAVV

SEQ ID NO: 14027 - protein, 7 aa, Artificial Sequence
  Synthetic Construct
GRGSLPF

SEQ ID NO: 14028 - protein, 7 aa, Artificial Sequence
  Synthetic Construct
SGKPASE

SEQ ID NO: 14029 - protein, 7 aa, Artificial Sequence
  Synthetic Construct
RSVSVNS

SEQ ID NO: 14030 - protein, 7 aa, Artificial Sequence
  Synthetic Construct
DRGGVVA

SEQ ID NO: 14031 - protein, 7 aa, Artificial Sequence
  Synthetic Construct
GRETGFS

SEQ ID NO: 14032 - protein, 7 aa, Artificial Sequence
  Synthetic Construct
QIVPSNP

SEQ ID NO: 14033 - protein, 7 aa, Artificial Sequence
  Synthetic Construct
TTLGHSY

SEQ ID NO: 14034 - protein, 7 aa, Artificial Sequence
  Synthetic Construct
SREFQLA

SEQ ID NO: 14035 - protein, 7 aa, Artificial Sequence
  Synthetic Construct
GRDHNIG

SEQ ID NO: 14036 - protein, 7 aa, Artificial Sequence
  Synthetic Construct
SNNSRPN

SEQ ID NO: 14037 - protein, 7 aa, Artificial Sequence
  Synthetic Construct
KNQSSDL

SEQ ID NO: 14038 - protein, 7 aa, Artificial Sequence
  Synthetic Construct
PNDRAHG

SEQ ID NO: 14039 - protein, 7 aa, Artificial Sequence
  Synthetic Construct
ALTRTQS

SEQ ID NO: 14040 - protein, 7 aa, Artificial Sequence
  Synthetic Construct
MRPPSDK

SEQ ID NO: 14041 - protein, 7 aa, Artificial Sequence
  Synthetic Construct
TNSTTKS

SEQ ID NO: 14042 - protein, 7 aa, Artificial Sequence
  Synthetic Construct
GRHGMTA

SEQ ID NO: 14043 - protein, 7 aa, Artificial Sequence
  Synthetic Construct
VSHISPA

SEQ ID NO: 14044 - protein, 7 aa, Artificial Sequence
  Synthetic Construct
KVTSNSS

SEQ ID NO: 14045 - protein, 7 aa, Artificial Sequence
  Synthetic Construct
MYGPGAS

SEQ ID NO: 14046 - protein, 7 aa, Artificial Sequence
  Synthetic Construct
VLRSNTP

SEQ ID NO: 14047 - protein, 7 aa, Artificial Sequence
  Synthetic Construct
NSSSSNK

SEQ ID NO: 14048 - protein, 7 aa, Artificial Sequence
  Synthetic Construct
STEKSTS

SEQ ID NO: 14049 - protein, 7 aa, Artificial Sequence
  Synthetic Construct
NTNGNKG

SEQ ID NO: 14050 - protein, 7 aa, Artificial Sequence
  Synthetic Construct
ITTNLGA

SEQ ID NO: 14051 - protein, 7 aa, Artificial Sequence
  Synthetic Construct
IQKPQSS

SEQ ID NO: 14052 - protein, 7 aa, Artificial Sequence
  Synthetic Construct
VRDAAYT

SEQ ID NO: 14053 - protein, 7 aa, Artificial Sequence
  Synthetic Construct
ARSSTGA

SEQ ID NO: 14054 - protein, 7 aa, Artificial Sequence
  Synthetic Construct
TSVHNKV

SEQ ID NO: 14055 - protein, 7 aa, Artificial Sequence
  Synthetic Construct
TISTHGT

SEQ ID NO: 14056 - protein, 7 aa, Artificial Sequence
  Synthetic Construct
TVTNINF

SEQ ID NO: 14057 - protein, 7 aa, Artificial Sequence
  Synthetic Construct
SINSNHI

SEQ ID NO: 14058 - protein, 7 aa, Artificial Sequence
  Synthetic Construct
QKAGYSN

SEQ ID NO: 14059 - protein, 7 aa, Artificial Sequence
  Synthetic Construct
ARDTVRT

SEQ ID NO: 14060 - protein, 7 aa, Artificial Sequence
  Synthetic Construct
YKDQTKV

SEQ ID NO: 14061 - protein, 7 aa, Artificial Sequence
  Synthetic Construct
NIGLNPM

SEQ ID NO: 14062 - protein, 7 aa, Artificial Sequence
  Synthetic Construct
GSTNMIY

SEQ ID NO: 14063 - protein, 7 aa, Artificial Sequence
  Synthetic Construct
IDAKGLK

SEQ ID NO: 14064 - protein, 7 aa, Artificial Sequence
  Synthetic Construct
VVSHNLT

SEQ ID NO: 14065 - protein, 7 aa, Artificial Sequence
  Synthetic Construct
TVSLKTA

SEQ ID NO: 14066 - protein, 7 aa, Artificial Sequence
  Synthetic Construct
YSGSNYH

SEQ ID NO: 14067 - protein, 7 aa, Artificial Sequence
  Synthetic Construct
PSDATMG

SEQ ID NO: 14068 - protein, 7 aa, Artificial Sequence
  Synthetic Construct
WGETTNG

SEQ ID NO: 14069 - protein, 7 aa, Artificial Sequence
  Synthetic Construct
NYHKTMP

SEQ ID NO: 14070 - protein, 7 aa, Artificial Sequence
  Synthetic Construct
ARHELPV

SEQ ID NO: 14071 - protein, 7 aa, Artificial Sequence
  Synthetic Construct
HNLTRNL

SEQ ID NO: 14072 - protein, 7 aa, Artificial Sequence
  Synthetic Construct
GPQIGTV

SEQ ID NO: 14073 - protein, 7 aa, Artificial Sequence
  Synthetic Construct
MRADSNV

SEQ ID NO: 14074 - protein, 7 aa, Artificial Sequence
  Synthetic Construct
VANGPTT

SEQ ID NO: 14075 - protein, 7 aa, Artificial Sequence
  Synthetic Construct
TKNLNTY

SEQ ID NO: 14076 - protein, 7 aa, Artificial Sequence
  Synthetic Construct
DRLGARS

SEQ ID NO: 14077 - protein, 7 aa, Artificial Sequence
  Synthetic Construct
NIGSGQK

SEQ ID NO: 14078 - protein, 7 aa, Artificial Sequence
  Synthetic Construct
GREMTNP

SEQ ID NO: 14079 - protein, 7 aa, Artificial Sequence
  Synthetic Construct
IMAAAHS

SEQ ID NO: 14080 - protein, 7 aa, Artificial Sequence
  Synthetic Construct
SDQRIHP

SEQ ID NO: 14081 - protein, 7 aa, Artificial Sequence
  Synthetic Construct
VSGQTNM

SEQ ID NO: 14082 - protein, 7 aa, Artificial Sequence
  Synthetic Construct
YSLGSEP

SEQ ID NO: 14083 - protein, 7 aa, Artificial Sequence
  Synthetic Construct
STLKALT

SEQ ID NO: 14084 - protein, 7 aa, Artificial Sequence
  Synthetic Construct
SALIPSP

SEQ ID NO: 14085 - protein, 7 aa, Artificial Sequence
  Synthetic Construct
TSQAGNQ

SEQ ID NO: 14086 - protein, 7 aa, Artificial Sequence
  Synthetic Construct
KHASLPI

SEQ ID NO: 14087 - protein, 7 aa, Artificial Sequence
  Synthetic Construct
LDQLTKN

SEQ ID NO: 14088 - protein, 7 aa, Artificial Sequence
  Synthetic Construct
MARSTDR

SEQ ID NO: 14089 - protein, 7 aa, Artificial Sequence
  Synthetic Construct
SYNHIEK

SEQ ID NO: 14090 - protein, 7 aa, Artificial Sequence
  Synthetic Construct
VNHIQPM

SEQ ID NO: 14091 - protein, 7 aa, Artificial Sequence
  Synthetic Construct
SRAEPKL

SEQ ID NO: 14092 - protein, 7 aa, Artificial Sequence
  Synthetic Construct
ASHIGNS

SEQ ID NO: 14093 - protein, 7 aa, Artificial Sequence
  Synthetic Construct
HQGFASA

SEQ ID NO: 14094 - protein, 7 aa, Artificial Sequence
  Synthetic Construct
EGKSIMP

SEQ ID NO: 14095 - protein, 7 aa, Artificial Sequence
  Synthetic Construct
LTGMHST

SEQ ID NO: 14096 - protein, 7 aa, Artificial Sequence
  Synthetic Construct
SNPSTIH

SEQ ID NO: 14097 - protein, 7 aa, Artificial Sequence
  Synthetic Construct
SRDQPTS

SEQ ID NO: 14098 - protein, 7 aa, Artificial Sequence
  Synthetic Construct
KTAEPYT

SEQ ID NO: 14099 - protein, 7 aa, Artificial Sequence
  Synthetic Construct
IGSNPDK

SEQ ID NO: 14100 - protein, 7 aa, Artificial Sequence
  Synthetic Construct
LASTFSP

SEQ ID NO: 14101 - protein, 7 aa, Artificial Sequence
  Synthetic Construct
LVRLNTS

SEQ ID NO: 14102 - protein, 7 aa, Artificial Sequence
  Synthetic Construct
FQDLRAQ

SEQ ID NO: 14103 - protein, 7 aa, Artificial Sequence
  Synthetic Construct
ISHSPQT

SEQ ID NO: 14104 - protein, 7 aa, Artificial Sequence
  Synthetic Construct
FQDGQRE

SEQ ID NO: 14105 - protein, 7 aa, Artificial Sequence
  Synthetic Construct
DTREAFR

SEQ ID NO: 14106 - protein, 7 aa, Artificial Sequence
  Synthetic Construct
LVADARP

SEQ ID NO: 14107 - protein, 7 aa, Artificial Sequence
  Synthetic Construct
SFSSGAG

SEQ ID NO: 14108 - protein, 7 aa, Artificial Sequence
  Synthetic Construct
DVLTGKS

SEQ ID NO: 14109 - protein, 7 aa, Artificial Sequence
  Synthetic Construct
KMVLNNA

SEQ ID NO: 14110 - protein, 7 aa, Artificial Sequence
  Synthetic Construct
RKIDTMS

SEQ ID NO: 14111 - protein, 7 aa, Artificial Sequence
  Synthetic Construct
MSQVITG

SEQ ID NO: 14112 - protein, 7 aa, Artificial Sequence
  Synthetic Construct
TYDTRNT

SEQ ID NO: 14113 - protein, 7 aa, Artificial Sequence
  Synthetic Construct
YRDGSGS

SEQ ID NO: 14114 - protein, 7 aa, Artificial Sequence
  Synthetic Construct
GNISPAG

SEQ ID NO: 14115 - protein, 7 aa, Artificial Sequence
  Synthetic Construct
KAGLGLS

SEQ ID NO: 14116 - protein, 7 aa, Artificial Sequence
  Synthetic Construct
RHVEKDT

SEQ ID NO: 14117 - protein, 7 aa, Artificial Sequence
  Synthetic Construct
KEVRANA

SEQ ID NO: 14118 - protein, 7 aa, Artificial Sequence
  Synthetic Construct
ESKPLPA

SEQ ID NO: 14119 - protein, 7 aa, Artificial Sequence
  Synthetic Construct
TLSHNSM

SEQ ID NO: 14120 - protein, 7 aa, Artificial Sequence
  Synthetic Construct
VGSYTVS

SEQ ID NO: 14121 - protein, 7 aa, Artificial Sequence
  Synthetic Construct
QSATSLT

SEQ ID NO: 14122 - protein, 7 aa, Artificial Sequence
  Synthetic Construct
HANGLRD

SEQ ID NO: 14123 - protein, 7 aa, Artificial Sequence
  Synthetic Construct
RMSHDSP

SEQ ID NO: 14124 - protein, 7 aa, Artificial Sequence
  Synthetic Construct
KHSGLES

SEQ ID NO: 14125 - protein, 7 aa, Artificial Sequence
  Synthetic Construct
KLSTAIE

SEQ ID NO: 14126 - protein, 7 aa, Artificial Sequence
  Synthetic Construct
NSKQLLL

SEQ ID NO: 14127 - protein, 7 aa, Artificial Sequence
  Synthetic Construct
SLHNNRV

SEQ ID NO: 14128 - protein, 7 aa, Artificial Sequence
  Synthetic Construct
SADRSIT

SEQ ID NO: 14129 - protein, 7 aa, Artificial Sequence
  Synthetic Construct
PTGRPQE

SEQ ID NO: 14130 - protein, 7 aa, Artificial Sequence
  Synthetic Construct
KTVQEPL

SEQ ID NO: 14131 - protein, 7 aa, Artificial Sequence
  Synthetic Construct
STKALSN

SEQ ID NO: 14132 - protein, 7 aa, Artificial Sequence
  Synthetic Construct
SNQSTRS

SEQ ID NO: 14133 - protein, 7 aa, Artificial Sequence
  Synthetic Construct
GVEGSSR

SEQ ID NO: 14134 - protein, 7 aa, Artificial Sequence
  Synthetic Construct
LHQGPSS

SEQ ID NO: 14135 - protein, 7 aa, Artificial Sequence
  Synthetic Construct
VDSRNVV

SEQ ID NO: 14136 - protein, 7 aa, Artificial Sequence
  Synthetic Construct
LGKQTAL

SEQ ID NO: 14137 - protein, 7 aa, Artificial Sequence
  Synthetic Construct
SGNRTNM

SEQ ID NO: 14138 - protein, 7 aa, Artificial Sequence
  Synthetic Construct
VKGYAST

SEQ ID NO: 14139 - protein, 7 aa, Artificial Sequence
  Synthetic Construct
ASVSSSS

SEQ ID NO: 14140 - protein, 7 aa, Artificial Sequence
  Synthetic Construct
LQLKSGM

SEQ ID NO: 14141 - protein, 7 aa, Artificial Sequence
  Synthetic Construct
DMRASGS

SEQ ID NO: 14142 - protein, 7 aa, Artificial Sequence
  Synthetic Construct
LTATLPY

SEQ ID NO: 14143 - protein, 7 aa, Artificial Sequence
  Synthetic Construct
SNAPNSY

SEQ ID NO: 14144 - protein, 7 aa, Artificial Sequence
  Synthetic Construct
KVESSRA

SEQ ID NO: 14145 - protein, 7 aa, Artificial Sequence
  Synthetic Construct
WSNSTTV

SEQ ID NO: 14146 - protein, 7 aa, Artificial Sequence
  Synthetic Construct
SLIHTRP

SEQ ID NO: 14147 - protein, 7 aa, Artificial Sequence
  Synthetic Construct
TLSSPHN

SEQ ID NO: 14148 - protein, 7 aa, Artificial Sequence
  Synthetic Construct
VPRFNGN

SEQ ID NO: 14149 - protein, 7 aa, Artificial Sequence
  Synthetic Construct
FNHSGSG

SEQ ID NO: 14150 - protein, 7 aa, Artificial Sequence
  Synthetic Construct
WVDTNSK

SEQ ID NO: 14151 - protein, 7 aa, Artificial Sequence
  Synthetic Construct
HSDGSRL

SEQ ID NO: 14152 - protein, 7 aa, Artificial Sequence
  Synthetic Construct
RQAVQTS

SEQ ID NO: 14153 - protein, 7 aa, Artificial Sequence
  Synthetic Construct
MHSGIPT

SEQ ID NO: 14154 - protein, 7 aa, Artificial Sequence
  Synthetic Construct
VKDQGRS

SEQ ID NO: 14155 - protein, 7 aa, Artificial Sequence
  Synthetic Construct
RPTLSNQ

SEQ ID NO: 14156 - protein, 7 aa, Artificial Sequence
  Synthetic Construct
VSKSAAL

SEQ ID NO: 14157 - protein, 7 aa, Artificial Sequence
  Synthetic Construct
KDSHLSS

SEQ ID NO: 14158 - protein, 7 aa, Artificial Sequence
  Synthetic Construct
VGVRMTG

SEQ ID NO: 14159 - protein, 7 aa, Artificial Sequence
  Synthetic Construct
ADRLLNS

SEQ ID NO: 14160 - protein, 7 aa, Artificial Sequence
  Synthetic Construct
GSELRTG

SEQ ID NO: 14161 - protein, 7 aa, Artificial Sequence
  Synthetic Construct
MKLSTSS

SEQ ID NO: 14162 - protein, 7 aa, Artificial Sequence
  Synthetic Construct
QAYNIVP

SEQ ID NO: 14163 - protein, 7 aa, Artificial Sequence
  Synthetic Construct
VGGNIRT

SEQ ID NO: 14164 - protein, 7 aa, Artificial Sequence
  Synthetic Construct
SYQQTLG

SEQ ID NO: 14165 - protein, 7 aa, Artificial Sequence
  Synthetic Construct
MRPTPTD

SEQ ID NO: 14166 - protein, 7 aa, Artificial Sequence
  Synthetic Construct
RKANDLN

SEQ ID NO: 14167 - protein, 7 aa, Artificial Sequence
  Synthetic Construct
ISGTAST

SEQ ID NO: 14168 - protein, 7 aa, Artificial Sequence
  Synthetic Construct
YVQLNNA

SEQ ID NO: 14169 - protein, 7 aa, Artificial Sequence
  Synthetic Construct
TEKGWGP

SEQ ID NO: 14170 - protein, 7 aa, Artificial Sequence
  Synthetic Construct
SPQRHNS

SEQ ID NO: 14171 - protein, 7 aa, Artificial Sequence
  Synthetic Construct
YTHMTER

SEQ ID NO: 14172 - protein, 7 aa, Artificial Sequence
  Synthetic Construct
DRSMQQA

SEQ ID NO: 14173 - protein, 7 aa, Artificial Sequence
  Synthetic Construct
DTMNAMR

SEQ ID NO: 14174 - protein, 7 aa, Artificial Sequence
  Synthetic Construct
LKPGHMV

SEQ ID NO: 14175 - protein, 7 aa, Artificial Sequence
  Synthetic Construct
QFNSKDT

SEQ ID NO: 14176 - protein, 7 aa, Artificial Sequence
  Synthetic Construct
WTNSRPM

SEQ ID NO: 14177 - protein, 7 aa, Artificial Sequence
  Synthetic Construct
LLTTSSE

SEQ ID NO: 14178 - protein, 7 aa, Artificial Sequence
  Synthetic Construct
QRASSGS

SEQ ID NO: 14179 - protein, 7 aa, Artificial Sequence
  Synthetic Construct
PKESNNM

SEQ ID NO: 14180 - protein, 7 aa, Artificial Sequence
  Synthetic Construct
AKHVATE

SEQ ID NO: 14181 - protein, 7 aa, Artificial Sequence
  Synthetic Construct
TQSSTYS

SEQ ID NO: 14182 - protein, 7 aa, Artificial Sequence
  Synthetic Construct
PRTSTNI

SEQ ID NO: 14183 - protein, 7 aa, Artificial Sequence
  Synthetic Construct
RLASNSD

SEQ ID NO: 14184 - protein, 7 aa, Artificial Sequence
  Synthetic Construct
GPLQTNA

SEQ ID NO: 14185 - protein, 7 aa, Artificial Sequence
  Synthetic Construct
KVSAMSD

SEQ ID NO: 14186 - protein, 7 aa, Artificial Sequence
  Synthetic Construct
AGKYVNS

SEQ ID NO: 14187 - protein, 7 aa, Artificial Sequence
  Synthetic Construct
PKSGSPS

SEQ ID NO: 14188 - protein, 7 aa, Artificial Sequence
  Synthetic Construct
FISNGSS

SEQ ID NO: 14189 - protein, 7 aa, Artificial Sequence
  Synthetic Construct
NLNAMHK

SEQ ID NO: 14190 - protein, 7 aa, Artificial Sequence
  Synthetic Construct
ESHAREG

SEQ ID NO: 14191 - protein, 7 aa, Artificial Sequence
  Synthetic Construct
TVVGVRG

SEQ ID NO: 14192 - protein, 7 aa, Artificial Sequence
  Synthetic Construct
AKATVPS

SEQ ID NO: 14193 - protein, 7 aa, Artificial Sequence
  Synthetic Construct
TKTVNMT

SEQ ID NO: 14194 - protein, 7 aa, Artificial Sequence
  Synthetic Construct
QSSLKLT

SEQ ID NO: 14195 - protein, 7 aa, Artificial Sequence
  Synthetic Construct
NAQRTGP

SEQ ID NO: 14196 - protein, 7 aa, Artificial Sequence
  Synthetic Construct
NRRDATP

SEQ ID NO: 14197 - protein, 7 aa, Artificial Sequence
  Synthetic Construct
GNQNTLL

SEQ ID NO: 14198 - protein, 7 aa, Artificial Sequence
  Synthetic Construct
TRVSGSA

SEQ ID NO: 14199 - protein, 7 aa, Artificial Sequence
  Synthetic Construct
VTTAMMS

SEQ ID NO: 14200 - protein, 7 aa, Artificial Sequence
  Synthetic Construct
DRTPIAH

SEQ ID NO: 14201 - protein, 7 aa, Artificial Sequence
  Synthetic Construct
LPLNSRP

SEQ ID NO: 14202 - protein, 7 aa, Artificial Sequence
  Synthetic Construct
PQASQAN

SEQ ID NO: 14203 - protein, 7 aa, Artificial Sequence
  Synthetic Construct
TARNVPN

SEQ ID NO: 14204 - protein, 7 aa, Artificial Sequence
  Synthetic Construct
LNGILSQ

SEQ ID NO: 14205 - protein, 7 aa, Artificial Sequence
  Synthetic Construct
LQDKTLN

SEQ ID NO: 14206 - protein, 7 aa, Artificial Sequence
  Synthetic Construct
YRGENNP

SEQ ID NO: 14207 - protein, 7 aa, Artificial Sequence
  Synthetic Construct
VNKQLNS

SEQ ID NO: 14208 - protein, 7 aa, Artificial Sequence
  Synthetic Construct
VLKDDGH

SEQ ID NO: 14209 - protein, 7 aa, Artificial Sequence
  Synthetic Construct
TRGEVSL

SEQ ID NO: 14210 - protein, 7 aa, Artificial Sequence
  Synthetic Construct
EFQRMHP

SEQ ID NO: 14211 - protein, 7 aa, Artificial Sequence
  Synthetic Construct
ISPMSTS

SEQ ID NO: 14212 - protein, 7 aa, Artificial Sequence
  Synthetic Construct
LGHDHAT

SEQ ID NO: 14213 - protein, 7 aa, Artificial Sequence
  Synthetic Construct
LSPGPQQ

SEQ ID NO: 14214 - protein, 7 aa, Artificial Sequence
  Synthetic Construct
KFRGEEP

SEQ ID NO: 14215 - protein, 7 aa, Artificial Sequence
  Synthetic Construct
QGSRLAS

SEQ ID NO: 14216 - protein, 7 aa, Artificial Sequence
  Synthetic Construct
WERSQLS

SEQ ID NO: 14217 - protein, 7 aa, Artificial Sequence
  Synthetic Construct
QQKAANG

SEQ ID NO: 14218 - protein, 7 aa, Artificial Sequence
  Synthetic Construct
YTLSLSS

SEQ ID NO: 14219 - protein, 7 aa, Artificial Sequence
  Synthetic Construct
GLIPNNS

SEQ ID NO: 14220 - protein, 7 aa, Artificial Sequence
  Synthetic Construct
SVPVSRT

SEQ ID NO: 14221 - protein, 7 aa, Artificial Sequence
  Synthetic Construct
NKQQSQT

SEQ ID NO: 14222 - protein, 7 aa, Artificial Sequence
  Synthetic Construct
SKHSVQV

SEQ ID NO: 14223 - protein, 7 aa, Artificial Sequence
  Synthetic Construct
NRPSQQG

SEQ ID NO: 14224 - protein, 7 aa, Artificial Sequence
  Synthetic Construct
QEYRNTL

SEQ ID NO: 14225 - protein, 7 aa, Artificial Sequence
  Synthetic Construct
FERDRMG

SEQ ID NO: 14226 - protein, 7 aa, Artificial Sequence
  Synthetic Construct
STSSNLS

SEQ ID NO: 14227 - protein, 7 aa, Artificial Sequence
  Synthetic Construct
RSLEGIV

SEQ ID NO: 14228 - protein, 7 aa, Artificial Sequence
  Synthetic Construct
GNSRLDP

SEQ ID NO: 14229 - protein, 7 aa, Artificial Sequence
  Synthetic Construct
IDTIGKA

SEQ ID NO: 14230 - protein, 7 aa, Artificial Sequence
  Synthetic Construct
LDHTSRA

SEQ ID NO: 14231 - protein, 7 aa, Artificial Sequence
  Synthetic Construct
WGQTNSS

SEQ ID NO: 14232 - protein, 7 aa, Artificial Sequence
  Synthetic Construct
ARGNLSS

SEQ ID NO: 14233 - protein, 7 aa, Artificial Sequence
  Synthetic Construct
DNMKLHV

SEQ ID NO: 14234 - protein, 7 aa, Artificial Sequence
  Synthetic Construct
EKTQQSY

SEQ ID NO: 14235 - protein, 7 aa, Artificial Sequence
  Synthetic Construct
SNGLARN

SEQ ID NO: 14236 - protein, 7 aa, Artificial Sequence
  Synthetic Construct
VVSHRPA

SEQ ID NO: 14237 - protein, 7 aa, Artificial Sequence
  Synthetic Construct
SLGVSRN

SEQ ID NO: 14238 - protein, 7 aa, Artificial Sequence
  Synthetic Construct
DHSHGRD

SEQ ID NO: 14239 - protein, 7 aa, Artificial Sequence
  Synthetic Construct
STHQVAN

SEQ ID NO: 14240 - protein, 7 aa, Artificial Sequence
  Synthetic Construct
NQSASSR

SEQ ID NO: 14241 - protein, 7 aa, Artificial Sequence
  Synthetic Construct
VTVGSHM

SEQ ID NO: 14242 - protein, 7 aa, Artificial Sequence
  Synthetic Construct
SSNIAQN

SEQ ID NO: 14243 - protein, 7 aa, Artificial Sequence
  Synthetic Construct
LNEMATP

SEQ ID NO: 14244 - protein, 7 aa, Artificial Sequence
  Synthetic Construct
STKIERD

SEQ ID NO: 14245 - protein, 7 aa, Artificial Sequence
  Synthetic Construct
NLVDARI

SEQ ID NO: 14246 - protein, 7 aa, Artificial Sequence
  Synthetic Construct
YSTGKDA

SEQ ID NO: 14247 - protein, 7 aa, Artificial Sequence
  Synthetic Construct
TQGIVTS

SEQ ID NO: 14248 - protein, 7 aa, Artificial Sequence
  Synthetic Construct
SFGATSL

SEQ ID NO: 14249 - protein, 7 aa, Artificial Sequence
  Synthetic Construct
TAGMSSR

SEQ ID NO: 14250 - protein, 7 aa, Artificial Sequence
  Synthetic Construct
RDNSLIP

SEQ ID NO: 14251 - protein, 7 aa, Artificial Sequence
  Synthetic Construct
KTNADYG

SEQ ID NO: 14252 - protein, 7 aa, Artificial Sequence
  Synthetic Construct
VNPHRTM

SEQ ID NO: 14253 - protein, 7 aa, Artificial Sequence
  Synthetic Construct
DIRGRPT

SEQ ID NO: 14254 - protein, 7 aa, Artificial Sequence
  Synthetic Construct
REVSSTS

SEQ ID NO: 14255 - protein, 7 aa, Artificial Sequence
  Synthetic Construct
VSQGTRV

SEQ ID NO: 14256 - protein, 7 aa, Artificial Sequence
  Synthetic Construct
KTPIMHA

SEQ ID NO: 14257 - protein, 7 aa, Artificial Sequence
  Synthetic Construct
LESRDTV

SEQ ID NO: 14258 - protein, 7 aa, Artificial Sequence
  Synthetic Construct
VLNSSMT

SEQ ID NO: 14259 - protein, 7 aa, Artificial Sequence
  Synthetic Construct
FRTVTQA

SEQ ID NO: 14260 - protein, 7 aa, Artificial Sequence
  Synthetic Construct
TGAMNMT

SEQ ID NO: 14261 - protein, 7 aa, Artificial Sequence
  Synthetic Construct
LKTQNYS

SEQ ID NO: 14262 - protein, 7 aa, Artificial Sequence
  Synthetic Construct
QKTMLTA

SEQ ID NO: 14263 - protein, 7 aa, Artificial Sequence
  Synthetic Construct
SNIIGSD

SEQ ID NO: 14264 - protein, 7 aa, Artificial Sequence
  Synthetic Construct
SVSVSKM

SEQ ID NO: 14265 - protein, 7 aa, Artificial Sequence
  Synthetic Construct
AAQVSHA

SEQ ID NO: 14266 - protein, 7 aa, Artificial Sequence
  Synthetic Construct
INVVEKA

SEQ ID NO: 14267 - protein, 7 aa, Artificial Sequence
  Synthetic Construct
MLRGDLP

SEQ ID NO: 14268 - protein, 7 aa, Artificial Sequence
  Synthetic Construct
NLPTMQP

SEQ ID NO: 14269 - protein, 7 aa, Artificial Sequence
  Synthetic Construct
FQDKINR

SEQ ID NO: 14270 - protein, 7 aa, Artificial Sequence
  Synthetic Construct
SRQTIET

SEQ ID NO: 14271 - protein, 7 aa, Artificial Sequence
  Synthetic Construct
LHSKLNG

SEQ ID NO: 14272 - protein, 7 aa, Artificial Sequence
  Synthetic Construct
TPSASNM

SEQ ID NO: 14273 - protein, 7 aa, Artificial Sequence
  Synthetic Construct
ANTAIRT

SEQ ID NO: 14274 - protein, 7 aa, Artificial Sequence
  Synthetic Construct
SPYNQNN

SEQ ID NO: 14275 - protein, 7 aa, Artificial Sequence
  Synthetic Construct
SGKQQTT

SEQ ID NO: 14276 - protein, 7 aa, Artificial Sequence
  Synthetic Construct
NLPVQGS

SEQ ID NO: 14277 - protein, 7 aa, Artificial Sequence
  Synthetic Construct
PNLTTER

SEQ ID NO: 14278 - protein, 7 aa, Artificial Sequence
  Synthetic Construct
ASLVNTA

SEQ ID NO: 14279 - protein, 7 aa, Artificial Sequence
  Synthetic Construct
STAGDTR

SEQ ID NO: 14280 - protein, 7 aa, Artificial Sequence
  Synthetic Construct
LRDTRTD

SEQ ID NO: 14281 - protein, 7 aa, Artificial Sequence
  Synthetic Construct
LQQAQPQ

SEQ ID NO: 14282 - protein, 7 aa, Artificial Sequence
  Synthetic Construct
YSPHVTP

SEQ ID NO: 14283 - protein, 7 aa, Artificial Sequence
  Synthetic Construct
LQIKTSP

SEQ ID NO: 14284 - protein, 7 aa, Artificial Sequence
  Synthetic Construct
RVPPNLQ

SEQ ID NO: 14285 - protein, 7 aa, Artificial Sequence
  Synthetic Construct
LAEHPKT

SEQ ID NO: 14286 - protein, 7 aa, Artificial Sequence
  Synthetic Construct
IAARSPL

SEQ ID NO: 14287 - protein, 7 aa, Artificial Sequence
  Synthetic Construct
SGKQHED

SEQ ID NO: 14288 - protein, 7 aa, Artificial Sequence
  Synthetic Construct
IGNLQAT

SEQ ID NO: 14289 - protein, 7 aa, Artificial Sequence
  Synthetic Construct
PDASQRV

SEQ ID NO: 14290 - protein, 7 aa, Artificial Sequence
  Synthetic Construct
AVDRMTP

SEQ ID NO: 14291 - protein, 7 aa, Artificial Sequence
  Synthetic Construct
FGREKPA

SEQ ID NO: 14292 - protein, 7 aa, Artificial Sequence
  Synthetic Construct
LNNRPQL

SEQ ID NO: 14293 - protein, 7 aa, Artificial Sequence
  Synthetic Construct
NFHGRTD

SEQ ID NO: 14294 - protein, 7 aa, Artificial Sequence
  Synthetic Construct
GVRLSST

SEQ ID NO: 14295 - protein, 7 aa, Artificial Sequence
  Synthetic Construct
TVNSHRQ

SEQ ID NO: 14296 - protein, 7 aa, Artificial Sequence
  Synthetic Construct
NSNHTPR

SEQ ID NO: 14297 - protein, 7 aa, Artificial Sequence
  Synthetic Construct
ANTITVV

SEQ ID NO: 14298 - protein, 7 aa, Artificial Sequence
  Synthetic Construct
DVTQSKP

SEQ ID NO: 14299 - protein, 7 aa, Artificial Sequence
  Synthetic Construct
GNHARNL

SEQ ID NO: 14300 - protein, 7 aa, Artificial Sequence
  Synthetic Construct
QHRDTSM

SEQ ID NO: 14301 - protein, 7 aa, Artificial Sequence
  Synthetic Construct
LQGRLTS

SEQ ID NO: 14302 - protein, 7 aa, Artificial Sequence
  Synthetic Construct
ISMREQS

SEQ ID NO: 14303 - protein, 7 aa, Artificial Sequence
  Synthetic Construct
TRNFDHT

SEQ ID NO: 14304 - protein, 7 aa, Artificial Sequence
  Synthetic Construct
ASHRAQI

SEQ ID NO: 14305 - protein, 7 aa, Artificial Sequence
  Synthetic Construct
NQQSPHK

SEQ ID NO: 14306 - protein, 7 aa, Artificial Sequence
  Synthetic Construct
RPGESNP

SEQ ID NO: 14307 - protein, 7 aa, Artificial Sequence
  Synthetic Construct
ARDSSIM

SEQ ID NO: 14308 - protein, 7 aa, Artificial Sequence
  Synthetic Construct
TGMSTQV

SEQ ID NO: 14309 - protein, 7 aa, Artificial Sequence
  Synthetic Construct
MGVKADI

SEQ ID NO: 14310 - protein, 7 aa, Artificial Sequence
  Synthetic Construct
QFKGITQ

SEQ ID NO: 14311 - protein, 7 aa, Artificial Sequence
  Synthetic Construct
HNNSPTH

SEQ ID NO: 14312 - protein, 7 aa, Artificial Sequence
  Synthetic Construct
DSNFTSA

SEQ ID NO: 14313 - protein, 7 aa, Artificial Sequence
  Synthetic Construct
AVPHMGT

SEQ ID NO: 14314 - protein, 7 aa, Artificial Sequence
  Synthetic Construct
VVSPNLM

SEQ ID NO: 14315 - protein, 7 aa, Artificial Sequence
  Synthetic Construct
PFPKTLD

SEQ ID NO: 14316 - protein, 7 aa, Artificial Sequence
  Synthetic Construct
QSAGLAE

SEQ ID NO: 14317 - protein, 7 aa, Artificial Sequence
  Synthetic Construct
GKAHDLA

SEQ ID NO: 14318 - protein, 7 aa, Artificial Sequence
  Synthetic Construct
QRISTNA

SEQ ID NO: 14319 - protein, 7 aa, Artificial Sequence
  Synthetic Construct
WLTTGSS

SEQ ID NO: 14320 - protein, 7 aa, Artificial Sequence
  Synthetic Construct
YRAQGPL

SEQ ID NO: 14321 - protein, 7 aa, Artificial Sequence
  Synthetic Construct
VMKRYDE

SEQ ID NO: 14322 - protein, 7 aa, Artificial Sequence
  Synthetic Construct
LEYSQRD

SEQ ID NO: 14323 - protein, 7 aa, Artificial Sequence
  Synthetic Construct
LQKVHLG

SEQ ID NO: 14324 - protein, 7 aa, Artificial Sequence
  Synthetic Construct
RSHSHPS

SEQ ID NO: 14325 - protein, 7 aa, Artificial Sequence
  Synthetic Construct
HTFTSTG

SEQ ID NO: 14326 - protein, 7 aa, Artificial Sequence
  Synthetic Construct
SVGSGPG

SEQ ID NO: 14327 - protein, 7 aa, Artificial Sequence
  Synthetic Construct
QSFNGSN

SEQ ID NO: 14328 - protein, 7 aa, Artificial Sequence
  Synthetic Construct
VTAIRGA

SEQ ID NO: 14329 - protein, 7 aa, Artificial Sequence
  Synthetic Construct
LGKTSYS

SEQ ID NO: 14330 - protein, 7 aa, Artificial Sequence
  Synthetic Construct
STMAMAS

SEQ ID NO: 14331 - protein, 7 aa, Artificial Sequence
  Synthetic Construct
ASGRSSA

SEQ ID NO: 14332 - protein, 7 aa, Artificial Sequence
  Synthetic Construct
GRTPAVE

SEQ ID NO: 14333 - protein, 7 aa, Artificial Sequence
  Synthetic Construct
GRIDVSS

SEQ ID NO: 14334 - protein, 7 aa, Artificial Sequence
  Synthetic Construct
TPKVNSS

SEQ ID NO: 14335 - protein, 7 aa, Artificial Sequence
  Synthetic Construct
SVRNSTT

SEQ ID NO: 14336 - protein, 7 aa, Artificial Sequence
  Synthetic Construct
VNGAQQI

SEQ ID NO: 14337 - protein, 7 aa, Artificial Sequence
  Synthetic Construct
NRAESFR

SEQ ID NO: 14338 - protein, 7 aa, Artificial Sequence
  Synthetic Construct
HDRASVR

SEQ ID NO: 14339 - protein, 7 aa, Artificial Sequence
  Synthetic Construct
DSPSRGR

SEQ ID NO: 14340 - protein, 7 aa, Artificial Sequence
  Synthetic Construct
SNNIHSK

SEQ ID NO: 14341 - protein, 7 aa, Artificial Sequence
  Synthetic Construct
INNIVIP

SEQ ID NO: 14342 - protein, 7 aa, Artificial Sequence
  Synthetic Construct
IRSSDET

SEQ ID NO: 14343 - protein, 7 aa, Artificial Sequence
  Synthetic Construct
NMPSLVA

SEQ ID NO: 14344 - protein, 7 aa, Artificial Sequence
  Synthetic Construct
NRTLESI

SEQ ID NO: 14345 - protein, 7 aa, Artificial Sequence
  Synthetic Construct
PQHNNQP

SEQ ID NO: 14346 - protein, 7 aa, Artificial Sequence
  Synthetic Construct
LGYNAHP

SEQ ID NO: 14347 - protein, 7 aa, Artificial Sequence
  Synthetic Construct
LKHQYDG

SEQ ID NO: 14348 - protein, 7 aa, Artificial Sequence
  Synthetic Construct
HYSPTRE

SEQ ID NO: 14349 - protein, 7 aa, Artificial Sequence
  Synthetic Construct
SYRSTSD

SEQ ID NO: 14350 - protein, 7 aa, Artificial Sequence
  Synthetic Construct
VTPTAAL

SEQ ID NO: 14351 - protein, 7 aa, Artificial Sequence
  Synthetic Construct
LEQRYSS

SEQ ID NO: 14352 - protein, 7 aa, Artificial Sequence
  Synthetic Construct
MNNIRQS

SEQ ID NO: 14353 - protein, 7 aa, Artificial Sequence
  Synthetic Construct
SSRNDAS

SEQ ID NO: 14354 - protein, 7 aa, Artificial Sequence
  Synthetic Construct
GTDRKPF

SEQ ID NO: 14355 - protein, 7 aa, Artificial Sequence
  Synthetic Construct
RVNKEDR

SEQ ID NO: 14356 - protein, 7 aa, Artificial Sequence
  Synthetic Construct
TGRSLAT

SEQ ID NO: 14357 - protein, 7 aa, Artificial Sequence
  Synthetic Construct
MKSSTSN

SEQ ID NO: 14358 - protein, 7 aa, Artificial Sequence
  Synthetic Construct
RHDLASN

SEQ ID NO: 14359 - protein, 7 aa, Artificial Sequence
  Synthetic Construct
LMAVSTP

SEQ ID NO: 14360 - protein, 7 aa, Artificial Sequence
  Synthetic Construct
REGIYTL

SEQ ID NO: 14361 - protein, 7 aa, Artificial Sequence
  Synthetic Construct
DNKGSLS

SEQ ID NO: 14362 - protein, 7 aa, Artificial Sequence
  Synthetic Construct
KGQVTHG

SEQ ID NO: 14363 - protein, 7 aa, Artificial Sequence
  Synthetic Construct
SKTLNNL

SEQ ID NO: 14364 - protein, 7 aa, Artificial Sequence
  Synthetic Construct
RNPQVPT

SEQ ID NO: 14365 - protein, 7 aa, Artificial Sequence
  Synthetic Construct
SANASNT

SEQ ID NO: 14366 - protein, 7 aa, Artificial Sequence
  Synthetic Construct
GYMKPAI

SEQ ID NO: 14367 - protein, 7 aa, Artificial Sequence
  Synthetic Construct
SSHGPTP

SEQ ID NO: 14368 - protein, 7 aa, Artificial Sequence
  Synthetic Construct
STRNPPQ

SEQ ID NO: 14369 - protein, 7 aa, Artificial Sequence
  Synthetic Construct
LNRINEQ

SEQ ID NO: 14370 - protein, 7 aa, Artificial Sequence
  Synthetic Construct
GAAKSQN

SEQ ID NO: 14371 - protein, 7 aa, Artificial Sequence
  Synthetic Construct
LPTLHGP

SEQ ID NO: 14372 - protein, 7 aa, Artificial Sequence
  Synthetic Construct
VPSTIKG

SEQ ID NO: 14373 - protein, 7 aa, Artificial Sequence
  Synthetic Construct
TSSMRES

SEQ ID NO: 14374 - protein, 7 aa, Artificial Sequence
  Synthetic Construct
LMSSNNA

SEQ ID NO: 14375 - protein, 7 aa, Artificial Sequence
  Synthetic Construct
AKTQSAT

SEQ ID NO: 14376 - protein, 7 aa, Artificial Sequence
  Synthetic Construct
KEGQSRY

SEQ ID NO: 14377 - protein, 7 aa, Artificial Sequence
  Synthetic Construct
KVNSSAT

SEQ ID NO: 14378 - protein, 7 aa, Artificial Sequence
  Synthetic Construct
RTTSLVA

SEQ ID NO: 14379 - protein, 7 aa, Artificial Sequence
  Synthetic Construct
MTNQSAH

SEQ ID NO: 14380 - protein, 7 aa, Artificial Sequence
  Synthetic Construct
PHIRGEN

SEQ ID NO: 14381 - protein, 7 aa, Artificial Sequence
  Synthetic Construct
RTQSSIS

SEQ ID NO: 14382 - protein, 7 aa, Artificial Sequence
  Synthetic Construct
MFTTTGA

SEQ ID NO: 14383 - protein, 7 aa, Artificial Sequence
  Synthetic Construct
SNIKLMA

SEQ ID NO: 14384 - protein, 7 aa, Artificial Sequence
  Synthetic Construct
STQGTRD

SEQ ID NO: 14385 - protein, 7 aa, Artificial Sequence
  Synthetic Construct
ILSGRNG

SEQ ID NO: 14386 - protein, 7 aa, Artificial Sequence
  Synthetic Construct
GLKVSGS

SEQ ID NO: 14387 - protein, 7 aa, Artificial Sequence
  Synthetic Construct
TGANLPN

SEQ ID NO: 14388 - protein, 7 aa, Artificial Sequence
  Synthetic Construct
YSLSMPN

SEQ ID NO: 14389 - protein, 7 aa, Artificial Sequence
  Synthetic Construct
TFERKAA

SEQ ID NO: 14390 - protein, 7 aa, Artificial Sequence
  Synthetic Construct
LGRASSV

SEQ ID NO: 14391 - protein, 7 aa, Artificial Sequence
  Synthetic Construct
RTKTSDG

SEQ ID NO: 14392 - protein, 7 aa, Artificial Sequence
  Synthetic Construct
LNPHLGP

SEQ ID NO: 14393 - protein, 7 aa, Artificial Sequence
  Synthetic Construct
IMPNNTM

SEQ ID NO: 14394 - protein, 7 aa, Artificial Sequence
  Synthetic Construct
HKSDSGY

SEQ ID NO: 14395 - protein, 7 aa, Artificial Sequence
  Synthetic Construct
DRLNKNS

SEQ ID NO: 14396 - protein, 7 aa, Artificial Sequence
  Synthetic Construct
MSGGSSK

SEQ ID NO: 14397 - protein, 7 aa, Artificial Sequence
  Synthetic Construct
QREQGNA

SEQ ID NO: 14398 - protein, 7 aa, Artificial Sequence
  Synthetic Construct
GGGNVTS

SEQ ID NO: 14399 - protein, 7 aa, Artificial Sequence
  Synthetic Construct
NLKNAYV

SEQ ID NO: 14400 - protein, 7 aa, Artificial Sequence
  Synthetic Construct
SKNDRPG

SEQ ID NO: 14401 - protein, 7 aa, Artificial Sequence
  Synthetic Construct
RGSGQDI

SEQ ID NO: 14402 - protein, 7 aa, Artificial Sequence
  Synthetic Construct
VGSNTSY

SEQ ID NO: 14403 - protein, 7 aa, Artificial Sequence
  Synthetic Construct
SPRIGST

SEQ ID NO: 14404 - protein, 7 aa, Artificial Sequence
  Synthetic Construct
GTLKETS

SEQ ID NO: 14405 - protein, 7 aa, Artificial Sequence
  Synthetic Construct
SIQRTVA

SEQ ID NO: 14406 - protein, 7 aa, Artificial Sequence
  Synthetic Construct
RGESNGT

SEQ ID NO: 14407 - protein, 7 aa, Artificial Sequence
  Synthetic Construct
EPSNARV

SEQ ID NO: 14408 - protein, 7 aa, Artificial Sequence
  Synthetic Construct
SQATMNK

SEQ ID NO: 14409 - protein, 7 aa, Artificial Sequence
  Synthetic Construct
AQGTSTT

SEQ ID NO: 14410 - protein, 7 aa, Artificial Sequence
  Synthetic Construct
YMSKNNL

SEQ ID NO: 14411 - protein, 7 aa, Artificial Sequence
  Synthetic Construct
NTTNMSK

SEQ ID NO: 14412 - protein, 7 aa, Artificial Sequence
  Synthetic Construct
SKASKTE

SEQ ID NO: 14413 - protein, 7 aa, Artificial Sequence
  Synthetic Construct
MAGSIVT

SEQ ID NO: 14414 - protein, 7 aa, Artificial Sequence
  Synthetic Construct
VNSSQTP

SEQ ID NO: 14415 - protein, 7 aa, Artificial Sequence
  Synthetic Construct
TRSALLD

SEQ ID NO: 14416 - protein, 7 aa, Artificial Sequence
  Synthetic Construct
GISYSPS

SEQ ID NO: 14417 - protein, 7 aa, Artificial Sequence
  Synthetic Construct
HGREVPQ

SEQ ID NO: 14418 - protein, 7 aa, Artificial Sequence
  Synthetic Construct
TRSADNR

SEQ ID NO: 14419 - protein, 7 aa, Artificial Sequence
  Synthetic Construct
SGNSSRG

SEQ ID NO: 14420 - protein, 7 aa, Artificial Sequence
  Synthetic Construct
TTKGNPS

SEQ ID NO: 14421 - protein, 7 aa, Artificial Sequence
  Synthetic Construct
DMRSTRD

SEQ ID NO: 14422 - protein, 7 aa, Artificial Sequence
  Synthetic Construct
LGNSLPA

SEQ ID NO: 14423 - protein, 7 aa, Artificial Sequence
  Synthetic Construct
LTSMSIP

SEQ ID NO: 14424 - protein, 7 aa, Artificial Sequence
  Synthetic Construct
GTHIKQA

SEQ ID NO: 14425 - protein, 7 aa, Artificial Sequence
  Synthetic Construct
TQGRIVS

SEQ ID NO: 14426 - protein, 7 aa, Artificial Sequence
  Synthetic Construct
LGGNNTL

SEQ ID NO: 14427 - protein, 7 aa, Artificial Sequence
  Synthetic Construct
MSANNGR

SEQ ID NO: 14428 - protein, 7 aa, Artificial Sequence
  Synthetic Construct
VTNPMSA

SEQ ID NO: 14429 - protein, 7 aa, Artificial Sequence
  Synthetic Construct
EAYKSTS

SEQ ID NO: 14430 - protein, 7 aa, Artificial Sequence
  Synthetic Construct
RPNNQGQ

SEQ ID NO: 14431 - protein, 7 aa, Artificial Sequence
  Synthetic Construct
MNFAGSG

SEQ ID NO: 14432 - protein, 7 aa, Artificial Sequence
  Synthetic Construct
KTNHSSS

SEQ ID NO: 14433 - protein, 7 aa, Artificial Sequence
  Synthetic Construct
NGYGSQT

SEQ ID NO: 14434 - protein, 7 aa, Artificial Sequence
  Synthetic Construct
KTGHQFT

SEQ ID NO: 14435 - protein, 7 aa, Artificial Sequence
  Synthetic Construct
TARTLQL

SEQ ID NO: 14436 - protein, 7 aa, Artificial Sequence
  Synthetic Construct
QASTTQI

SEQ ID NO: 14437 - protein, 7 aa, Artificial Sequence
  Synthetic Construct
TAFDTRG

SEQ ID NO: 14438 - protein, 7 aa, Artificial Sequence
  Synthetic Construct
VNSHVAR

SEQ ID NO: 14439 - protein, 7 aa, Artificial Sequence
  Synthetic Construct
SPLHSNT

SEQ ID NO: 14440 - protein, 7 aa, Artificial Sequence
  Synthetic Construct
LSRVTIN

SEQ ID NO: 14441 - protein, 7 aa, Artificial Sequence
  Synthetic Construct
TQHNVDS

SEQ ID NO: 14442 - protein, 7 aa, Artificial Sequence
  Synthetic Construct
TFQTSNS

SEQ ID NO: 14443 - protein, 7 aa, Artificial Sequence
  Synthetic Construct
SNHVSVN

SEQ ID NO: 14444 - protein, 7 aa, Artificial Sequence
  Synthetic Construct
MLHSSIT

SEQ ID NO: 14445 - protein, 7 aa, Artificial Sequence
  Synthetic Construct
LKATDGS

SEQ ID NO: 14446 - protein, 7 aa, Artificial Sequence
  Synthetic Construct
LGNMHNM

SEQ ID NO: 14447 - protein, 7 aa, Artificial Sequence
  Synthetic Construct
INRLISG

SEQ ID NO: 14448 - protein, 7 aa, Artificial Sequence
  Synthetic Construct
TRSNLAS

SEQ ID NO: 14449 - protein, 7 aa, Artificial Sequence
  Synthetic Construct
HSNGVRG

SEQ ID NO: 14450 - protein, 7 aa, Artificial Sequence
  Synthetic Construct
AGNPREK

SEQ ID NO: 14451 - protein, 7 aa, Artificial Sequence
  Synthetic Construct
RARDVDE

SEQ ID NO: 14452 - protein, 7 aa, Artificial Sequence
  Synthetic Construct
VSNGPSL

SEQ ID NO: 14453 - protein, 7 aa, Artificial Sequence
  Synthetic Construct
ANQRGVG

SEQ ID NO: 14454 - protein, 7 aa, Artificial Sequence
  Synthetic Construct
MRSETLN

SEQ ID NO: 14455 - protein, 7 aa, Artificial Sequence
  Synthetic Construct
KPSSQLL

SEQ ID NO: 14456 - protein, 7 aa, Artificial Sequence
  Synthetic Construct
SLRPHDR

SEQ ID NO: 14457 - protein, 7 aa, Artificial Sequence
  Synthetic Construct
GSNASKY

SEQ ID NO: 14458 - protein, 7 aa, Artificial Sequence
  Synthetic Construct
TNRDLGP

SEQ ID NO: 14459 - protein, 7 aa, Artificial Sequence
  Synthetic Construct
WGSTAGA

SEQ ID NO: 14460 - protein, 7 aa, Artificial Sequence
  Synthetic Construct
ISGADRT

SEQ ID NO: 14461 - protein, 7 aa, Artificial Sequence
  Synthetic Construct
SAVRSPI

SEQ ID NO: 14462 - protein, 7 aa, Artificial Sequence
  Synthetic Construct
RVSHTET

SEQ ID NO: 14463 - protein, 7 aa, Artificial Sequence
  Synthetic Construct
KANSQIT

SEQ ID NO: 14464 - protein, 7 aa, Artificial Sequence
  Synthetic Construct
PSVYREP

SEQ ID NO: 14465 - protein, 7 aa, Artificial Sequence
  Synthetic Construct
TTNFVTS

SEQ ID NO: 14466 - protein, 7 aa, Artificial Sequence
  Synthetic Construct
NLMPTDR

SEQ ID NO: 14467 - protein, 7 aa, Artificial Sequence
  Synthetic Construct
TNHTGSQ

SEQ ID NO: 14468 - protein, 7 aa, Artificial Sequence
  Synthetic Construct
HWNGTNP

SEQ ID NO: 14469 - protein, 7 aa, Artificial Sequence
  Synthetic Construct
HKSIGQE

SEQ ID NO: 14470 - protein, 7 aa, Artificial Sequence
  Synthetic Construct
TRPIPIS

SEQ ID NO: 14471 - protein, 7 aa, Artificial Sequence
  Synthetic Construct
NPGMSRM

SEQ ID NO: 14472 - protein, 7 aa, Artificial Sequence
  Synthetic Construct
IANRVSP

SEQ ID NO: 14473 - protein, 7 aa, Artificial Sequence
  Synthetic Construct
TALANQK

SEQ ID NO: 14474 - protein, 7 aa, Artificial Sequence
  Synthetic Construct
TSLSSSA

SEQ ID NO: 14475 - protein, 7 aa, Artificial Sequence
  Synthetic Construct
ALTGNMS

SEQ ID NO: 14476 - protein, 7 aa, Artificial Sequence
  Synthetic Construct
MQTKNVP

SEQ ID NO: 14477 - protein, 7 aa, Artificial Sequence
  Synthetic Construct
QATKTNV

SEQ ID NO: 14478 - protein, 7 aa, Artificial Sequence
  Synthetic Construct
LHTTSSV

SEQ ID NO: 14479 - protein, 7 aa, Artificial Sequence
  Synthetic Construct
YVQSSSN

SEQ ID NO: 14480 - protein, 7 aa, Artificial Sequence
  Synthetic Construct
TMKIRTE

SEQ ID NO: 14481 - protein, 7 aa, Artificial Sequence
  Synthetic Construct
KSHSPGS

SEQ ID NO: 14482 - protein, 7 aa, Artificial Sequence
  Synthetic Construct
KAVDPPN

SEQ ID NO: 14483 - protein, 7 aa, Artificial Sequence
  Synthetic Construct
NAPPMSP

SEQ ID NO: 14484 - protein, 7 aa, Artificial Sequence
  Synthetic Construct
INKMFTP

SEQ ID NO: 14485 - protein, 7 aa, Artificial Sequence
  Synthetic Construct
YAKATLG

SEQ ID NO: 14486 - protein, 7 aa, Artificial Sequence
  Synthetic Construct
HLARPSE

SEQ ID NO: 14487 - protein, 7 aa, Artificial Sequence
  Synthetic Construct
QLNSDRN

SEQ ID NO: 14488 - protein, 7 aa, Artificial Sequence
  Synthetic Construct
MRPDTSY

SEQ ID NO: 14489 - protein, 7 aa, Artificial Sequence
  Synthetic Construct
GVAMSSG

SEQ ID NO: 14490 - protein, 7 aa, Artificial Sequence
  Synthetic Construct
GHSRPDR

SEQ ID NO: 14491 - protein, 7 aa, Artificial Sequence
  Synthetic Construct
VFQATRT

SEQ ID NO: 14492 - protein, 7 aa, Artificial Sequence
  Synthetic Construct
TSLTSYT

SEQ ID NO: 14493 - protein, 7 aa, Artificial Sequence
  Synthetic Construct
KLNTGDI

SEQ ID NO: 14494 - protein, 7 aa, Artificial Sequence
  Synthetic Construct
RTNETIV

SEQ ID NO: 14495 - protein, 7 aa, Artificial Sequence
  Synthetic Construct
RLQNSTP

SEQ ID NO: 14496 - protein, 7 aa, Artificial Sequence
  Synthetic Construct
TSRLTSG

SEQ ID NO: 14497 - protein, 7 aa, Artificial Sequence
  Synthetic Construct
SNTTFSA

SEQ ID NO: 14498 - protein, 7 aa, Artificial Sequence
  Synthetic Construct
DQRSSPA

SEQ ID NO: 14499 - protein, 7 aa, Artificial Sequence
  Synthetic Construct
VGSGGSR

SEQ ID NO: 14500 - protein, 7 aa, Artificial Sequence
  Synthetic Construct
RSTNAPN

SEQ ID NO: 14501 - protein, 7 aa, Artificial Sequence
  Synthetic Construct
MAGQQRL

SEQ ID NO: 14502 - protein, 7 aa, Artificial Sequence
  Synthetic Construct
IRNSAPP

SEQ ID NO: 14503 - protein, 7 aa, Artificial Sequence
  Synthetic Construct
LSTKSFN

SEQ ID NO: 14504 - protein, 7 aa, Artificial Sequence
  Synthetic Construct
WPGSITA

SEQ ID NO: 14505 - protein, 7 aa, Artificial Sequence
  Synthetic Construct
TGGVHAQ

SEQ ID NO: 14506 - protein, 7 aa, Artificial Sequence
  Synthetic Construct
SERSSMA

SEQ ID NO: 14507 - protein, 7 aa, Artificial Sequence
  Synthetic Construct
FQNGRNN

SEQ ID NO: 14508 - protein, 7 aa, Artificial Sequence
  Synthetic Construct
GGSRLPQ

SEQ ID NO: 14509 - protein, 7 aa, Artificial Sequence
  Synthetic Construct
GGNSLSV

SEQ ID NO: 14510 - protein, 7 aa, Artificial Sequence
  Synthetic Construct
SKKIDHG

SEQ ID NO: 14511 - protein, 7 aa, Artificial Sequence
  Synthetic Construct
YRDTLAA

SEQ ID NO: 14512 - protein, 7 aa, Artificial Sequence
  Synthetic Construct
LHSGERN

SEQ ID NO: 14513 - protein, 7 aa, Artificial Sequence
  Synthetic Construct
IMPHGSP

SEQ ID NO: 14514 - protein, 7 aa, Artificial Sequence
  Synthetic Construct
TARTLNM

SEQ ID NO: 14515 - protein, 7 aa, Artificial Sequence
  Synthetic Construct
ASVQGHS

SEQ ID NO: 14516 - protein, 7 aa, Artificial Sequence
  Synthetic Construct
LNNAGRA

SEQ ID NO: 14517 - protein, 7 aa, Artificial Sequence
  Synthetic Construct
GLRGSHA

SEQ ID NO: 14518 - protein, 7 aa, Artificial Sequence
  Synthetic Construct
FVRDSYS

SEQ ID NO: 14519 - protein, 7 aa, Artificial Sequence
  Synthetic Construct
GRFTGTE

SEQ ID NO: 14520 - protein, 7 aa, Artificial Sequence
  Synthetic Construct
RQNPIEL

SEQ ID NO: 14521 - protein, 7 aa, Artificial Sequence
  Synthetic Construct
VRDKFGT

SEQ ID NO: 14522 - protein, 7 aa, Artificial Sequence
  Synthetic Construct
LPSNSNR

SEQ ID NO: 14523 - protein, 7 aa, Artificial Sequence
  Synthetic Construct
VRQEHTS

SEQ ID NO: 14524 - protein, 7 aa, Artificial Sequence
  Synthetic Construct
IRQGPTN

SEQ ID NO: 14525 - protein, 7 aa, Artificial Sequence
  Synthetic Construct
DYSKSNT

SEQ ID NO: 14526 - protein, 7 aa, Artificial Sequence
  Synthetic Construct
MSNVNVS

SEQ ID NO: 14527 - protein, 7 aa, Artificial Sequence
  Synthetic Construct
MSSGRSL

SEQ ID NO: 14528 - protein, 7 aa, Artificial Sequence
  Synthetic Construct
GLRDIRA

SEQ ID NO: 14529 - protein, 7 aa, Artificial Sequence
  Synthetic Construct
LISAHKG

SEQ ID NO: 14530 - protein, 7 aa, Artificial Sequence
  Synthetic Construct
PINTHAA

SEQ ID NO: 14531 - protein, 7 aa, Artificial Sequence
  Synthetic Construct
MPHVGNA

SEQ ID NO: 14532 - protein, 7 aa, Artificial Sequence
  Synthetic Construct
YGSSAIN

SEQ ID NO: 14533 - protein, 7 aa, Artificial Sequence
  Synthetic Construct
HASMPSS

SEQ ID NO: 14534 - protein, 7 aa, Artificial Sequence
  Synthetic Construct
FGENARF

SEQ ID NO: 14535 - protein, 7 aa, Artificial Sequence
  Synthetic Construct
SRHDLPS

SEQ ID NO: 14536 - protein, 7 aa, Artificial Sequence
  Synthetic Construct
RSQGANM

SEQ ID NO: 14537 - protein, 7 aa, Artificial Sequence
  Synthetic Construct
ANSNSHS

SEQ ID NO: 14538 - protein, 7 aa, Artificial Sequence
  Synthetic Construct
QARQNQG

SEQ ID NO: 14539 - protein, 7 aa, Artificial Sequence
  Synthetic Construct
GVASNTT

SEQ ID NO: 14540 - protein, 7 aa, Artificial Sequence
  Synthetic Construct
KYSSSQS

SEQ ID NO: 14541 - protein, 7 aa, Artificial Sequence
  Synthetic Construct
SAKTLNT

SEQ ID NO: 14542 - protein, 7 aa, Artificial Sequence
  Synthetic Construct
GIRTTNA

SEQ ID NO: 14543 - protein, 7 aa, Artificial Sequence
  Synthetic Construct
MNTTINR

SEQ ID NO: 14544 - protein, 7 aa, Artificial Sequence
  Synthetic Construct
LKNTSLP

SEQ ID NO: 14545 - protein, 7 aa, Artificial Sequence
  Synthetic Construct
TNRAATM

SEQ ID NO: 14546 - protein, 7 aa, Artificial Sequence
  Synthetic Construct
HGYPNVP

SEQ ID NO: 14547 - protein, 7 aa, Artificial Sequence
  Synthetic Construct
WGYRGAE

SEQ ID NO: 14548 - protein, 7 aa, Artificial Sequence
  Synthetic Construct
LLVTNTS

SEQ ID NO: 14549 - protein, 7 aa, Artificial Sequence
  Synthetic Construct
KNRLPPD

SEQ ID NO: 14550 - protein, 7 aa, Artificial Sequence
  Synthetic Construct
YRSQEHP

SEQ ID NO: 14551 - protein, 7 aa, Artificial Sequence
  Synthetic Construct
HGGRVSP

SEQ ID NO: 14552 - protein, 7 aa, Artificial Sequence
  Synthetic Construct
GQNRLAS

SEQ ID NO: 14553 - protein, 7 aa, Artificial Sequence
  Synthetic Construct
QSVSATR

SEQ ID NO: 14554 - protein, 7 aa, Artificial Sequence
  Synthetic Construct
QRPIPQA

SEQ ID NO: 14555 - protein, 7 aa, Artificial Sequence
  Synthetic Construct
QRAIGIE

SEQ ID NO: 14556 - protein, 7 aa, Artificial Sequence
  Synthetic Construct
FGHVGIN

SEQ ID NO: 14557 - protein, 7 aa, Artificial Sequence
  Synthetic Construct
FEHVRSE

SEQ ID NO: 14558 - protein, 7 aa, Artificial Sequence
  Synthetic Construct
KSVTSNT

SEQ ID NO: 14559 - protein, 7 aa, Artificial Sequence
  Synthetic Construct
LTGNVTA

SEQ ID NO: 14560 - protein, 7 aa, Artificial Sequence
  Synthetic Construct
NHAYPSA

SEQ ID NO: 14561 - protein, 7 aa, Artificial Sequence
  Synthetic Construct
MPQGKSV

SEQ ID NO: 14562 - protein, 7 aa, Artificial Sequence
  Synthetic Construct
LRTAATS

SEQ ID NO: 14563 - protein, 7 aa, Artificial Sequence
  Synthetic Construct
DSQHRVS

SEQ ID NO: 14564 - protein, 7 aa, Artificial Sequence
  Synthetic Construct
FLNEHTV

SEQ ID NO: 14565 - protein, 7 aa, Artificial Sequence
  Synthetic Construct
NSTGTSM

SEQ ID NO: 14566 - protein, 7 aa, Artificial Sequence
  Synthetic Construct
HSPPMSA

SEQ ID NO: 14567 - protein, 7 aa, Artificial Sequence
  Synthetic Construct
LMSQRPT

SEQ ID NO: 14568 - protein, 7 aa, Artificial Sequence
  Synthetic Construct
NTNVNPP

SEQ ID NO: 14569 - protein, 7 aa, Artificial Sequence
  Synthetic Construct
WGGYSSA

SEQ ID NO: 14570 - protein, 7 aa, Artificial Sequence
  Synthetic Construct
YSLNPSG

SEQ ID NO: 14571 - protein, 7 aa, Artificial Sequence
  Synthetic Construct
KESKDRV

SEQ ID NO: 14572 - protein, 7 aa, Artificial Sequence
  Synthetic Construct
KLVSSPD

SEQ ID NO: 14573 - protein, 7 aa, Artificial Sequence
  Synthetic Construct
NTASHNA

SEQ ID NO: 14574 - protein, 7 aa, Artificial Sequence
  Synthetic Construct
DMSNKTY

SEQ ID NO: 14575 - protein, 7 aa, Artificial Sequence
  Synthetic Construct
LVHKDFP

SEQ ID NO: 14576 - protein, 7 aa, Artificial Sequence
  Synthetic Construct
KPALAQN

SEQ ID NO: 14577 - protein, 7 aa, Artificial Sequence
  Synthetic Construct
GNAQPSK

SEQ ID NO: 14578 - protein, 7 aa, Artificial Sequence
  Synthetic Construct
RVAHTEN

SEQ ID NO: 14579 - protein, 7 aa, Artificial Sequence
  Synthetic Construct
VSASFMA

SEQ ID NO: 14580 - protein, 7 aa, Artificial Sequence
  Synthetic Construct
RVLTADA

SEQ ID NO: 14581 - protein, 7 aa, Artificial Sequence
  Synthetic Construct
TVVGTKQ

SEQ ID NO: 14582 - protein, 7 aa, Artificial Sequence
  Synthetic Construct
LARTQPS

SEQ ID NO: 14583 - protein, 7 aa, Artificial Sequence
  Synthetic Construct
MSSSHSA

SEQ ID NO: 14584 - protein, 7 aa, Artificial Sequence
  Synthetic Construct
PSSKSPS

SEQ ID NO: 14585 - protein, 7 aa, Artificial Sequence
  Synthetic Construct
YSGAMSV

SEQ ID NO: 14586 - protein, 7 aa, Artificial Sequence
  Synthetic Construct
PPPTKSY

SEQ ID NO: 14587 - protein, 7 aa, Artificial Sequence
  Synthetic Construct
SAPHATT

SEQ ID NO: 14588 - protein, 7 aa, Artificial Sequence
  Synthetic Construct
ASKPMVA

SEQ ID NO: 14589 - protein, 7 aa, Artificial Sequence
  Synthetic Construct
TLTYGDR

SEQ ID NO: 14590 - protein, 7 aa, Artificial Sequence
  Synthetic Construct
ARSDSKD

SEQ ID NO: 14591 - protein, 7 aa, Artificial Sequence
  Synthetic Construct
MSKAASL

SEQ ID NO: 14592 - protein, 7 aa, Artificial Sequence
  Synthetic Construct
STHTSAV

SEQ ID NO: 14593 - protein, 7 aa, Artificial Sequence
  Synthetic Construct
TARLQDG

SEQ ID NO: 14594 - protein, 7 aa, Artificial Sequence
  Synthetic Construct
RPVLGQP

SEQ ID NO: 14595 - protein, 7 aa, Artificial Sequence
  Synthetic Construct
ASFKTEV

SEQ ID NO: 14596 - protein, 7 aa, Artificial Sequence
  Synthetic Construct
VTRTVNA

SEQ ID NO: 14597 - protein, 7 aa, Artificial Sequence
  Synthetic Construct
DHARSGG

SEQ ID NO: 14598 - protein, 7 aa, Artificial Sequence
  Synthetic Construct
TTHLTVS

SEQ ID NO: 14599 - protein, 7 aa, Artificial Sequence
  Synthetic Construct
VPKSNGT

SEQ ID NO: 14600 - protein, 7 aa, Artificial Sequence
  Synthetic Construct
RLGVGPE

SEQ ID NO: 14601 - protein, 7 aa, Artificial Sequence
  Synthetic Construct
NNRQTSD

SEQ ID NO: 14602 - protein, 7 aa, Artificial Sequence
  Synthetic Construct
RFTNNEA

SEQ ID NO: 14603 - protein, 7 aa, Artificial Sequence
  Synthetic Construct
SSHQMRG

SEQ ID NO: 14604 - protein, 7 aa, Artificial Sequence
  Synthetic Construct
TTMGTML

SEQ ID NO: 14605 - protein, 7 aa, Artificial Sequence
  Synthetic Construct
TNGGVPI

SEQ ID NO: 14606 - protein, 7 aa, Artificial Sequence
  Synthetic Construct
KSNEGNG

SEQ ID NO: 14607 - protein, 7 aa, Artificial Sequence
  Synthetic Construct
NVAMTTL

SEQ ID NO: 14608 - protein, 7 aa, Artificial Sequence
  Synthetic Construct
YSGHTPM

SEQ ID NO: 14609 - protein, 7 aa, Artificial Sequence
  Synthetic Construct
GTPNRAL

SEQ ID NO: 14610 - protein, 7 aa, Artificial Sequence
  Synthetic Construct
RSGPTQP

SEQ ID NO: 14611 - protein, 7 aa, Artificial Sequence
  Synthetic Construct
IFNLKQD

SEQ ID NO: 14612 - protein, 7 aa, Artificial Sequence
  Synthetic Construct
HAMSLSP

SEQ ID NO: 14613 - protein, 7 aa, Artificial Sequence
  Synthetic Construct
SESMLRE

SEQ ID NO: 14614 - protein, 7 aa, Artificial Sequence
  Synthetic Construct
LPRPPQA

SEQ ID NO: 14615 - protein, 7 aa, Artificial Sequence
  Synthetic Construct
LGLGALS

SEQ ID NO: 14616 - protein, 7 aa, Artificial Sequence
  Synthetic Construct
IPKSADI

SEQ ID NO: 14617 - protein, 7 aa, Artificial Sequence
  Synthetic Construct
AQSLRTM

SEQ ID NO: 14618 - protein, 7 aa, Artificial Sequence
  Synthetic Construct
MLTSSLD

SEQ ID NO: 14619 - protein, 7 aa, Artificial Sequence
  Synthetic Construct
IYRDNER

SEQ ID NO: 14620 - protein, 7 aa, Artificial Sequence
  Synthetic Construct
SPPTMPA

SEQ ID NO: 14621 - protein, 7 aa, Artificial Sequence
  Synthetic Construct
PMRSGTP

SEQ ID NO: 14622 - protein, 7 aa, Artificial Sequence
  Synthetic Construct
LLSKSSE

SEQ ID NO: 14623 - protein, 7 aa, Artificial Sequence
  Synthetic Construct
TANFQER

SEQ ID NO: 14624 - protein, 7 aa, Artificial Sequence
  Synthetic Construct
SGNRPVT

SEQ ID NO: 14625 - protein, 7 aa, Artificial Sequence
  Synthetic Construct
LNQVDSR

SEQ ID NO: 14626 - protein, 7 aa, Artificial Sequence
  Synthetic Construct
ITPSSSK

SEQ ID NO: 14627 - protein, 7 aa, Artificial Sequence
  Synthetic Construct
DVSLTKA

SEQ ID NO: 14628 - protein, 7 aa, Artificial Sequence
  Synthetic Construct
INMRTAV

SEQ ID NO: 14629 - protein, 7 aa, Artificial Sequence
  Synthetic Construct
SKNTGSA

SEQ ID NO: 14630 - protein, 7 aa, Artificial Sequence
  Synthetic Construct
GSAHQEP

SEQ ID NO: 14631 - protein, 7 aa, Artificial Sequence
  Synthetic Construct
SKNALNH

SEQ ID NO: 14632 - protein, 7 aa, Artificial Sequence
  Synthetic Construct
GKAVSVS

SEQ ID NO: 14633 - protein, 7 aa, Artificial Sequence
  Synthetic Construct
YSGTGTV

SEQ ID NO: 14634 - protein, 7 aa, Artificial Sequence
  Synthetic Construct
SIPDRRG

SEQ ID NO: 14635 - protein, 7 aa, Artificial Sequence
  Synthetic Construct
NIANLNA

SEQ ID NO: 14636 - protein, 7 aa, Artificial Sequence
  Synthetic Construct
SGARELN

SEQ ID NO: 14637 - protein, 7 aa, Artificial Sequence
  Synthetic Construct
GHSYTKE

SEQ ID NO: 14638 - protein, 7 aa, Artificial Sequence
  Synthetic Construct
TLNSIRA

SEQ ID NO: 14639 - protein, 7 aa, Artificial Sequence
  Synthetic Construct
LSLSSIA

SEQ ID NO: 14640 - protein, 7 aa, Artificial Sequence
  Synthetic Construct
NVSRVTN

SEQ ID NO: 14641 - protein, 7 aa, Artificial Sequence
  Synthetic Construct
YDTTANR

SEQ ID NO: 14642 - protein, 7 aa, Artificial Sequence
  Synthetic Construct
IDRLNSS

SEQ ID NO: 14643 - protein, 7 aa, Artificial Sequence
  Synthetic Construct
TTTNRIS

SEQ ID NO: 14644 - protein, 7 aa, Artificial Sequence
  Synthetic Construct
FNTVRDR

SEQ ID NO: 14645 - protein, 7 aa, Artificial Sequence
  Synthetic Construct
RTLADEL

SEQ ID NO: 14646 - protein, 7 aa, Artificial Sequence
  Synthetic Construct
RHTIEQA

SEQ ID NO: 14647 - protein, 7 aa, Artificial Sequence
  Synthetic Construct
QTMGSSV

SEQ ID NO: 14648 - protein, 7 aa, Artificial Sequence
  Synthetic Construct
LNRPQHS

SEQ ID NO: 14649 - protein, 7 aa, Artificial Sequence
  Synthetic Construct
MSVALRG

SEQ ID NO: 14650 - protein, 7 aa, Artificial Sequence
  Synthetic Construct
DNLARMG

SEQ ID NO: 14651 - protein, 7 aa, Artificial Sequence
  Synthetic Construct
TAHNALL

SEQ ID NO: 14652 - protein, 7 aa, Artificial Sequence
  Synthetic Construct
HTDRSGL

SEQ ID NO: 14653 - protein, 7 aa, Artificial Sequence
  Synthetic Construct
YVGGIVP

SEQ ID NO: 14654 - protein, 7 aa, Artificial Sequence
  Synthetic Construct
KPNQTPN

SEQ ID NO: 14655 - protein, 7 aa, Artificial Sequence
  Synthetic Construct
AGSSLLP

SEQ ID NO: 14656 - protein, 7 aa, Artificial Sequence
  Synthetic Construct
SNVHDRS

SEQ ID NO: 14657 - protein, 7 aa, Artificial Sequence
  Synthetic Construct
VTKLGSP

SEQ ID NO: 14658 - protein, 7 aa, Artificial Sequence
  Synthetic Construct
RGVERSS

SEQ ID NO: 14659 - protein, 7 aa, Artificial Sequence
  Synthetic Construct
TSLSGSN

SEQ ID NO: 14660 - protein, 7 aa, Artificial Sequence
  Synthetic Construct
LSLSTNN

SEQ ID NO: 14661 - protein, 7 aa, Artificial Sequence
  Synthetic Construct
LGQITRP

SEQ ID NO: 14662 - protein, 7 aa, Artificial Sequence
  Synthetic Construct
NASPGSS

SEQ ID NO: 14663 - protein, 7 aa, Artificial Sequence
  Synthetic Construct
MKANSLS

SEQ ID NO: 14664 - protein, 7 aa, Artificial Sequence
  Synthetic Construct
HKGMANS

SEQ ID NO: 14665 - protein, 7 aa, Artificial Sequence
  Synthetic Construct
GRNNYPD

SEQ ID NO: 14666 - protein, 7 aa, Artificial Sequence
  Synthetic Construct
LPDQKWQ

SEQ ID NO: 14667 - protein, 7 aa, Artificial Sequence
  Synthetic Construct
GVNNRGS

SEQ ID NO: 14668 - protein, 7 aa, Artificial Sequence
  Synthetic Construct
NRIGMQP

SEQ ID NO: 14669 - protein, 7 aa, Artificial Sequence
  Synthetic Construct
EKVPSLN

SEQ ID NO: 14670 - protein, 7 aa, Artificial Sequence
  Synthetic Construct
GRDSSNP

SEQ ID NO: 14671 - protein, 7 aa, Artificial Sequence
  Synthetic Construct
TGRPNLM

SEQ ID NO: 14672 - protein, 7 aa, Artificial Sequence
  Synthetic Construct
VAGRSPM

SEQ ID NO: 14673 - protein, 7 aa, Artificial Sequence
  Synthetic Construct
LPHVSVP

SEQ ID NO: 14674 - protein, 7 aa, Artificial Sequence
  Synthetic Construct
LRTGSFA

SEQ ID NO: 14675 - protein, 7 aa, Artificial Sequence
  Synthetic Construct
AGVSSGS

SEQ ID NO: 14676 - protein, 7 aa, Artificial Sequence
  Synthetic Construct
WRDSGHG

SEQ ID NO: 14677 - protein, 7 aa, Artificial Sequence
  Synthetic Construct
SFGNRPV

SEQ ID NO: 14678 - protein, 7 aa, Artificial Sequence
  Synthetic Construct
KVSHNGD

SEQ ID NO: 14679 - protein, 7 aa, Artificial Sequence
  Synthetic Construct
NTPPYVQ

SEQ ID NO: 14680 - protein, 7 aa, Artificial Sequence
  Synthetic Construct
KKDNNQP

SEQ ID NO: 14681 - protein, 7 aa, Artificial Sequence
  Synthetic Construct
TIKSLPV

SEQ ID NO: 14682 - protein, 7 aa, Artificial Sequence
  Synthetic Construct
INAMRSQ

SEQ ID NO: 14683 - protein, 7 aa, Artificial Sequence
  Synthetic Construct
GNSIAKG

SEQ ID NO: 14684 - protein, 7 aa, Artificial Sequence
  Synthetic Construct
VTTPKAF

SEQ ID NO: 14685 - protein, 7 aa, Artificial Sequence
  Synthetic Construct
GSVAGSR

SEQ ID NO: 14686 - protein, 7 aa, Artificial Sequence
  Synthetic Construct
SANNAPK

SEQ ID NO: 14687 - protein, 7 aa, Artificial Sequence
  Synthetic Construct
DRLNPLP

SEQ ID NO: 14688 - protein, 7 aa, Artificial Sequence
  Synthetic Construct
RNQPTDV

SEQ ID NO: 14689 - protein, 7 aa, Artificial Sequence
  Synthetic Construct
TQVGSGP

SEQ ID NO: 14690 - protein, 7 aa, Artificial Sequence
  Synthetic Construct
LSQVSRP

SEQ ID NO: 14691 - protein, 7 aa, Artificial Sequence
  Synthetic Construct
NGANLQM

SEQ ID NO: 14692 - protein, 7 aa, Artificial Sequence
  Synthetic Construct
MLTTNSV

SEQ ID NO: 14693 - protein, 7 aa, Artificial Sequence
  Synthetic Construct
TSTRPSP

SEQ ID NO: 14694 - protein, 7 aa, Artificial Sequence
  Synthetic Construct
KYIGSGE

SEQ ID NO: 14695 - protein, 7 aa, Artificial Sequence
  Synthetic Construct
NNLTRVT

SEQ ID NO: 14696 - protein, 7 aa, Artificial Sequence
  Synthetic Construct
KIETMMP

SEQ ID NO: 14697 - protein, 7 aa, Artificial Sequence
  Synthetic Construct
LSHHTRD

SEQ ID NO: 14698 - protein, 7 aa, Artificial Sequence
  Synthetic Construct
TRTNPTE

SEQ ID NO: 14699 - protein, 7 aa, Artificial Sequence
  Synthetic Construct
STRNVVG

SEQ ID NO: 14700 - protein, 7 aa, Artificial Sequence
  Synthetic Construct
SVDLRKD

SEQ ID NO: 14701 - protein, 7 aa, Artificial Sequence
  Synthetic Construct
NAAAPAR

SEQ ID NO: 14702 - protein, 7 aa, Artificial Sequence
  Synthetic Construct
TQIAISP

SEQ ID NO: 14703 - protein, 7 aa, Artificial Sequence
  Synthetic Construct
QKNLSQS

SEQ ID NO: 14704 - protein, 7 aa, Artificial Sequence
  Synthetic Construct
TSMGGEP

SEQ ID NO: 14705 - protein, 7 aa, Artificial Sequence
  Synthetic Construct
STSHQNT

SEQ ID NO: 14706 - protein, 7 aa, Artificial Sequence
  Synthetic Construct
LRGSMQS

SEQ ID NO: 14707 - protein, 7 aa, Artificial Sequence
  Synthetic Construct
VTHQIHN

SEQ ID NO: 14708 - protein, 7 aa, Artificial Sequence
  Synthetic Construct
NVRNAPG

SEQ ID NO: 14709 - protein, 7 aa, Artificial Sequence
  Synthetic Construct
QSRSAAA

SEQ ID NO: 14710 - protein, 7 aa, Artificial Sequence
  Synthetic Construct
HNQAPSG

SEQ ID NO: 14711 - protein, 7 aa, Artificial Sequence
  Synthetic Construct
IGSMHHT

SEQ ID NO: 14712 - protein, 7 aa, Artificial Sequence
  Synthetic Construct
TNPGPLA

SEQ ID NO: 14713 - protein, 7 aa, Artificial Sequence
  Synthetic Construct
NTPHNAS

SEQ ID NO: 14714 - protein, 7 aa, Artificial Sequence
  Synthetic Construct
RVIGNSS

SEQ ID NO: 14715 - protein, 7 aa, Artificial Sequence
  Synthetic Construct
STGNRSV

SEQ ID NO: 14716 - protein, 7 aa, Artificial Sequence
  Synthetic Construct
MNSEVTR

SEQ ID NO: 14717 - protein, 7 aa, Artificial Sequence
  Synthetic Construct
QQAKGST

SEQ ID NO: 14718 - protein, 7 aa, Artificial Sequence
  Synthetic Construct
LGIQRGG

SEQ ID NO: 14719 - protein, 7 aa, Artificial Sequence
  Synthetic Construct
HVGAATS

SEQ ID NO: 14720 - protein, 7 aa, Artificial Sequence
  Synthetic Construct
KWNSTME

SEQ ID NO: 14721 - protein, 7 aa, Artificial Sequence
  Synthetic Construct
SRVPESN

SEQ ID NO: 14722 - protein, 7 aa, Artificial Sequence
  Synthetic Construct
LMAKSMS

SEQ ID NO: 14723 - protein, 7 aa, Artificial Sequence
  Synthetic Construct
RPMEPSI

SEQ ID NO: 14724 - protein, 7 aa, Artificial Sequence
  Synthetic Construct
QVTSSRP

SEQ ID NO: 14725 - protein, 7 aa, Artificial Sequence
  Synthetic Construct
RDANMSS

SEQ ID NO: 14726 - protein, 7 aa, Artificial Sequence
  Synthetic Construct
GLLSQDG

SEQ ID NO: 14727 - protein, 7 aa, Artificial Sequence
  Synthetic Construct
TINAHSI

SEQ ID NO: 14728 - protein, 7 aa, Artificial Sequence
  Synthetic Construct
LTGNKPQ

SEQ ID NO: 14729 - protein, 7 aa, Artificial Sequence
  Synthetic Construct
TFDTNKT

SEQ ID NO: 14730 - protein, 7 aa, Artificial Sequence
  Synthetic Construct
TLQTTRL

SEQ ID NO: 14731 - protein, 7 aa, Artificial Sequence
  Synthetic Construct
TSQMRSP

SEQ ID NO: 14732 - protein, 7 aa, Artificial Sequence
  Synthetic Construct
VSPSNKA

SEQ ID NO: 14733 - protein, 7 aa, Artificial Sequence
  Synthetic Construct
LNRTYPP

SEQ ID NO: 14734 - protein, 7 aa, Artificial Sequence
  Synthetic Construct
NAELAVR

SEQ ID NO: 14735 - protein, 7 aa, Artificial Sequence
  Synthetic Construct
RPNTTTD

SEQ ID NO: 14736 - protein, 7 aa, Artificial Sequence
  Synthetic Construct
TNRTQLY

SEQ ID NO: 14737 - protein, 7 aa, Artificial Sequence
  Synthetic Construct
PKSSGIN

SEQ ID NO: 14738 - protein, 7 aa, Artificial Sequence
  Synthetic Construct
NNSNTRQ

SEQ ID NO: 14739 - protein, 7 aa, Artificial Sequence
  Synthetic Construct
RVTDAGS

SEQ ID NO: 14740 - protein, 7 aa, Artificial Sequence
  Synthetic Construct
DTPTTRT

SEQ ID NO: 14741 - protein, 7 aa, Artificial Sequence
  Synthetic Construct
NLNLSMS

SEQ ID NO: 14742 - protein, 7 aa, Artificial Sequence
  Synthetic Construct
PNRTANN

SEQ ID NO: 14743 - protein, 7 aa, Artificial Sequence
  Synthetic Construct
WNRTSTA

SEQ ID NO: 14744 - protein, 7 aa, Artificial Sequence
  Synthetic Construct
QSNPVIP

SEQ ID NO: 14745 - protein, 7 aa, Artificial Sequence
  Synthetic Construct
IRNVTSD

SEQ ID NO: 14746 - protein, 7 aa, Artificial Sequence
  Synthetic Construct
EVTDTTR

SEQ ID NO: 14747 - protein, 7 aa, Artificial Sequence
  Synthetic Construct
AQNKSGP

SEQ ID NO: 14748 - protein, 7 aa, Artificial Sequence
  Synthetic Construct
YINQTES

SEQ ID NO: 14749 - protein, 7 aa, Artificial Sequence
  Synthetic Construct
RVPVSEN

SEQ ID NO: 14750 - protein, 7 aa, Artificial Sequence
  Synthetic Construct
QNGTKLQ

SEQ ID NO: 14751 - protein, 7 aa, Artificial Sequence
  Synthetic Construct
GYSNNTA

SEQ ID NO: 14752 - protein, 7 aa, Artificial Sequence
  Synthetic Construct
NRGMGNV

SEQ ID NO: 14753 - protein, 7 aa, Artificial Sequence
  Synthetic Construct
YMRDPST

SEQ ID NO: 14754 - protein, 7 aa, Artificial Sequence
  Synthetic Construct
SIPSRDV

SEQ ID NO: 14755 - protein, 7 aa, Artificial Sequence
  Synthetic Construct
GPVSMNS

SEQ ID NO: 14756 - protein, 7 aa, Artificial Sequence
  Synthetic Construct
SEGVTRL

SEQ ID NO: 14757 - protein, 7 aa, Artificial Sequence
  Synthetic Construct
SVNAGAM

SEQ ID NO: 14758 - protein, 7 aa, Artificial Sequence
  Synthetic Construct
EMTKTIP

SEQ ID NO: 14759 - protein, 7 aa, Artificial Sequence
  Synthetic Construct
HASVKMP

SEQ ID NO: 14760 - protein, 7 aa, Artificial Sequence
  Synthetic Construct
NNGLKLS

SEQ ID NO: 14761 - protein, 7 aa, Artificial Sequence
  Synthetic Construct
PVSHNAG

SEQ ID NO: 14762 - protein, 7 aa, Artificial Sequence
  Synthetic Construct
KVAAAAA

SEQ ID NO: 14763 - protein, 7 aa, Artificial Sequence
  Synthetic Construct
MANAIRS

SEQ ID NO: 14764 - protein, 7 aa, Artificial Sequence
  Synthetic Construct
FGQSTSG

SEQ ID NO: 14765 - protein, 7 aa, Artificial Sequence
  Synthetic Construct
TSSTILR

SEQ ID NO: 14766 - protein, 7 aa, Artificial Sequence
  Synthetic Construct
NVSRAEH

SEQ ID NO: 14767 - protein, 7 aa, Artificial Sequence
  Synthetic Construct
RTAPSTE

SEQ ID NO: 14768 - protein, 7 aa, Artificial Sequence
  Synthetic Construct
LARSEHL

SEQ ID NO: 14769 - protein, 7 aa, Artificial Sequence
  Synthetic Construct
STGHPSQ

SEQ ID NO: 14770 - protein, 7 aa, Artificial Sequence
  Synthetic Construct
SRPDKNL

SEQ ID NO: 14771 - protein, 7 aa, Artificial Sequence
  Synthetic Construct
KKSDSPN

SEQ ID NO: 14772 - protein, 7 aa, Artificial Sequence
  Synthetic Construct
VNSRIYA

SEQ ID NO: 14773 - protein, 7 aa, Artificial Sequence
  Synthetic Construct
LRQMANG

SEQ ID NO: 14774 - protein, 7 aa, Artificial Sequence
  Synthetic Construct
ERLKGSS

SEQ ID NO: 14775 - protein, 7 aa, Artificial Sequence
  Synthetic Construct
MSYMRVD

SEQ ID NO: 14776 - protein, 7 aa, Artificial Sequence
  Synthetic Construct
FNSKLQL

SEQ ID NO: 14777 - protein, 7 aa, Artificial Sequence
  Synthetic Construct
REHVNDS

SEQ ID NO: 14778 - protein, 7 aa, Artificial Sequence
  Synthetic Construct
GSPSQNT

SEQ ID NO: 14779 - protein, 7 aa, Artificial Sequence
  Synthetic Construct
HTAEKAP

SEQ ID NO: 14780 - protein, 7 aa, Artificial Sequence
  Synthetic Construct
SMSGKLD

SEQ ID NO: 14781 - protein, 7 aa, Artificial Sequence
  Synthetic Construct
TSQSRTS

SEQ ID NO: 14782 - protein, 7 aa, Artificial Sequence
  Synthetic Construct
WPTQSGS

SEQ ID NO: 14783 - protein, 7 aa, Artificial Sequence
  Synthetic Construct
DNTTRLK

SEQ ID NO: 14784 - protein, 7 aa, Artificial Sequence
  Synthetic Construct
SSAAGKW

SEQ ID NO: 14785 - protein, 7 aa, Artificial Sequence
  Synthetic Construct
SKFAHVA

SEQ ID NO: 14786 - protein, 7 aa, Artificial Sequence
  Synthetic Construct
QTYQGST

SEQ ID NO: 14787 - protein, 7 aa, Artificial Sequence
  Synthetic Construct
TVNLNRA

SEQ ID NO: 14788 - protein, 7 aa, Artificial Sequence
  Synthetic Construct
RYGSSLP

SEQ ID NO: 14789 - protein, 7 aa, Artificial Sequence
  Synthetic Construct
RSNSSNL

SEQ ID NO: 14790 - protein, 7 aa, Artificial Sequence
  Synthetic Construct
QGPSIRD

SEQ ID NO: 14791 - protein, 7 aa, Artificial Sequence
  Synthetic Construct
WRDLAPV

SEQ ID NO: 14792 - protein, 7 aa, Artificial Sequence
  Synthetic Construct
HSDIQRP

SEQ ID NO: 14793 - protein, 7 aa, Artificial Sequence
  Synthetic Construct
LAAMTNA

SEQ ID NO: 14794 - protein, 7 aa, Artificial Sequence
  Synthetic Construct
SANHTHT

SEQ ID NO: 14795 - protein, 7 aa, Artificial Sequence
  Synthetic Construct
GKLSVEN

SEQ ID NO: 14796 - protein, 7 aa, Artificial Sequence
  Synthetic Construct
KPGANPP

SEQ ID NO: 14797 - protein, 7 aa, Artificial Sequence
  Synthetic Construct
LTEGRHD

SEQ ID NO: 14798 - protein, 7 aa, Artificial Sequence
  Synthetic Construct
LGSNIYP

SEQ ID NO: 14799 - protein, 7 aa, Artificial Sequence
  Synthetic Construct
NGAHSSE

SEQ ID NO: 14800 - protein, 7 aa, Artificial Sequence
  Synthetic Construct
NTMGGAA

SEQ ID NO: 14801 - protein, 7 aa, Artificial Sequence
  Synthetic Construct
RTPIGQP

SEQ ID NO: 14802 - protein, 7 aa, Artificial Sequence
  Synthetic Construct
YSVAQQP

SEQ ID NO: 14803 - protein, 7 aa, Artificial Sequence
  Synthetic Construct
PHSKGML

SEQ ID NO: 14804 - protein, 7 aa, Artificial Sequence
  Synthetic Construct
VPAHGMG

SEQ ID NO: 14805 - protein, 7 aa, Artificial Sequence
  Synthetic Construct
IGGVPQR

SEQ ID NO: 14806 - protein, 7 aa, Artificial Sequence
  Synthetic Construct
VQGTVSR

SEQ ID NO: 14807 - protein, 7 aa, Artificial Sequence
  Synthetic Construct
SGGSGAP

SEQ ID NO: 14808 - protein, 7 aa, Artificial Sequence
  Synthetic Construct
KVPTQTE

SEQ ID NO: 14809 - protein, 7 aa, Artificial Sequence
  Synthetic Construct
ISTMKPS

SEQ ID NO: 14810 - protein, 7 aa, Artificial Sequence
  Synthetic Construct
SRVVEQA

SEQ ID NO: 14811 - protein, 7 aa, Artificial Sequence
  Synthetic Construct
VLSRQST

SEQ ID NO: 14812 - protein, 7 aa, Artificial Sequence
  Synthetic Construct
VVTTSSM

SEQ ID NO: 14813 - protein, 7 aa, Artificial Sequence
  Synthetic Construct
STGSSGL

SEQ ID NO: 14814 - protein, 7 aa, Artificial Sequence
  Synthetic Construct
PNRAANN

SEQ ID NO: 14815 - protein, 7 aa, Artificial Sequence
  Synthetic Construct
YPVNSQP

SEQ ID NO: 14816 - protein, 7 aa, Artificial Sequence
  Synthetic Construct
KSASPYD

SEQ ID NO: 14817 - protein, 7 aa, Artificial Sequence
  Synthetic Construct
SKSWGAA

SEQ ID NO: 14818 - protein, 7 aa, Artificial Sequence
  Synthetic Construct
SAMLKVD

SEQ ID NO: 14819 - protein, 7 aa, Artificial Sequence
  Synthetic Construct
RSQTIQA

SEQ ID NO: 14820 - protein, 7 aa, Artificial Sequence
  Synthetic Construct
PSSRLGD

SEQ ID NO: 14821 - protein, 7 aa, Artificial Sequence
  Synthetic Construct
IGPRGTQ

SEQ ID NO: 14822 - protein, 7 aa, Artificial Sequence
  Synthetic Construct
ASKGQYL

SEQ ID NO: 14823 - protein, 7 aa, Artificial Sequence
  Synthetic Construct
VRTLTVD

SEQ ID NO: 14824 - protein, 7 aa, Artificial Sequence
  Synthetic Construct
RGNAANE

SEQ ID NO: 14825 - protein, 7 aa, Artificial Sequence
  Synthetic Construct
FGSHPSV

SEQ ID NO: 14826 - protein, 7 aa, Artificial Sequence
  Synthetic Construct
GHPTPVN

SEQ ID NO: 14827 - protein, 7 aa, Artificial Sequence
  Synthetic Construct
SLNPVRM

SEQ ID NO: 14828 - protein, 7 aa, Artificial Sequence
  Synthetic Construct
SIRGQPF

SEQ ID NO: 14829 - protein, 7 aa, Artificial Sequence
  Synthetic Construct
TAKFNQG

SEQ ID NO: 14830 - protein, 7 aa, Artificial Sequence
  Synthetic Construct
LISTHDM

SEQ ID NO: 14831 - protein, 7 aa, Artificial Sequence
  Synthetic Construct
QSRDNIR

SEQ ID NO: 14832 - protein, 7 aa, Artificial Sequence
  Synthetic Construct
NNGNKGF

SEQ ID NO: 14833 - protein, 7 aa, Artificial Sequence
  Synthetic Construct
NVNYDGR

SEQ ID NO: 14834 - protein, 7 aa, Artificial Sequence
  Synthetic Construct
FMKGASA

SEQ ID NO: 14835 - protein, 7 aa, Artificial Sequence
  Synthetic Construct
LATSTQM

SEQ ID NO: 14836 - protein, 7 aa, Artificial Sequence
  Synthetic Construct
VHGGYSA

SEQ ID NO: 14837 - protein, 7 aa, Artificial Sequence
  Synthetic Construct
RGSEPMQ

SEQ ID NO: 14838 - protein, 7 aa, Artificial Sequence
  Synthetic Construct
GLRTSGT

SEQ ID NO: 14839 - protein, 7 aa, Artificial Sequence
  Synthetic Construct
LYKGGVS

SEQ ID NO: 14840 - protein, 7 aa, Artificial Sequence
  Synthetic Construct
MKTHSPP

SEQ ID NO: 14841 - DNA, 33 bp, Artificial Sequence; identical to SEQ ID NO: 1169
  Synthetic Construct

SEQ ID NO: 14842 - DNA, 33 bp, Artificial Sequence; identical to SEQ ID NO: 1246
  Synthetic Construct

SEQ ID NO: 14843 - DNA, 33 bp, Artificial Sequence; identical to SEQ ID NO: 1190
  Synthetic Construct

SEQ ID NO: 14844 - DNA, 33 bp, Artificial Sequence; identical to SEQ ID NO: 1391
  Synthetic Construct

SEQ ID NO: 14845 - DNA, 33 bp, Artificial Sequence; identical to SEQ ID NO: 1198
  Synthetic Construct

SEQ ID NO: 14846 - DNA, 33 bp, Artificial Sequence; identical to SEQ ID NO: 1510
  Synthetic Construct

SEQ ID NO: 14847 - DNA, 33 bp, Artificial Sequence; identical to SEQ ID NO: 1203
  Synthetic Construct

SEQ ID NO: 14848 - DNA, 33 bp, Artificial Sequence; identical to SEQ ID NO: 1319
  Synthetic Construct

SEQ ID NO: 14849 - DNA, 33 bp, Artificial Sequence; identical to SEQ ID NO: 1455
  Synthetic Construct

SEQ ID NO: 14850 - DNA, 33 bp, Artificial Sequence; identical to SEQ ID NO: 1417
  Synthetic Construct

SEQ ID NO: 14851 - DNA, 33 bp, Artificial Sequence; identical to SEQ ID NO: 1324
  Synthetic Construct

SEQ ID NO: 14852 - DNA, 33 bp, Artificial Sequence; identical to SEQ ID NO: 1165
  Synthetic Construct

SEQ ID NO: 14853 - DNA, 33 bp, Artificial Sequence; identical to SEQ ID NO: 1516
  Synthetic Construct

SEQ ID NO: 14854 - DNA, 33 bp, Artificial Sequence; identical to SEQ ID NO: 1120
  Synthetic Construct

SEQ ID NO: 14855 - DNA, 33 bp, Artificial Sequence; identical to SEQ ID NO: 1380
  Synthetic Construct

SEQ ID NO: 14856 - DNA, 33 bp, Artificial Sequence; identical to SEQ ID NO: 1367
  Synthetic Construct

SEQ ID NO: 14857 - DNA, 33 bp, Artificial Sequence; identical to SEQ ID NO: 1253
  Synthetic Construct

SEQ ID NO: 14858 - DNA, 33 bp, Artificial Sequence; identical to SEQ ID NO: 1322
  Synthetic Construct

SEQ ID NO: 14859 - DNA, 33 bp, Artificial Sequence; identical to SEQ ID NO: 1375
  Synthetic Construct

SEQ ID NO: 14860 - DNA, 33 bp, Artificial Sequence; identical to SEQ ID NO: 1414
  Synthetic Construct

SEQ ID NO: 14861 - DNA, 33 bp, Artificial Sequence; identical to SEQ ID NO: 1237
  Synthetic Construct

SEQ ID NO: 14862 - DNA, 33 bp, Artificial Sequence; identical to SEQ ID NO: 1385
  Synthetic Construct

SEQ ID NO: 14863 - DNA, 33 bp, Artificial Sequence; identical to SEQ ID NO: 1368
  Synthetic Construct

SEQ ID NO: 14864 - DNA, 33 bp, Artificial Sequence; identical to SEQ ID NO: 1330
  Synthetic Construct

SEQ ID NO: 14865 - DNA, 33 bp, Artificial Sequence; identical to SEQ ID NO: 1175
  Synthetic Construct

SEQ ID NO: 14866 - DNA, 33 bp, Artificial Sequence; identical to SEQ ID NO: 1387
  Synthetic Construct

SEQ ID NO: 14867 - DNA, 33 bp, Artificial Sequence; identical to SEQ ID NO: 1284
  Synthetic Construct

SEQ ID NO: 14868 - DNA, 33 bp, Artificial Sequence; identical to SEQ ID NO: 1199
  Synthetic Construct

SEQ ID NO: 14869 - DNA, 33 bp, Artificial Sequence; identical to SEQ ID NO: 1447
  Synthetic Construct

SEQ ID NO: 14870 - DNA, 33 bp, Artificial Sequence; identical to SEQ ID NO: 1408
  Synthetic Construct

SEQ ID NO: 14871 - DNA, 33 bp, Artificial Sequence; identical to SEQ ID NO: 1425
  Synthetic Construct

SEQ ID NO: 14872 - DNA, 33 bp, Artificial Sequence; identical to SEQ ID NO: 4565
  Synthetic Construct

SEQ ID NO: 14873 - DNA, 33 bp, Artificial Sequence; identical to SEQ ID NO: 1468
  Synthetic Construct

SEQ ID NO: 14874 - DNA, 33 bp, Artificial Sequence; identical to SEQ ID NO: 1167
  Synthetic Construct

SEQ ID NO: 14875 - DNA, 33 bp, Artificial Sequence; identical to SEQ ID NO: 1293
  Synthetic Construct

SEQ ID NO: 14876 - DNA, 33 bp, Artificial Sequence; identical to SEQ ID NO: 1256
  Synthetic Construct

SEQ ID NO: 14877 - DNA, 33 bp, Artificial Sequence; identical to SEQ ID NO: 1415
  Synthetic Construct

SEQ ID NO: 14878 - DNA, 33 bp, Artificial Sequence; identical to SEQ ID NO: 1497
  Synthetic Construct

SEQ ID NO: 14879 - DNA, 33 bp, Artificial Sequence; identical to SEQ ID NO: 1163
  Synthetic Construct

SEQ ID NO: 14880 - DNA, 33 bp, Artificial Sequence; identical to SEQ ID NO: 1509
  Synthetic Construct

SEQ ID NO: 14881 - protein, 11 aa, Artificial Sequence
  Synthetic Construct
AQSNSIRLVAQ

SEQ ID NO: 14882 - protein, 11 aa, Artificial Sequence
  Synthetic Construct
AQPNTIRNVAQ

SEQ ID NO: 14883 - protein, 11 aa, Artificial Sequence
  Synthetic Construct
AQTSLGYSSAQ

SEQ ID NO: 14884 - protein, 11 aa, Artificial Sequence
  Synthetic Construct
AQMGADHRTAQ

SEQ ID NO: 14885 - protein, 11 aa, Artificial Sequence
  Synthetic Construct
AQGDNSLTRAQ

SEQ ID NO: 14886 - protein, 11 aa, Artificial Sequence
  Synthetic Construct
AQTPQSQEMAQ

SEQ ID NO: 14887 - protein, 11 aa, Artificial Sequence
  Synthetic Construct
AQSGVSTTDAQ

SEQ ID NO: 14888 - protein, 11 aa, Artificial Sequence
  Synthetic Construct
AQEGLGNAAAQ

SEQ ID NO: 14889 - protein, 11 aa, Artificial Sequence
  Synthetic Construct
AQIAENLSAAQ

SEQ ID NO: 14890 - protein, 11 aa, Artificial Sequence
  Synthetic Construct
AQLGDITGFAQ

SEQ ID NO: 14891 - protein, 11 aa, Artificial Sequence
  Synthetic Construct
AQSQLHRLQAQ

SEQ ID NO: 14892 - protein, 11 aa, Artificial Sequence
  Synthetic Construct
AQPIITMPAAQ

SEQ ID NO: 14893 - protein, 11 aa, Artificial Sequence
  Synthetic Construct
AQWSHSENSAQ

SEQ ID NO: 14894 - protein, 11 aa, Artificial Sequence
  Synthetic Construct
AQLTQQTDVAQ

SEQ ID NO: 14895 - protein, 11 aa, Artificial Sequence
  Synthetic Construct
AQGMSGVAQAQ

SEQ ID NO: 14896 - protein, 11 aa, Artificial Sequence
  Synthetic Construct
AQPTNIMLDAQ

SEQ ID NO: 14897 - protein, 11 aa, Artificial Sequence
  Synthetic Construct
AQNPTLITLAQ

SEQ ID NO: 14898 - protein, 11 aa, Artificial Sequence
  Synthetic Construct
AQPGGGLTPAQ

SEQ ID NO: 14899 - protein, 11 aa, Artificial Sequence
  Synthetic Construct
AQDRDSVQNAQ

SEQ ID NO: 14900 - protein, 11 aa, Artificial Sequence
  Synthetic Construct
AQLNGLNVSAQ

SEQ ID NO: 14901 - protein, 11 aa, Artificial Sequence
  Synthetic Construct
AQAQTSNDPAQ

SEQ ID NO: 14902 - protein, 11 aa, Artificial Sequence
  Synthetic Construct
AQSAPNVTIAQ

SEQ ID NO: 14903 - protein, 11 aa, Artificial Sequence
  Synthetic Construct
AQPNMSAMIAQ

SEQ ID NO: 14904 - protein, 11 aa, Artificial Sequence
  Synthetic Construct
AQYSADKTTAQ

SEQ ID NO: 14905 - protein, 11 aa, Artificial Sequence
  Synthetic Construct
AQRVDAVLSAQ

SEQ ID NO: 14906 - protein, 11 aa, Artificial Sequence
  Synthetic Construct
AQGTAVFTAAQ

SEQ ID NO: 14907 - protein, 11 aa, Artificial Sequence
  Synthetic Construct
AQTLSGALTAQ

SEQ ID NO: 14908 - protein, 11 aa, Artificial Sequence
  Synthetic Construct
AQHADNRLKAQ

SEQ ID NO: 14909 - protein, 11 aa, Artificial Sequence
  Synthetic Construct
AQTQGPGPKAQ

SEQ ID NO: 14910 - protein, 11 aa, Artificial Sequence
  Synthetic Construct
AQVDALSHMAQ

SEQ ID NO: 14911 - protein, 11 aa, Artificial Sequence
  Synthetic Construct
AQRNDAILNAQ

SEQ ID NO: 14912 - protein, 11 aa, Artificial Sequence
  Synthetic Construct
AQLTVAVETAQ

SEQ ID NO: 14913 - protein, 11 aa, Artificial Sequence
  Synthetic Construct
AQSQAIAPKAQ

SEQ ID NO: 14914 - protein, 11 aa, Artificial Sequence
  Synthetic Construct
AQVLSVNHLAQ

SEQ ID NO: 14915 - protein, 11 aa, Artificial Sequence
  Synthetic Construct
AQSIYYHTEAQ

SEQ ID NO: 14916 - protein, 11 aa, Artificial Sequence
  Synthetic Construct
AQMNILREVAQ

SEQ ID NO: 14917 - protein, 11 aa, Artificial Sequence
  Synthetic Construct
AQNMLKQSEAQ

SEQ ID NO: 14918 - protein, 11 aa, Artificial Sequence
  Synthetic Construct
AQFMPISSAAQ

SEQ ID NO: 14919 - protein, 11 aa, Artificial Sequence
  Synthetic Construct
AQKNAPMPDAQ

SEQ ID NO: 14920 - protein, 11 aa, Artificial Sequence
  Synthetic Construct
AQTNYDLRAAQ

SEQ ID NO: 14921 - protein, 7 aa, Artificial Sequence
  Synthetic Construct
SNSIRLV

SEQ ID NO: 14922 - protein, 7 aa, Artificial Sequence
  Synthetic Construct
PNTIRNV

SEQ ID NO: 14923 - protein, 7 aa, Artificial Sequence
  Synthetic Construct
TSLGYSS

SEQ ID NO: 14924 - protein, 7 aa, Artificial Sequence
  Synthetic Construct
MGADHRT

SEQ ID NO: 14925 - protein, 7 aa, Artificial Sequence
  Synthetic Construct
GDNSLTR

SEQ ID NO: 14926 - protein, 7 aa, Artificial Sequence
  Synthetic Construct
TPQSQEM

SEQ ID NO: 14927 - protein, 7 aa, Artificial Sequence
  Synthetic Construct
SGVSTTD

SEQ ID NO: 14928 - protein, 7 aa, Artificial Sequence
  Synthetic Construct
EGLGNAA

SEQ ID NO: 14929 - protein, 7 aa, Artificial Sequence
  Synthetic Construct
IAENLSA

SEQ ID NO: 14930 - protein, 7 aa, Artificial Sequence
  Synthetic Construct
LGDITGF

SEQ ID NO: 14931 - protein, 7 aa, Artificial Sequence
  Synthetic Construct
SQLHRLQ

SEQ ID NO: 14932 - protein, 7 aa, Artificial Sequence
  Synthetic Construct
PIITMPA

SEQ ID NO: 14933 - protein, 7 aa, Artificial Sequence
  Synthetic Construct
WSHSENS

SEQ ID NO: 14934 - protein, 7 aa, Artificial Sequence
  Synthetic Construct
LTQQTDV

SEQ ID NO: 14935 - protein, 7 aa, Artificial Sequence
  Synthetic Construct
GMSGVAQ

SEQ ID NO: 14936 - protein, 7 aa, Artificial Sequence
  Synthetic Construct
PTNIMLD

SEQ ID NO: 14937 - protein, 7 aa, Artificial Sequence
  Synthetic Construct
NPTLITL

SEQ ID NO: 14938 - protein, 7 aa, Artificial Sequence
  Synthetic Construct
PGGGLTP

SEQ ID NO: 14939 - protein, 7 aa, Artificial Sequence
  Synthetic Construct
DRDSVQN

SEQ ID NO: 14940 - protein, 7 aa, Artificial Sequence
  Synthetic Construct
LNGLNVS

SEQ ID NO: 14941 - protein, 7 aa, Artificial Sequence
  Synthetic Construct
AQTSNDP

SEQ ID NO: 14942 - protein, 7 aa, Artificial Sequence
  Synthetic Construct
SAPNVTI

SEQ ID NO: 14943 - protein, 7 aa, Artificial Sequence
  Synthetic Construct
PNMSAMI

SEQ ID NO: 14944 - protein, 7 aa, Artificial Sequence
  Synthetic Construct
YSADKTT

SEQ ID NO: 14945 - protein, 7 aa, Artificial Sequence
  Synthetic Construct
RVDAVLS

SEQ ID NO: 14946 - protein, 7 aa, Artificial Sequence
  Synthetic Construct
GTAVFTA

SEQ ID NO: 14947 - protein, 7 aa, Artificial Sequence
  Synthetic Construct
TLSGALT

SEQ ID NO: 14948 - protein, 7 aa, Artificial Sequence
  Synthetic Construct
HADNRLK

SEQ ID NO: 14949 - protein, 7 aa, Artificial Sequence
  Synthetic Construct
TQGPGPK

SEQ ID NO: 14950 - protein, 7 aa, Artificial Sequence
  Synthetic Construct
VDALSHM

SEQ ID NO: 14951 - protein, 7 aa, Artificial Sequence
  Synthetic Construct
RNDAILN

SEQ ID NO: 14952 - protein, 7 aa, Artificial Sequence
  Synthetic Construct
LTVAVET

SEQ ID NO: 14953 - protein, 7 aa, Artificial Sequence
  Synthetic Construct
SQAIAPK

SEQ ID NO: 14954 - protein, 7 aa, Artificial Sequence
  Synthetic Construct
VLSVNHL

SEQ ID NO: 14955 - protein, 7 aa, Artificial Sequence
  Synthetic Construct
SIYYHTE

SEQ ID NO: 14956 - protein, 7 aa, Artificial Sequence
  Synthetic Construct
MNILREV

SEQ ID NO: 14957 - protein, 7 aa, Artificial Sequence
  Synthetic Construct
NMLKQSE

SEQ ID NO: 14958 - protein, 7 aa, Artificial Sequence
  Synthetic Construct
FMPISSA

SEQ ID NO: 14959 - protein, 7 aa, Artificial Sequence
  Synthetic Construct
KNAPMPD

SEQ ID NO: 14960 - protein, 7 aa, Artificial Sequence
  Synthetic Construct
TNYDLRA

SEQ ID NO: 14961 - DNA, 33 bp, Artificial Sequence
  Synthetic Construct
gcccaaaaagcctacagcgtccaagtcgcacag

SEQ ID NO: 14962 - DNA, 33 bp, Artificial Sequence
  Synthetic Construct
gcccaaagaaccgccaacgccctcggcgcacag

SEQ ID NO: 14963 - DNA, 33 bp, Artificial Sequence
  Synthetic Construct
gcccaagtgacgggggttcggattggggcacag

SEQ ID NO: 14964 - DNA, 33 bp, Artificial Sequence
  Synthetic Construct
gcccaaccgcggccggtgtcgaatggggcacag

SEQ ID NO: 14965 - DNA, 33 bp, Artificial Sequence
  Synthetic Construct
gcccaattcagcgtcaccagacaagccgcacag

SEQ ID NO: 14966 - DNA, 33 bp, Artificial Sequence
  Synthetic Construct
gcccaatacccccacatgacccacgacgcacag

SEQ ID NO: 14967 - DNA, 33 bp, Artificial Sequence
  Synthetic Construct
gcccaaagcagcagactcagcgtcggcgcacag

SEQ ID NO: 14968 - DNA, 33 bp, Artificial Sequence; identical to SEQ ID NO: 1965
  Synthetic Construct

SEQ ID NO: 14969 - DNA, 33 bp, Artificial Sequence; identical to SEQ ID NO: 5208
  Synthetic Construct

SEQ ID NO: 14970 - DNA, 33 bp, Artificial Sequence; identical to SEQ ID NO: 5521
  Synthetic Construct

SEQ ID NO: 14971 - DNA, 33 bp, Artificial Sequence; identical to SEQ ID NO: 3281
  Synthetic Construct

SEQ ID NO: 14972 - DNA, 33 bp, Artificial Sequence; identical to SEQ ID NO: 5208
  Synthetic Construct

SEQ ID NO: 14973 - DNA, 33 bp, Artificial Sequence; identical to SEQ ID NO: 3766
  Synthetic Construct

SEQ ID NO: 14974 - DNA, 33 bp, Artificial Sequence
  Synthetic Construct
gcccaaaggcttgataggactggtttggcacag

SEQ ID NO: 14975 - DNA, 33 bp, Artificial Sequence
  Synthetic Construct
gcccaagtggcgggtctgactgttcaggcacag

SEQ ID NO: 14976 - DNA, 33 bp, Artificial Sequence
  Synthetic Construct
gcccaacattctgcgaagactattgcggcacag

SEQ ID NO: 14977 - DNA, 33 bp, Artificial Sequence
  Synthetic Construct
gcccaaagcatcagagcccccgtcagcgcacag

SEQ ID NO: 14978 - DNA, 33 bp, Artificial Sequence
  Synthetic Construct
gcccaacccgtcggcaccagaaccagcgcacag

SEQ ID NO: 14979 - DNA, 33 bp, Artificial Sequence
  Synthetic Construct
gcccaaatcaacaccgccagctacaaagcacag

SEQ ID NO: 14980 - DNA, 33 bp, Artificial Sequence
  Synthetic Construct
gcccaagggaggacggtgcaggatagggcacag

SEQ ID NO: 14981 - DNA, 33 bp, Artificial Sequence
  Synthetic Construct
gcccaaagactcaccaacagcaaccaagcacag

SEQ ID NO: 14982 - DNA, 33 bp, Artificial Sequence; identical to SEQ ID NO: 3861
  Synthetic Construct

SEQ ID NO: 14983 - DNA, 33 bp, Artificial Sequence
  Synthetic Construct
gcccaattttctggtagtgctagggttgcacag

SEQ ID NO: 14984 - DNA, 33 bp, Artificial Sequence
  Synthetic Construct
gcccaacgtcagcatcagcttcctatggcacag

SEQ ID NO: 14985 - DNA, 33 bp, Artificial Sequence
  Synthetic Construct
gcccaacccctcagaaacatcagcgccgcacag

SEQ ID NO: 14986 - DNA, 33 bp, Artificial Sequence; identical to SEQ ID NO: 1340
  Synthetic Construct

SEQ ID NO: 14987 - DNA, 33 bp, Artificial Sequence
  Synthetic Construct
gcccaaccttctggttctgcgcggagtgcacag

SEQ ID NO: 14988 - DNA, 33 bp, Artificial Sequence
  Synthetic Construct
gcccaaccgcgtcatgcgactcagtcggcacag

SEQ ID NO: 14989 - DNA, 33 bp, Artificial Sequence; identical to SEQ ID NO: 2383
  Synthetic Construct

SEQ ID NO: 14990 - DNA, 33 bp, Artificial Sequence; identical to SEQ ID NO: 1393
  Synthetic Construct

SEQ ID NO: 14991 - DNA, 33 bp, Artificial Sequence
  Synthetic Construct
gcccaaaccagaagcgaagtcatgaaagcacag

SEQ ID NO: 14992 - DNA, 33 bp, Artificial Sequence; identical to SEQ ID NO: 3239
  Synthetic Construct

SEQ ID NO: 14993 - DNA, 33 bp, Artificial Sequence
  Synthetic Construct
gcccaaatgctcagcggccaagccagagcacag

SEQ ID NO: 14994 - DNA, 33 bp, Artificial Sequence
  Synthetic Construct
gcccaatctatgcttacgagtattgttgcacag

SEQ ID NO: 14995 - DNA, 33 bp, Artificial Sequence
  Synthetic Construct
gcccaacttaggggttctgctcaggtggcacag

SEQ ID NO: 14996 - DNA, 33 bp, Artificial Sequence
  Synthetic Construct
gcccaaaaagccatcagcaccgccaacgcacag

SEQ ID NO: 14997 - DNA, 33 bp, Artificial Sequence; identical to SEQ ID NO: 1191
  Synthetic Construct

SEQ ID NO: 14998 - DNA, 33 bp, Artificial Sequence
  Synthetic Construct
gcccaaaagcgggcgcctgctgattctgcacag

SEQ ID NO: 14999 - DNA, 33 bp, Artificial Sequence
  Synthetic Construct
gcccaagctaatgcgatgggtgatcatgcacag

SEQ ID NO: 15000 - DNA, 33 bp, Artificial Sequence
  Synthetic Construct
gcccaaaacaccctcatcaacgtcagcgcacag

SEQ ID NO: 15001 - DNA, 33 bp, Artificial Sequence
  Synthetic Construct
gcccaatggtctgatcctagtgatctggcacag

SEQ ID NO: 15002 - DNA, 33 bp, Artificial Sequence; identical to SEQ ID NO: 2028
  Synthetic Construct

SEQ ID NO: 15003 - DNA, 33 bp, Artificial Sequence; identical to SEQ ID NO: 2045
  Synthetic Construct

SEQ ID NO: 15004 - DNA, 33 bp, Artificial Sequence
  Synthetic Construct
gcccaactttctactgcgttgactgtggcacag

SEQ ID NO: 15005 - DNA, 33 bp, Artificial Sequence; identical to SEQ ID NO: 4042
  Synthetic Construct

SEQ ID NO: 15006 - DNA, 33 bp, Artificial Sequence; identical to SEQ ID NO: 1418
  Synthetic Construct

SEQ ID NO: 15007 - DNA, 33 bp, Artificial Sequence; identical to SEQ ID NO: 3413
  Synthetic Construct

SEQ ID NO: 15008 - DNA, 33 bp, Artificial Sequence
  Synthetic Construct
gcccaaggtcttcagtcgccgaggtctgcacag

SEQ ID NO: 15009 - DNA, 33 bp, Artificial Sequence
  Synthetic Construct
gcccaaggggctgctggtaagagtttggcacag

SEQ ID NO: 15010 - DNA, 33 bp, Artificial Sequence; identical to SEQ ID NO: 1118
  Synthetic Construct

SEQ ID NO: 15011 - DNA, 33 bp, Artificial Sequence
  Synthetic Construct
gcccaaaaactcagcaccctccaccaagcacag

SEQ ID NO: 15012 - DNA, 33 bp, Artificial Sequence; identical to SEQ ID NO: 2953
  Synthetic Construct

SEQ ID NO: 15013 - DNA, 33 bp, Artificial Sequence
  Synthetic Construct
gcccaacttccgggtggtgcgaggttggcacag

SEQ ID NO: 15014 - DNA, 33 bp, Artificial Sequence
  Synthetic Construct
gcccaacttggttctgcgcttacgagggcacag

SEQ ID NO: 15015 - DNA, 33 bp, Artificial Sequence
  Synthetic Construct
gcccaaggcaccaccagaagccccaccgcacag

SEQ ID NO: 15016 - DNA, 33 bp, Artificial Sequence
  Synthetic Construct
gcccaaggtcatatttcggcgcttgcggcacag

SEQ ID NO: 15017 - DNA, 33 bp, Artificial Sequence; identical to SEQ ID NO: 2379
  Synthetic Construct

SEQ ID NO: 15018 - DNA, 33 bp, Artificial Sequence
  Synthetic Construct
gcccaatttcagcaggatacttatctggcacag

SEQ ID NO: 15019 - DNA, 33 bp, Artificial Sequence; identical to SEQ ID NO: 1639
  Synthetic Construct

SEQ ID NO: 15020 - DNA, 33 bp, Artificial Sequence
  Synthetic Construct
gcccaacttaaggttgcgtctggtttggcacag

SEQ ID NO: 15021 - DNA, 33 bp, Artificial Sequence; identical to SEQ ID NO: 1128
  Synthetic Construct

SEQ ID NO: 15022 - DNA, 33 bp, Artificial Sequence; identical to SEQ ID NO: 2226
  Synthetic Construct

SEQ ID NO: 15023 - DNA, 33 bp, Artificial Sequence
  Synthetic Construct
gcccaaagagacaccgtcagcagatacgcacag

SEQ ID NO: 15024 - DNA, 33 bp, Artificial Sequence
  Synthetic Construct
gcccaaatcaacaaagacaacaaccaagcacag

SEQ ID NO: 15025 - DNA, 33 bp, Artificial Sequence
  Synthetic Construct
gcccaaatggccaacaccagaagcgccgcacag

SEQ ID NO: 15026 - DNA, 33 bp, Artificial Sequence
  Synthetic Construct
gcccaagaaagcatccaacaactcagcgcacag

SEQ ID NO: 15027 - DNA, 33 bp, Artificial Sequence
  Synthetic Construct
gcccaactcaccagagtcggcaccgtcgcacag

SEQ ID NO: 15028 - DNA, 33 bp, Artificial Sequence
  Synthetic Construct
gcccaagtccaagtcgccatgagagccgcacag

SEQ ID NO: 15029 - DNA, 33 bp, Artificial Sequence; identical to SEQ ID NO: 1702
  Synthetic Construct

SEQ ID NO: 15030 - DNA, 33 bp, Artificial Sequence
  Synthetic Construct
gcccaacccagccacgccagagccagcgcacag

SEQ ID NO: 15031 - DNA, 33 bp, Artificial Sequence; identical to SEQ ID NO: 1549
  Synthetic Construct

SEQ ID NO: 15032 - DNA, 33 bp, Artificial Sequence; identical to SEQ ID NO: 4649
  Synthetic Construct

SEQ ID NO: 15033 - DNA, 33 bp, Artificial Sequence; identical to SEQ ID NO: 5285
  Synthetic Construct

SEQ ID NO: 15034 - DNA, 33 bp, Artificial Sequence; identical to SEQ ID NO: 2561
  Synthetic Construct

SEQ ID NO: 15035 - DNA, 33 bp, Artificial Sequence
  Synthetic Construct
gcccaatttcttcttacttcggatccggcacag

SEQ ID NO: 15036 - DNA, 33 bp, Artificial Sequence; identical to SEQ ID NO: 3415
  Synthetic Construct

SEQ ID NO: 15037 - DNA, 33 bp, Artificial Sequence
  Synthetic Construct
gcccaagtcagcatcagcgtcatgggcgcacag

SEQ ID NO: 15038 - DNA, 33 bp, Artificial Sequence; identical to SEQ ID NO: 1121
  Synthetic Construct

SEQ ID NO: 15039 - DNA, 33 bp, Artificial Sequence
  Synthetic Construct
gcccaacggactacggctaattcgcttgcacag

SEQ ID NO: 15040 - DNA, 33 bp, Artificial Sequence; identical to SEQ ID NO: 2854
  Synthetic Construct

SEQ ID NO: 15041 - DNA, 33 bp, Artificial Sequence
  Synthetic Construct
gcccaacacagcggccccaccagcagcgcacag

SEQ ID NO: 15042 - DNA, 33 bp, Artificial Sequence
  Synthetic Construct
gcccaaaaaaccaacaacaccgtcctcgcacag

SEQ ID NO: 15043 - DNA, 33 bp, Artificial Sequence
  Synthetic Construct
gcccaacccgccagaatccccggcagcgcacag

SEQ ID NO: 15044 - DNA, 33 bp, Artificial Sequence
  Synthetic Construct
gcccaattgtctgctcagcttccgcgggcacag

SEQ ID NO: 15045 - DNA, 33 bp, Artificial Sequence
  Synthetic Construct
gcccaagttggttctagtaatacgtatgcacag

SEQ ID NO: 15046 - DNA, 33 bp, Artificial Sequence
  Synthetic Construct
gcccaactcatcagcaccacccacagagcacag

SEQ ID NO: 15047 - DNA, 33 bp, Artificial Sequence
  Synthetic Construct
gcccaatatgttaatagtgctccgaaggcacag

SEQ ID NO: 15048 - DNA, 33 bp, Artificial Sequence; identical to SEQ ID NO: 3766
  Synthetic Construct

SEQ ID NO: 15049 - DNA, 33 bp, Artificial Sequence; identical to SEQ ID NO: 3545
  Synthetic Construct

SEQ ID NO: 15050 - DNA, 33 bp, Artificial Sequence; identical to SEQ ID NO: 1275
  Synthetic Construct

SEQ ID NO: 15051 - DNA, 33 bp, Artificial Sequence
  Synthetic Construct
gcccaacaccccagcctcagacaaagcgcacag

SEQ ID NO: 15052 - DNA, 33 bp, Artificial Sequence; identical to SEQ ID NO: 5636
  Synthetic Construct

SEQ ID NO: 15053 - DNA, 33 bp, Artificial Sequence; identical to SEQ ID NO: 15030
  Synthetic Construct

SEQ ID NO: 15054 - protein, 11 aa, Artificial Sequence
  Synthetic Construct
AQKAYSVQVAQ

SEQ ID NO: 15055 - protein, 11 aa, Artificial Sequence
  Synthetic Construct
AQRTANALGAQ

SEQ ID NO: 15056 - protein, 11 aa, Artificial Sequence
  Synthetic Construct
AQVTGVRIGAQ

SEQ ID NO: 15057 - protein, 11 aa, Artificial Sequence
  Synthetic Construct
AQPRPVSNGAQ

SEQ ID NO: 15058 - protein, 11 aa, Artificial Sequence
  Synthetic Construct
AQFSVTRQAAQ

SEQ ID NO: 15059 - protein, 11 aa, Artificial Sequence
  Synthetic Construct
AQYPHMTHDAQ

SEQ ID NO: 15060 - protein, 11 aa, Artificial Sequence
  Synthetic Construct
AQSSRLSVGAQ

SEQ ID NO: 15061 - protein, 11 aa, Artificial Sequence
  Synthetic Construct
AQPLSGGVRAQ

SEQ ID NO: 15062 - protein, 11 aa, Artificial Sequence
  Synthetic Construct
AQGLKVSGSAQ

SEQ ID NO: 15063 - protein, 11 aa, Artificial Sequence
  Synthetic Construct
AQSTRNVVGAQ

SEQ ID NO: 15064 - protein, 11 aa, Artificial Sequence
  Synthetic Construct
AQSGGTREGAQ

SEQ ID NO: 15065 - protein, 11 aa, Artificial Sequence
  Synthetic Construct
AQGLKVSGSAQ

SEQ ID NO: 15066 - protein, 11 aa, Artificial Sequence
  Synthetic Construct
AQNNNQKVYAQ

SEQ ID NO: 15067 - protein, 11 aa, Artificial Sequence
  Synthetic Construct
AQRLDRTGLAQ

SEQ ID NO: 15068 - protein, 11 aa, Artificial Sequence
  Synthetic Construct
AQVAGLTVQAQ

SEQ ID NO: 15069 - protein, 11 aa, Artificial Sequence
  Synthetic Construct
AQHSAKTIAAQ

SEQ ID NO: 15070 - protein, 11 aa, Artificial Sequence
  Synthetic Construct
AQSIRAPVSAQ

SEQ ID NO: 15071 - protein, 11 aa, Artificial Sequence
  Synthetic Construct
AQPVGTRTSAQ

SEQ ID NO: 15072 - protein, 11 aa, Artificial Sequence
  Synthetic Construct
AQINTASYKAQ

SEQ ID NO: 15073 - protein, 11 aa, Artificial Sequence
  Synthetic Construct
AQGRTVQDRAQ

SEQ ID NO: 15074 - protein, 11 aa, Artificial Sequence
  Synthetic Construct
AQRLTNSNQAQ

SEQ ID NO: 15075 - protein, 11 aa, Artificial Sequence
  Synthetic Construct
AQMIRGTSSAQ

SEQ ID NO: 15076 - protein, 11 aa, Artificial Sequence
  Synthetic Construct
AQFSGSARVAQ

SEQ ID NO: 15077 - protein, 11 aa, Artificial Sequence
  Synthetic Construct
AQRQHQLPMAQ

SEQ ID NO: 15078 - protein, 11 aa, Artificial Sequence
  Synthetic Construct
AQPLRNISAAQ

SEQ ID NO: 15079 - protein, 11 aa, Artificial Sequence
  Synthetic Construct
AQPYSGQRTAQ

SEQ ID NO: 15080 - protein, 11 aa, Artificial Sequence
  Synthetic Construct
AQPSGSARSAQ

SEQ ID NO: 15081 - protein, 11 aa, Artificial Sequence
  Synthetic Construct
AQPRHATQSAQ

SEQ ID NO: 15082 - protein, 11 aa, Artificial Sequence
  Synthetic Construct
AQSKVTPPLAQ

SEQ ID NO: 15083 - protein, 11 aa, Artificial Sequence
  Synthetic Construct
AQNTSGVPKAQ

SEQ ID NO: 15084 - protein, 11 aa, Artificial Sequence
  Synthetic Construct
AQTRSEVMKAQ

SEQ ID NO: 15085 - protein, 11 aa, Artificial Sequence
  Synthetic Construct
AQRTDVRTNAQ

SEQ ID NO: 15086 - protein, 11 aa, Artificial Sequence
  Synthetic Construct
AQMLSGQARAQ

SEQ ID NO: 15087 - protein, 11 aa, Artificial Sequence
  Synthetic Construct
AQSMLTSIVAQ

SEQ ID NO: 15088 - protein, 11 aa, Artificial Sequence
  Synthetic Construct
AQLRGSAQVAQ

SEQ ID NO: 15089 - protein, 11 aa, Artificial Sequence
  Synthetic Construct
AQKAISTANAQ

SEQ ID NO: 15090 - protein, 11 aa, Artificial Sequence
  Synthetic Construct
AQISGVQTRAQ

SEQ ID NO: 15091 - protein, 11 aa, Artificial Sequence
  Synthetic Construct
AQKRAPADSAQ

SEQ ID NO: 15092 - protein, 11 aa, Artificial Sequence
  Synthetic Construct
AQANAMGDHAQ

SEQ ID NO: 15093 - protein, 11 aa, Artificial Sequence
  Synthetic Construct
AQNTLINVSAQ

SEQ ID NO: 15094 - protein, 11 aa, Artificial Sequence
  Synthetic Construct
AQWSDPSDLAQ

SEQ ID NO: 15095 - protein, 11 aa, Artificial Sequence
  Synthetic Construct
AQRISTLGLAQ

SEQ ID NO: 15096 - protein, 11 aa, Artificial Sequence
  Synthetic Construct
AQFKVSIQQAQ

SEQ ID NO: 15097 - protein, 11 aa, Artificial Sequence
  Synthetic Construct
AQLSTALTVAQ

SEQ ID NO: 15098 - protein, 11 aa, Artificial Sequence
  Synthetic Construct
AQAEYNTGVAQ

SEQ ID NO: 15099 - protein, 11 aa, Artificial Sequence
  Synthetic Construct
AQISASHSRAQ

SEQ ID NO: 15100 - protein, 11 aa, Artificial Sequence
  Synthetic Construct
AQVNSHERAAQ

SEQ ID NO: 15101 - protein, 11 aa, Artificial Sequence
  Synthetic Construct
AQGLQSPRSAQ

SEQ ID NO: 15102 - protein, 11 aa, Artificial Sequence
  Synthetic Construct
AQGAAGKSLAQ

SEQ ID NO: 15103 - protein, 11 aa, Artificial Sequence
  Synthetic Construct
AQLSNSASQAQ

SEQ ID NO: 15104 - protein, 11 aa, Artificial Sequence
  Synthetic Construct
AQKLSTLHQAQ

SEQ ID NO: 15105 - protein, 11 aa, Artificial Sequence
  Synthetic Construct
AQMRGQGVHAQ

SEQ ID NO: 15106 - protein, 11 aa, Artificial Sequence
  Synthetic Construct
AQLPGGARLAQ

SEQ ID NO: 15107 - protein, 11 aa, Artificial Sequence
  Synthetic Construct
AQLGSALTRAQ

SEQ ID NO: 15108 - protein, 11 aa, Artificial Sequence
  Synthetic Construct
AQGTTRSPTAQ

SEQ ID NO: 15109 - protein, 11 aa, Artificial Sequence
  Synthetic Construct
AQGHISALAAQ

SEQ ID NO: 15110 - protein, 11 aa, Artificial Sequence
  Synthetic Construct
AQSISPPRTAQ

SEQ ID NO: 15111 - protein, 11 aa, Artificial Sequence
  Synthetic Construct
AQFQQDTYLAQ

SEQ ID NO: 15112 - protein, 11 aa, Artificial Sequence
  Synthetic Construct
AQLLATGLKAQ

SEQ ID NO: 15113 - protein, 11 aa, Artificial Sequence
  Synthetic Construct
AQLKVASGLAQ

SEQ ID NO: 15114 - protein, 11 aa, Artificial Sequence
  Synthetic Construct
AQFDNPNNVAQ

SEQ ID NO: 15115 - protein, 11 aa, Artificial Sequence
  Synthetic Construct
AQYLTSGGYAQ

SEQ ID NO: 15116 - protein, 11 aa, Artificial Sequence
  Synthetic Construct
AQRDTVSRYAQ

SEQ ID NO: 15117 - protein, 11 aa, Artificial Sequence
  Synthetic Construct
AQINKDNNQAQ

SEQ ID NO: 15118 - protein, 11 aa, Artificial Sequence
  Synthetic Construct
AQMANTRSAAQ

SEQ ID NO: 15119 - protein, 11 aa, Artificial Sequence
  Synthetic Construct
AQESIQQLSAQ

SEQ ID NO: 15120 - protein, 11 aa, Artificial Sequence
  Synthetic Construct
AQLTRVGTVAQ

SEQ ID NO: 15121 - protein, 11 aa, Artificial Sequence
  Synthetic Construct
AQVQVAMRAAQ

SEQ ID NO: 15122 - protein, 11 aa, Artificial Sequence
  Synthetic Construct
AQTAAHVSYAQ

SEQ ID NO: 15123 - protein, 11 aa, Artificial Sequence
  Synthetic Construct
AQPSHARASAQ

SEQ ID NO: 15124 - protein, 11 aa, Artificial Sequence
  Synthetic Construct
AQNVPTSPRAQ

SEQ ID NO: 15125 - protein, 11 aa, Artificial Sequence
  Synthetic Construct
AQKTQLGQMAQ

SEQ ID NO: 15126 - protein, 11 aa, Artificial Sequence
  Synthetic Construct
AQKANSQITAQ

SEQ ID NO: 15127 - protein, 11 aa, Artificial Sequence
  Synthetic Construct
AQNNSGHISAQ

SEQ ID NO: 15128 - protein, 11 aa, Artificial Sequence
  Synthetic Construct
AQFLLTSDPAQ

SEQ ID NO: 15129 - protein, 11 aa, Artificial Sequence
  Synthetic Construct
AQVKTDRVLAQ

SEQ ID NO: 15130 - protein, 11 aa, Artificial Sequence
  Synthetic Construct
AQVSISVMGAQ

SEQ ID NO: 15131 - protein, 11 aa, Artificial Sequence
  Synthetic Construct
AQAGLAHATAQ

SEQ ID NO: 15132 - protein, 11 aa, Artificial Sequence
  Synthetic Construct
AQRTTANSLAQ

SEQ ID NO: 15133 - protein, 11 aa, Artificial Sequence
  Synthetic Construct
AQSVPPNRNAQ

SEQ ID NO: 15134 - protein, 11 aa, Artificial Sequence
  Synthetic Construct
AQHSGPTSSAQ

SEQ ID NO: 15135 - protein, 11 aa, Artificial Sequence
  Synthetic Construct
AQKTNNTVLAQ

SEQ ID NO: 15136 - protein, 11 aa, Artificial Sequence
  Synthetic Construct
AQPARIPGSAQ

SEQ ID NO: 15137 - protein, 11 aa, Artificial Sequence
  Synthetic Construct
AQLSAQLPRAQ

SEQ ID NO: 15138 - protein, 11 aa, Artificial Sequence
  Synthetic Construct
AQVGSSNTYAQ

SEQ ID NO: 15139 - protein, 11 aa, Artificial Sequence
  Synthetic Construct
AQLISTTHRAQ

SEQ ID NO: 15140 - protein, 11 aa, Artificial Sequence
  Synthetic Construct
AQYVNSAPKAQ

SEQ ID NO: 15141 - protein, 11 aa, Artificial Sequence
  Synthetic Construct
AQNNNQKVYAQ

SEQ ID NO: 15142 - protein, 11 aa, Artificial Sequence
  Synthetic Construct
AQGTKTHSLAQ

SEQ ID NO: 15143 - protein, 11 aa, Artificial Sequence
  Synthetic Construct
AQPISANRLAQ

SEQ ID NO: 15144 - protein, 11 aa, Artificial Sequence
  Synthetic Construct
AQHPSLRQSAQ

SEQ ID NO: 15145 - protein, 11 aa, Artificial Sequence
  Synthetic Construct
AQPNRAANNAQ

SEQ ID NO: 15146 - protein, 11 aa, Artificial Sequence
  Synthetic Construct
AQPSHARASAQ

SEQ ID NO: 15147 - protein, 11 aa, Artificial Sequence
  Synthetic Construct
AQYTLSQGWAQ

SEQ ID NO: 15148 - protein, 12 aa, Artificial Sequence
  Synthetic Construct
AQQSVSKPFLAQ

SEQ ID NO: 15149 - protein, 11 aa, Artificial Sequence
  Synthetic Construct
AQFTLTTPKAQ

SEQ ID NO: 15150 - protein, 11 aa, Artificial Sequence
  Synthetic Construct
ESTLAVPFKAQ

SEQ ID NO: 15151 - protein, 11 aa, Artificial Sequence
  Synthetic Construct
GGTLAVPFKAQ

SEQ ID NO: 15152 - protein, 11 aa, Artificial Sequence
  Synthetic Construct
AQTLATPFKAQ

SEQ ID NO: 15153 - protein, 11 aa, Artificial Sequence
  Synthetic Construct
ATTLATPFKAQ

SEQ ID NO: 15154 - protein, 11 aa, Artificial Sequence
  Synthetic Construct
DGTLATPFKAQ

SEQ ID NO: 15155 - protein, 11 aa, Artificial Sequence
  Synthetic Construct
GGTLATPFKAQ

SEQ ID NO: 15156 - protein, 11 aa, Artificial Sequence
  Synthetic Construct
SGSLAVPFKAQ

SEQ ID NO: 15157 - protein, 11 aa, Artificial Sequence
  Synthetic Construct
AQTLAQPFKAQ

SEQ ID NO: 15158 - protein, 11 aa, Artificial Sequence
  Synthetic Construct
AQTLSNPFKAQ

SEQ ID NO: 15159 - protein, 11 aa, Artificial Sequence
  Synthetic Construct
AQTLSQPFKAQ

SEQ ID NO: 15160 - protein, 11 aa, Artificial Sequence
  Synthetic Construct
EGTLAVPFKAQ

SEQ ID NO: 15161 - protein, 11 aa, Artificial Sequence
  Synthetic Construct
DSTLAVPFKAQ

SEQ ID NO: 15162 - protein, 11 aa, Artificial Sequence
  Synthetic Construct
NQTLAVPFKAQ

SEQ ID NO: 15163 - protein, 11 aa, Artificial Sequence
  Synthetic Construct
SGNLAVPFKAQ

SEQ ID NO: 15164 - protein, 11 aa, Artificial Sequence
  Synthetic Construct
ATTLAVPFKAQ

SEQ ID NO: 15165 - protein, 11 aa, Artificial Sequence
  Synthetic Construct
AQTLTMPFKAQ

SEQ ID NO: 15166 - protein, 11 aa, Artificial Sequence
  Synthetic Construct
AQTLSTPFKAQ

SEQ ID NO: 15167 - protein, 11 aa, Artificial Sequence
  Synthetic Construct
QGTLAVPFKAQ

SEQ ID NO: 15168 - protein, 11 aa, Artificial Sequence
  Synthetic Construct
DGTLAVPFSNP

SEQ ID NO: 15169 - protein, 11 aa, Artificial Sequence
  Synthetic Construct
DGTLAVPFRAQ

SEQ ID NO: 15170 - protein, 11 aa, Artificial Sequence
  Synthetic Construct
AQNSREVNIAQ

SEQ ID NO: 15171 - protein, 11 aa, Artificial Sequence
  Synthetic Construct
AQTREVNVIAQ

SEQ ID NO: 15172 - protein, 11 aa, Artificial Sequence
  Synthetic Construct
AQIGMGHTLAQ

SEQ ID NO: 15173 - protein, 11 aa, Artificial Sequence
  Synthetic Construct
AQTAETKFLAQ

SEQ ID NO: 15174 - protein, 11 aa, Artificial Sequence
  Synthetic Construct
AQKATPPTEAQ

SEQ ID NO: 15175 - protein, 11 aa, Artificial Sequence
  Synthetic Construct
AQAETSRSVAQ

SEQ ID NO: 15176 - protein, 11 aa, Artificial Sequence
  Synthetic Construct
AQTNRTIQTAQ

SEQ ID NO: 15177 - protein, 11 aa, Artificial Sequence
  Synthetic Construct
AQYALTNDRAQ

SEQ ID NO: 15178 - protein, 11 aa, Artificial Sequence
  Synthetic Construct
AQSVTNKMLAQ

SEQ ID NO: 15179 - protein, 11 aa, Artificial Sequence
  Synthetic Construct
AQSVQIVRGAQ

SEQ ID NO: 15180 - protein, 11 aa, Artificial Sequence
  Synthetic Construct
AQYPNTSQVAQ

SEQ ID NO: 15181 - protein, 11 aa, Artificial Sequence
  Synthetic Construct
AQYTLSQGTAQ

SEQ ID NO: 15182 - protein, 11 aa, Artificial Sequence
  Synthetic Construct
AQWGLNRGTAQ

SEQ ID NO: 15183 - protein, 11 aa, Artificial Sequence
  Synthetic Construct
AQTPKNVPDAQ

SEQ ID NO: 15184 - protein, 11 aa, Artificial Sequence
  Synthetic Construct
AQYDPRGTDAQ

SEQ ID NO: 15185 - protein, 11 aa, Artificial Sequence
  Synthetic Construct
AQVDTRPIQAQ

SEQ ID NO: 15186 - protein, 11 aa, Artificial Sequence
  Synthetic Construct
AQTKSSYGVAQ

SEQ ID NO: 15187 - protein, 11 aa, Artificial Sequence
  Synthetic Construct
AQMNSTKNVAQ

SEQ ID NO: 15188 - protein, 11 aa, Artificial Sequence
  Synthetic Construct
AQSLHHGSSAQ

SEQ ID NO: 15189 - protein, 11 aa, Artificial Sequence
  Synthetic Construct
AQSSPGAMHAQ

SEQ ID NO: 15190 - protein, 11 aa, Artificial Sequence
  Synthetic Construct
AQSSYNDHPAQ

SEQ ID NO: 15191 - protein, 11 aa, Artificial Sequence
  Synthetic Construct
AQGAPRSSIAQ

SEQ ID NO: 15192 - protein, 11 aa, Artificial Sequence
  Synthetic Construct
AQQGSLYTSAQ

SEQ ID NO: 15193 - protein, 11 aa, Artificial Sequence
  Synthetic Construct
AQHNAPGSLAQ

SEQ ID NO: 15194 - protein, 11 aa, Artificial Sequence
  Synthetic Construct
AQSLSPTINAQ

SEQ ID NO: 15195 - protein, 11 aa, Artificial Sequence
  Synthetic Construct
AQNNVTLLSAQ

SEQ ID NO: 15196 - protein, 11 aa, Artificial Sequence
  Synthetic Construct
AQENRVKSAAQ

SEQ ID NO: 15197 - protein, 11 aa, Artificial Sequence
  Synthetic Construct
AQALNSVQPAQ

---

The invention claimed is:

1. An AAV capsid comprising:
   a) an AAV capsid protein comprising:
      i. a first amino acid sequence that is at least 98% identical to amino acid 217 to amino acid 736 of SEQ ID NO: 1; and
      ii. a second amino acid sequence identical to an amino acid sequence provided in Tables 2-3 or FIG. 33—inserted at an amino acid position 588_589 within SEQ ID NO: 1, wherein the AAV capsid protein comprises at least one of an increased specificity and an increased transduction efficiency when measured in a central nervous system (CNS) in a subject when delivered to the subject systemically, relative to a native AAV capsid protein provided in SEQ ID NO: 1.

2. The AAV capsid of claim 1, wherein the second amino acid sequence is selected from the group consisting of TALKPFL (SEQ ID NO: 436), TTLKPFL (SEQ ID NO: 437), TLQIPFK (SEQ ID NO: 435), TMQKPFI (SEQ ID NO: 440), SIERPFK (SEQ ID NO: 438), RYQGDSV (SEQ ID NO: 454), and TTLKPFS (SEQ ID NO: 5).

3. The AAV capsid of claim 1, wherein the AAV capsid protein is present in VP1, VP2, and VP3 of the AAV capsid.

4. The AAV capsid of claim 1, wherein the AAV capsid is chimeric.

5. The AAV capsid of claim 1, wherein 60 copies of the AAV capsid protein are assembled into the AAV capsid.

6. The AAV capsid protein of claim 1, wherein the CNS comprises a cell-type selected from the group consisting of a neuron, an oligodendrocyte, an astrocyte, and a brain vascular cell.

7. The AAV capsid of claim 1, wherein the CNS comprises a tissue that is selected from the group consisting of a brain, a thalamus, a cortex, a striatum, a ventral midbrain, and a spinal cord.

8. The AAV capsid of claim 1, wherein the AAV capsid protein further comprises an amino acid substitution A587D or Q588G.

9. The AAV capsid protein of claim 1, wherein the AAV capsid protein further comprises an amino acid substitution A589N or Q590P.

10. The AAV capsid of claim 1 that is isolated and purified.

11. The AAV capsid of claim 1 formulated as a pharmaceutical formulation for intravenous administration to treat a disease or a condition of the CNS, the pharmaceutical formulation further comprising a pharmaceutically acceptable carrier.

12. The AAV capsid of claim 11, wherein the pharmaceutical formulation further comprises a therapeutic agent.

* * * * *